United States Patent 6,812,339 (POLYMORPHISMS IN KNOWN GENES ASSOCIATED WITH HUMAN DISEASE, METHODS OF DETECTION AND USES THEREOF) - sequence listing, part 41

SEQ ID NO: 14097 - DNA, 10945 bp, Human
agaaaaggctctctatccaggttctgaacaataggaaatcatcaagaggatattggatgacaatatatgaaagatgttatttgagaaaggattctctcctgaggcatagatgttgaaccaaattctattagttatgcttttacagcaagatagtggtttacagcttacaaaaggcttgtacatcctctcatattaaaagttattagaacagtcctttgaagtagaaaagtaggcatttctattttacaaacgagttggccgagtatctgagatagtagataactcatagaaggtcatccgggaaacggggcagcagaactgggatcgaatgactctggtcatccaactccaaatgcaaaagtctttctgctgctgcttcctagttaaactctaagggtctaagactccattcctagttatggtctcaactacatttgctcattgctgtgaggggtcaacccacctcccggagtcctctcctgcacattctcatgttcctgaaaggcttttctgtcccttccactactccctgtaagctcctgtgcttcacaatttcttgttgaattttttctaatctgactctatcagttatgggaatgttccctcaattcttagtgctccaaaccggacttgctcttggcttgtatttgtccaaaatatttgtcttctctatgttttctacatgtttgtcttataaggacaaaaacctgccttagtttatccatgaacaaagccacgcatgctagtggacacacacacacatgcgcgtgcgcgcgcacacacacacacacacacatacacacagagactttgtatgtgagtaatgaatcatcaaatcatcataatttctggacttgtattaataagtcggccaggaggaaaagaatctgctgtcaatcatggcttctggttctcacagtcatctctactttcttccagcaagtttggttctgtcaaaaaccagctgtcagccttgttcctgcatgcccaatgcagaagagtcagtaaagaagatttggttctctgtatttcaggggcatcaatgccaggttgaaatatgccattctggcccagctcagtggctcacacgtgtaatcccagcactttggaaggccaaagcgggtggattgcttgagctcaggagttcgagaccagcctgggcaagaggctgaggtgggaggatgacctgagcccgggaggtcaaggctgcagcgagctgtgatcgtgccactgcactcgagccagggcgttggagtgagaccctgtcaaaaaaaaaaaaaaaaaggaaggaaaaaaggaaggaaggaagggagggagggaagatgccattcttagattgaagtggactttatctgggcagaacacacacacacatacacacatgcacacacacattgtggagaaattgctgactaagcaaagcttccaaatgacttagtttggctaaaatgtaggcttttaaaaatgtgagcactgccaagggtttttccttgttgacccatggatccatcaagtgcaaacattttctaatgcactatatttaagcctgtgcagctagatgtcattcaacatgaaatacattattacaacttgcatctgtctaaaatcttgcatctaaaatgagagacaaaaaatctataaaaatggaaaacatgcatagaaatatgtgagggaggaaaaaattacccccaagaatgttagtgcacgcagtcacacagggagaagactatttttgttttgttttgattgttttgttttgttttggttgttttgttttggtgacctaactggtcaaatgacctattaagaatatttcatagaacgaatgttccgatgctctaatctctctagacaaggttcatatttgtatgggttacttattctctctttgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacggtgagtgtttctgtgacatcccattcctacatttaagattcacgctaaatgaagtagaagtgactccttccagctttgccaaccagcttttattactagggcaagggtacccagcatctatttttaatataattaattcaaacttcaaaaagaatgaagttccactgagcttactgagctgggacttgaactctgagcattctacctcattgctttggtgcattaggtttgtaatatctggtacctctgtttcctcagatagatgatagaaataaagatatgatattaaggaagctgttaatactgaattttcagaaaagtatccctccataaaatgtatttgggggacaaactgcaggagattatattctggccctatagttattcaaaacgtatttattgattaatctttaaaaggcttagtgaacaatattctagtcagatatctaattcttaaatcctctagaagaattaactaatactataaaatgggtctggatgtagttctgacattattttataacaactggtaagagggagttactatagcaacaactaaaatgatctcaggaaaacctgtttggccctatgtatggtacattacatcttttcagtaattccactcaaatggagacttttaacaaagcaactgttctcaggggacctattttctcccttaaaattcattatacacatccctggttgatagcagtgtgtctggaggcagaaaccattcttgctttggaaacaattacgtctgtgttatactgagtagggaagctcattaattgtcgacacttacgttcctgataatgggatcagtgtgtaattcttgtttcgctccagatttctaataccacaaagaataaatcctttcactctgatcaattttgttaacttctcacgtgtcttctctacacccagggcaccggtgaatccaagtgtcctctgatggtcaaagttctagatgctgtccgaggcagtcctgccatcaatgtggccgtgcatgtgttcagaaaggctgctgatgacacctgggagccatttgcctctgggtaagttgccaaagaaccctcccacaggacttggttttatcttcccgtttgcccctcacttggtagagagaggctcacatcatctgctaaagaatttacaagtagattgaaaaacgtaggcagaggtcaagtatgccctctgaaggatgccctctttttgttttgcttagctaggaagtgaccaggaacctgagcatcatttaggggcagacagtagagaaaagaaggaatcagaactcctctcctctagctgtggtttgcaacccttttgggtcacagaacactttatgtaggtgatgaaaagtaaacattctatgcccagaaaaaatgcacagatacacacacatacaaaatcatatatgtgattttaggagtttcacagattccctggtgtccctgggtaacaccaaagctaagtgtccttgtcttagaattttaggaaaaggtataatgtgtattaacccattaacaaaaggaaaggaattcagaaatattattaaccaggcatctgtctgtagttaatatggatcacccaaaacccaaggcttttgcctaatgaacactttggggcacctactgtgtgcaaggctgggggctgtcaagctcagttaaaaaaaaaaagatagaagagatggatccatgaggcaaagtacagccccaggctaatcccacgatcacccgacttcatgtgcaagagtggcttctcaccttcattagccagttcacaattttcatggagtttttctacctgcactagcaaaaacttcaaggaaaatacatattaataaatctaagcaaagtgaccggaagacagagcaatcaggagaccctttgcatccagcagaagaggaactgctaagtatttacatctccacagagaagaatttctgttgggttttaattgaaccccaagaaccacatgattcttcaaccattattgggaagatcattttcttaggtctggttttaactggctttttatttgggaattcatttatgtttatataaaatgccaagcataacatgaaaagtggttacaggactattctaagggagagacagaatggacaccaaaaatattccaatgttcttgtgaatcttttccttgcaccaggacaaaaaaaaaaagaagtgaaaagaagaaaggaggaggggcataatcagagtcagtaaagacaactgctatttttatctatcgtagctgttgcagtcaaatgggaagcaatttccaacattcaactatggagctggtacttacatggaaatagaagttgcctagtgtttgttgctggcaaagagttatcagagaggttaaatatataaaagggaaaagagtcagatacaggttcttcttcctactttaggttttccactgtgtgtgcaaatgatactccctggtggtgtgcagatgcctcaaagctatcctcacaccacaagggagaggagcgagatcctgctgtcctggagaagtgcagagttagaacagctgtggccacttgcatccaatcatcaatcttgaatcacagggactctttcttaagtaaacattatacctggccgggcacggtggctcacgcctgtaatcccagcactttgggatgccaaagtgggcatatcatctgaggtcaggagttcaagaccagcctggccaacatggcaaaactccgtctttatgaaaaatacaaaaattagccaggcatggtggcaggcgcctgtaatcccagctaattgggaggctgaggctggagaatcccttgaatctaggaggcagaggttgcagtgagctgagatcgtgccattgcactccagcctgggtgacaagagtaaaactctgtctcaaaaaaaaaaaattatacctacattctcttcttatcagagaaaaaaatctacagtgagcttttcaaaaagtttttacaaactttttgccatttaatttcagttaggagttttccctacttctgacttagttgaggggaaatgttcataacatgtttataacatgtttatgtgtgttagttggtgggggtgtattactttgccatgccatttgtttcctccatgcgtaacttaatccagactttcacaccttataggaaaaccagtgagtctggagagctgcatgggctcacaactgaggaggaatttgtagaagggatatacaaagtggaaatagacaccaaatcttactggaaggcacttggcatctccccattccatgagcatgcagaggtgagtatacagaccttcgagggttgttttggttttggtttttgcttttggcattccaggaaatgcacagttttactcagtgtaccacagaaatgtcctaaggaaggtgatgaatgaccaaaggttccctttcctattatacaagaaaaaattcacaacactctgagaagcaaatttctttttgactttgatgaaaatccacttagtaacatgacttgaacttacatgaaactactcatagtctattcattccactttatatgaatattgatgtatctgctgttgaaataatagtttatgaggcagccctccagaccccacgtagagtgtatgtaacaagagatgcaccattttatttctcgaaaacccgtaacattcttcattccaaaacacatctggcttctcggaggtctggacaagtgattcttggcaacacatacctatagagacaataaaatcaaagtaataatggcaacacaatagataacatttaccaagcatacaccatgtggcagacacaattataagtgttttccatatttaacctacttaatcctcaggaataagccactgaggtcagtcctattattatccccatcttatagatgaagaaaatgaggcaccaggaagtcaaataacttgtcaaaggtcacaagactaggaaatacacaagtagaaatgtttacaattaaggcccaggctgggtttgccctcagttctgctatgcctcgcattatgccccaggaaactttttcccttgtgaaagccaagcttaaaaaaagaaaagccacatttgtaacgtgctctgttcccctgcctatggtgaggatcttcaaacagttatacatggacccagtccccctgccttctccttaatttcttaagtcatttgaaacagatggctgtcatggaaatagaatccagacatgttggtcagagttaaagatcaactaattccatcaaaaatagctcggcatgaaagggaactattctctggcttagtcatggatgagactttcaattgctataaagtggttcctttattagacaatgttaccagggaaacaacaggggtttgtttgacttctggggcccacaagtcaacaagagagccccatctaccaaggagcatgtccctgactacccctcagccagcagcaagacatggaccccagtcagggcaggagcagggtttcggcggcgcccagcacaagacattgcccctagagtctcagcccctaccctcgagtaatagatctgcctacctgagactgttgtttgcccaagagctgggtctcagcctgatgggaaccatataaaaaggttcactgacatactgcccacatgttgttctctttcattagatcttagcttccttgtctgctcttcattcttgcagtattcattcaacaaacattaaaaaaaaaaaaaagcattctatgtgtggaacactctgctagatgctgtggatttagaaatgaaaatacatcccgacccttggaatggaagggaaaggactgaagtaagacagattaagcaggaccgtcagcccagcttgaagcccagataaatacggagaacaagagagagcgagtagtgagagatgagtcccaatgcctcactttggtgacgggtgcgtggtgggcttcatgcagcttcttctgataaatgcctccttcagaactggtcaactctaccttggccagtgacccaggtggtcatagtagatttaccaagggaaaatggaaacttttattaggagctcttaggcctcttcacttcatggatttttttttcctttttttttgagatggagttttgccctgtcacccaggctggaatgcagtggtgcaatctcagctcactgcaacctccgcctcccaggttcaagcaattctcctgcctcagcctcccgagtagctgggactacaggtgtgcgccaccacaccaggctaatttttgtattttttgtaaagacaggttttcaccacgttggccaggctggtctgaactccagacctcaggtgattcacctgtctcagcctcccaaagtgctgggattacaggtgtgagccaccgtgcccggctacttcatggatttttgattacagattatgcctcttacaatttttaagaagaatcaagtgggctgaaggtcaatgtcaccataagacaaaagacatttttattagttgattctagggaattggccttaaggggagccctttcttcctaagagattcttaggtgattctcacttcctcttgccccagtattatttttgtttttggtatggctcactcagatccttttttcctcctatccctaagtaatccgggtttctttttcccatatttagaacaaaatgtatttatgcagagtgtgtccaaacctcaacccaaggcctgtatacaaaataaatcaaattaaacacatctttactgtcttctacctctttcctgacctcaatatatcccaacttgcctcactctgagaaccaaggctgtcccagcacctgagtcgcagatattctactgatttgacagaactgtgtgactatctggaacagcattttgatccacaatttgcccagttacaaagcttaaatgagctctagtgcatgcatatatatttcaaaattccaccatgatcttccacactctgtattgtaaatagagccctgtaatgcttttacttcgtatttcattgcttgttatacataaaaatatacttttcttcttcatgttagaaaatgcaaagaataggagggtgggggaatctctgggcttggagacaggagacttgccttcctactatggttccatcagaatgtagactgggacaatacaataattcaagtctggtttgctcatctgtaaattgggaagaatgtttccagctccagaatgctaaatctctaagtctgtggttggcagccactattgcagcagctcttcaatgactcaatgcagttttgcattctccctaccttttttttctaaaaccaataaaatagatacagcctttaggctttctgggatttcccttagtcaagctagggtcatcctgactttcggcgtgaatttgcaaaacaagacctgactctgtactcctgctctaaggactgtgcatggttccaaaggcttagcttgccagcatatttgagctttttccttctgttcaaactgttccaaaatataaaagaataaaattaattaagttggcactggacttccggtggtcagtcatgtgtgtcatctgtcacgtttttcgggctctggtggaaatggatctgtctgtcttctctcataggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacttttcattccactttaacttgattttttaaattcccttattgtcccttccaaaaaaaagagaatcaaaattttacaaagaatcaaaggaattctagaaagtatctgggcagaacgctaggagagatccaaatttccattgtcttgcaagcaaagcacgtattaaatatgatctgcagccattaaaaagacacattctgtaaatgagagagccttattttcctgtaaccttcagcaaatagcaaaagacacattccaagggcccacttctttactgtgggcatttctttttttttctttttttcttttttccttttttgagacaaagtctcactctgttgcccaggctagaatgcagtggtgtaatctcagctcactgcaacctctgcttcctgggttcaagcgattctcctgcctcagcctcccaagtaactgggattacaggcgcatgccaccacgcctagctcatttttgtatttttagtagagatgggattttgccatgttggctaggctggtctacgaactcctgacctcaggtgatccacctgcctcagcctcccaaagtgctgggattacaggcatgagccactacacccggcccctactctgggcatttctttgattaaagagaaggggagctccaacaagatacacctgcagcaactcaggccgtctgatcagttcaggccagatctacactgcaaccagccaggtcaggggaaaaccaaagaaccccacacacccaatttacttaggctgatccaaaatccatgtatggagaactcacatgcaccaggcactattttaggtgaactgaatataaagaataggacccagtacctgcatttacttaaagaactcacaatcttttgagaacataactgtttcatcatggtttggcaggaggctatggtacaaggcacagcaagggtaagaaggaggaagaaaccaacaccctacagaaatcagggaatgactctgaataggtgtcacttaatctgagtgttggtaatttgtcagatagacaagggaaaaggtattctaggtagagagaatacagtttgcaaggcccagccaagtgaaacaatttgataagttgagagagcagacgacgattcagaatgttgaagggcaaaggtattgaggtgggatgggttatgctgctatcacaaataaccccaaatctcgggggcttaacaaagtaaaagtttagtctcagttgtgccaggtccaatgtagaactctttgctctagagactctttagggtggctttccttctaatggtgactgtttgagacagtttgatttagtcttgtggcttcaaggtcactctggtgatatttagccagcagactgagggaacatagtatggtattagacccctctgtgctgaagtgtcacacatgagtcccattgacttctcactggccagagctagttacatgcccccatctagatgtgctgagaaatgtggcccctggctgggagccatttcccagaacaactaactctatgctctggaagaggagcactaatctgagttggccaacaaccatctctaccacagtagggttgggactggtggggcatgaggctggagtgaaggttggttttatctgccacgcgttacagctgtgaatttgtcttgaaagcaacatgggtccattgaagggaaccttgacatcagtcatgtggctgggacaagaatagttaccacttgcccgtaatctccaaccaggattctccaggagaacctgagttagacacatggcttaggcctaaacctacctgagtggtctttctattttcctccaaattcaaatctcaaatcttgctaccctctaactggctatgttgagagaggaaaaaacttgaagagaatgcagtgtagctttggagtttttcacatgcacttttcccaagatacatagcaaaatcaatgtctccaattctattaatgttgttagcaagtccttgttccatgcatattggttaatc

SEQ ID NO: 14098 - DNA, 32665 bp, Human
ataaaaggttagtggaaggattaaggttcttgaagataaatgtgggagaacaaatagagttgcaaataaagcacacaaacgatggtttgccttggaaaggagtcaggacacctcttctgtggggaaagaagggaaggagaggatgactgaagatagtctcagtcaaataatacatggggtcatctcataagagtgaataggtacagaggtgtgactagagtcatctcctaaagtttggaatgcctattttagaaatgcaataagggtaaggcaatgacaaagtgacgatataatttatagtgtgagcacacttttgaggatgaaagggttgttaacagatggaatgcctcacagcaggtgtcaacctagactcttctgagcaaatgcagacatatggtcacactagaaaggaaccgccaccccatggaaagagcagctatttgagagcatgaatgtgtaagggatctattcagccactgtggcctcctctagcgatattgccagtacatggtcagaactaaagagaataataggtttctagagttgagaggaaaagtgaggcaggaatagcagtcatgaaaatgaagcctccctggtggtcactgacaacatcttcagagtggcaggcagcagtctgctagctgctccggtagaactgtgtgcagcggtggaaatgttttctgtctgccctgtccaaatgggtagcccttagcacatgtggctgtggagcaactggattattcatttcaaataattgcggttaaaatccaaatagccacaagtagctaccatattagaaagtgctggttcagattgagccaagagaagaaggaagccagcagggagattaatgaactataaggaaatcctgccatttgcagcaaaacaacatggctggaagtggaggtcattatgttaactgaataagccaggcacagaaatacaaatacaacatcttctcacttatatgtgggagctaaaagttttgatctcatgggcatcgagaatagaatgatagaatccagaaactgggaaaggtagtggggaggtgggggaagaaaagaattgattaatgggtacaaatatatggtttgatagaagaaataagaccactagttagaaataagtacactagttcgatagatcagcagggtgactatagtttacaataacctattatacatatcaaagcagctagaagagaattatttaaatgtttctagcataatgaaaagacaagtatttaaggtaattgacatcccaagtatactaattatctttacaaattatatgaatgtattaaattatcacatgtattccaaaactatgcacatctttaatgcatcaatttttaaaattattattttacagtgcaaaatattcagaaagcaagatgggagttttttgggcaaatttaagagtaagcataactgtatttagaacagtactaggtcatgatgaagtcccaagtgtgacagtgcctatgaagaaccaaagaaaagagttggtgggactgaggatgctgaggaaccgagaagtcagaacatgggctgtccgtgtgtgtgtggtgtgtgtttttttgtgtgtgtataatgcacacacatccatagggatggtgggagttagctgggtgtggggtacattacatactggtggcctcgaggaaaagtaagcaggtcctggagaacacaagataaaaaccataggatgcggagtaaaggatgagagaatgtctaagatttcacaaggcagattattttgtttgttttttaagatactgttttctggaggagtcagtatggatccaggagaatatagatttctcctcgggcacttcccattagggaaggcaatgggaaaaattagtttcctcttgacaaagaatagtagtagtggttaaactttttttatgtctataatattcaatgcagtaggttattcatgaacaatgttttcacactgaattgagcagtaaattggctaaatatcaaataattttattttacagatctgctttaacgttggaagtggacttcacttacaggtgaggaaacaaagggattatttctgccttctgactcaggagggttaattccatggcaaacaggttgactgggctttactagattgaagacacatgttgtattagacccagccattcccattcaaacaagtgcagaggagcttatccaggggtattcagtgcagcagtttttgacaatgtaaatatccaccaataggtgaatgttaaaaccatttatggtacatgaaagaatgtccatgacgaggtgctgaatgaaaatcggggcaaaataagatatatagtgtaagtccatttttatagcaaaaagacctttatgcatctgtgtatatatgtgcaactgtatagttatgaaaaatcataaaagatattaatcaagctgttaatgaatactttgtgaggtataaatgaaaaagtaatttcaattttttgtcatagaaaattttgttcaagtaaaaaaaaaaatcaatgacctagtgataaccagagtacatattttgaagtaaaatacctattacatagagcaacaaaatgagtaaaatgataaaccaaacctagtataaggattatttctgatcttaagatcccaggtcagctgtattgaaatttcccttggataaaatatatattcacctgtaaaacccaactggaaatttatagaatggttttctgcctaaggttctgaaaatgaaatgggaaatttaattctttacccaatcctgaaaacaataaattcattaactggcagtttccctggttttagtcaagtttatatcaatagattactaagatttagccttaaaaaacatttagtaatttatttttaaaccacaaaccaccacagaaaaatgaaacttcattttcagttaataagaaaaaacgtttttgacatgatctgttattttttactttgccaatttgtaaggctactaaatgattctttaaacttttcaaactctcactctgggaaatcatttcttacagttaaaaacaaaattctactgtctgggcacagtggctcacacttgtaatcccagcactttgggagactgaggcgggcggattgcttgaggcttgagtctaggagttcaaggccagcttaggcaacatggtgaaaccccatagctactaaaaatacaaaaattagccagatgtggtggtgcatgcctgtaatcccagcttcttaggaggctgaggcaggaagatggcttgatccggggaagtcaaggctacagtgagccaagatcatgccactgcactccagcctgggtgacaaagcaagaccctgtctcaaaagaaaaaataaaccagaaaaaaccctacacttttactagcttggagacaatctcttgaggccctatgcagtttgctagaatatatatattcccttttagacaatgaagcctcataggaaatacgaagcataccttaaaatttgcactatttaaaagtttattatgttataggacagcatactaatgttctatatttatgacacataataaattttggcaatattctattgttataggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaaggtacctcctaaagaggaacatgaaatacatgcatatgactaaaatgtggtgtgagaggacttttatgtctactttaagatttaaggaaaatgtatgatgtgcttacagaatttttaaatattcaagatatatctgaaaattagcagagcttactttttagcataaagtatcaactttaagattctctttcccattccggaagatgcagcatcattggcaaaaatatagataactttgagttttgatttaactaagagtaaagggatttggcactggtaacacaaaatgttcagtgctcaaaagaggatgtcataaaatgtcattttcaagatgaactggtgtctattactaggtagggggaccatcttcatctgcctgagacagtcgtggtttatgcctgctctcctggcttaataattaatatctgtgttttcactctcaaggggtccaatttttttgataaattatgtgatagtgttgctactctatatttcaaagttggcatgcacaaacataaacccttcatttttttccccccaaagcttttcttcataagttctacccattttggtaattgatgctataattctctccagtttttcaagccaaaaatgtaccacacactatcagttctattccaaaaatatattccaaatctgctgcttctcttcaactccactgccattcccctagtccaagtcatgtcatctctggcctgtattaccaaagaacttcagaaggaaattgtccataaaaatatttacctgtaaattatagagaatcacttcttaggcttttggctaagatcaaatctagtaaattacagagagttcaacctgaaacattcctgttatttttatgttagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctggtaagaagaataattttagatttattagtttgtagtttttctgtcataataagtgtcatttgttttattttttcatagtatggtaatttagttttcttagcttaaatctaatcttatttatgtcatgatttcagctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacgtaagagtctttttttttttttttaataaataaatacctaagattactttatccccactgtaaataaacactaaatttcatatcttaatgaaagttgagtattacctacagaacaaatgataagaaagcagttcagaactgctttccttataggtttaaaggactttacatgccattgcttttaccctcagaacagatagggtagattaatgtgatggataaggtctctgtagcaactactcaactctgctatctgcaggaaagcaccatagacaatatgtaaacaaatgagcctagctgtggtccaataaaacttcatttacaaaaacaggtggctggttagctttggccctacagctttggctatagtttgctgacctgtaagttgtattatttttactgtaatatttattcacaacattgttcaacacagtgctcttcatgaggacccgaatgagagatttctttttgaccatgatgtaaggaatagttacgcttctcctgatttgtttgtatcttaatagatatcaggatcatgtacctgctcatgttactttctttgtattggctactaatactattataaacaaatctgtgcccttatacagcaatttttcaggactctaccctcagccttgccttcatcttgtttttactattgttatatcccattcacgcttatgtcctcatccagttaaatgttatattgtggtcaactgtatgtgattttgataagcacctgaaatcttttttggaacaagctaaaattataaataaaataacaggtaaatatgcttaaagttgaatttcatcttagacatctttatttctaatgccagatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggtaagttaatatgttatgttgcccatctttaaactctctatcctttccagtttctcctctctttttcttttctaattttcttattttgttctgtattccttatccataggataactcttggaattactctcttttagggatgtgctgtccaatatgggccatgtgactattgagcacttaaaatgtgactggcccaaattgtaatgtgctgtatgcacgttgaatgtgtaatatatgcaccagatttgaaaaacttaatatgaaaaatgcaaaatatgaccttaatgttttttgtgatcattgcatgttaaaataatattttagatatcatagattaaataaaatatacttgtttaaaattgttatcatgtgtttctttttaaaatgtggctactagaagatttaaaattacataaaaacagcaccattctagggcctctcctatcagggttctgtttactagaggttcctaaaacatttctcagtttgcagttctctaatgaaacattaggaggctcctccacggctagtacgtaggaggcagtgaggaaagggatgaaaataggaatcctagttagagaataaaagtatctgtaaaggagagaattactctaaatcccaaattgaaggaaagtttgagtaggtttactaggaaggcatttctctcgaacatttcactttattatttctaactgaaagggaaatttttaaataaaaaggggagatagaagattttttaaatgctgtatacataaaggttttaacagcgtacaagagtaaaatgtggttgatcataaagtacactctttgtcatcagatataaatcatcatccaagtgcactacgttcagtatttcttagagaaatgattggccgggcgtggtggctcatgcctgtaatgccagcactttgggaggctgaggcgggcagatcacaaggtcaggagatcgagaccatcctggctaacacggtgaaaccccatctctactaaatatacaaaaaattagctgggtgtggtggcgggcacctgtagtcccagctactcgggaggctgaggcaggagaatggtgtgaacccaggggacagagcttgcagtgagctgagatcgcgccactgcactccagcctgggcaacagagcaagactccatatccaaaaaaaagaaaagaaacatgatttaattctgcccaaattggaaggactgtgcctaacaggcttaagggaatgtttataaaattaaagaatatgattacacctaaaattctactctataccttttcacataaaactagaatggaaaagtgttactttgcattagtagtgtgattttaaacaagctgctatttctaaaggacggaaagtttagccaataataatggctgttaacttactgggcatttaccttctgccaggtactgttctaagcctttttatggattaacctatttaatccacatagaaaccctgtgaggcagattcacttattatcctcatcttacacataaagaacccgaaggtcaaagcgaataagtgcatgtccaacacagtcagtaagtgacgatgccagaattggaacccaggcagatggctccagggtcctggtgtcctgctgtgcactgagtggttctgccctatgcaggaccccaagcactggcactacctgccctcctaaattccagccacgctgaacagaaccatagtaaggggacctcatggaagagaagaagtgacatctgagaagccgttctctaggacacatactataagaatcaaatctctggggaattctggacaaagttcacccagttttgccttcactaaccaagtttatttaggaccagcttctcctcactgagaatgaagtgcaggacagaaagaaccaattcctacagttccacctcactttcagtagagaataagctacattttcaatagtggctcctttgtgcagactatctcctgataatatcaccaatgacttattgaagaatttgactatctacaactcccgaggcttttctgttcttctgcaaaagctctgactgcaagtaaatagtatcttcacacaaataatagcagatcataaaacagatttgtaaataaaatatactgtggtacgtgataaactggactaaaaccagaaagccagatgtaagagtgactcttttcacccagctggacatttttcattgctctgcaggaacacagcagctacactttgacagtagaagcaagagatggcaatggagaagttacagacaaacctgtaaaacaagctcaagttcagattcgtattttggatgtcaatgacaatatacctgtagtagaaaataaagtggtaactattattcttctaataactgtacctatttatttatatttcagtcctaattaaaaatatatcacttatatttgtatttcattgaaataaaaatcatgtgttcatgttttgcagcttgaagggatggttgaagaaaatcaagtcaacgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggtaagtactaagtattcaaaactggcgtgggccaagttggtgctggaaaggaatctaatatattttgagccctgaacacttaaaagtgctttacatattcaattaactagcactacagttgtttgagaaaggagccatccctatttgcccaagttctgtggttaggaagtggtcacactatggttcaaattcatatcaggggactctaatcctagccagacagcatggtaccaccatcattactgcttagctcatttccaggctttcttgcagctcatacctggcgatcacattctcacatcacaatctcttgcctctactgagtatcccctcaattactacctctgattttatctacttaagagtaaagccagccccacactttgagaagccaaggcaggcagatagcttgagctcaggagttcgagaccagcctggacaacatggcaaatccccgcttctacgaaaaaaaatacaaaaattagctgggcatggcggcacatgcctgtagtcccagctactaaagaggcttaggtgagaggatagcttgaacccaagaggcggaggctgcagtgagccgtggtcacactgctgcactccagcctgggcaacagagtgagaccctgactcaaaaaaaaaaaaaccccgaaacaaaaccagtaaacccaggcctcactaataacatctaaaaataaaagctgtgataacttgatagttaagtgtgcctaagaatcacctcataaaactgcatgccaaaaatgtaggttcctggtctcatcaacaaaaagtttcattgggcaggtttcaggaacttgtctttttagcaaaaatccacttgtgattctaatattagtatgaggctcacatttggaaatacagtatactaagttcttgtgcttaattgagtcaatggagggaaaattgaactaaatagggatattaagcatttatgtcgaattacaggatgggccgggtgtggtggctcaggcctgtaatcccatcccagcactttgggaggccgaggagggcggatcacgaggtcaggagttcgagaccagcctggccaacatggtgaaaccccatctctactactaaaaatacaaaaattagccaagcgtggtggtgcatgcctgtaattccagcttctcaggaggctgaggcaggagaatcacttgaacctgggaggcggaggttgcagtgagccaagatcgtgccattgccctcaagcctgggcaatagagtgagattccgtctcaagaaatataggtaaggaataatatcagtgtattttaagtagcttatattagaattgccttaccagattttaaaataaaatgcaaagctacagttccaaaatactatttcattaaattacacataggcaaaaattgattccagaagtttcgaaattcttatgaaaacttaatatataacagactgggtaaaactctgacagtggaaagaggaataatggtgatataaatgtataacagaatagggaagaattaacttgaggtttcatgataattgagcaccacttattgacagctactatatgcatttaagctacctttttaaaagcagagtaaaattgagtagcattacctcatgtttaaagagaagaactcatgattattgaagaaatggatcatgtcattcgagacaaaatcagtttatctgcttgtgtcatcaatttttaagccatcaatttataggtatgaccacgccagatacctgagatagaaaagccaattatacacgcaaggagaaacagtcagatattgatgaatgacagaggtgctagcatagaattgtcatgtgccacatacgaacgtttcagtcagtgacagactacatatatgacgatggccccgttaaattatcatggagctgagaaatacagagtaaggatgtaaagaaaaaaaatatttttgtgtagctgcacagtgtgtttgtgtcttaagctaaggctcattacaaaagagtcaaaaagttaagaaaatatttaaaagtttatagagaagttatggtaagctaagcctaatttattattggagaaagaaagtttcatttttttttaaatttagtgtcacctaggtacagtatttacaaagtctgcagtagtgtacagtaatgtcttaggccttcatatccattcactcactcactcagagtaactttcagtcttgcaagcaccacttatggtgagtgctctatacagctgtaccatttttcaaatctttactatcatatttttactataccttttctatgtttaagcatgtttaagtacacaaatactattatattataattgcctacaatattcagtacagtaacatgctatacaggtttgtagcataggagcaataggctataccatatagtgtaggtgtatagtaggctttaccatctaggtatgtgtgagttcactctgtgatgtttgcacctcaacaaaattgcctaactgcatttctcatttctcaaatcattaagcaatgcatgactgtatttttagtgtactatgatagcacaaaaaaagggatatagttatttctatcaagagggatgtggataaaaaaacaataaaatgagtattacagtgaaagcaaccgagtgagataattacaaagtcattgtctcaattatgtaatgaattgcttccaaattataagggcagcaatcggattccatcgaaaggaatttagacaaaaaagatatacaagtagcaaatacccacgtgaaaaggtgccaacatcattactcattagggaaaatcaaattaaaactataagagataccactttaccttctagaatggcagaaatgaatatcttagtccgtttgggctgctacaacaaaatgccatcatctgggttgcttattaacaacagaaatttatttctcacagttctggaggctggaaagcccaagatcaaagcagatgcagtgtctgggcaggtcccgctttctggcttatacacagtgccttcttgttgtatcatcacatagtggaacatccaacaagctccactaggcgtcttttgaaagagcattgatcccaggatctcccaaaagccccactcttaatatcatcactttgagagtcaggatttcagcacgtgagttttaaggcgacacaaacattcagacaatagcaatcaaaaagattgacaacaccaattattggcaaaaatatagagaaactggattgctagtggaattgtaacatgatgcaggcagtttgacagtttcttttaaaagttacacaagagtagttatatgacccaatgatttgattcttaggtttccacccaagaaaaataaaaacaggtctatacaaagacatgtatgcaaatgttcatagcagcattattcatgataataaaaaaaactaatagcagtccaaatgtccatcagctggtgagtagataaacagaatgtggtgtattcatatgatggaatactaatgagcaataaaaaggaatgaagtactgatacaagctacaacacggatgaacctcaaaaacattatgctatgggctgggcgcggtggctcccgcctgtaatcccagcactttgggaggccgaggttgggggatcacctgagctcaggagtttgagaccagcctgggcaacatggtgaaaccctgtctctactaaaacaaaaaattagccaggtttggtagtgcatgcctataattccagctgcttgggaggctgaagcaggagaattgcctgaacccgggaggcagaggttgctgtgagccagcatcacgtcacttcatcccagcctaagagacagagcaagactccatctcaaaaaaaaaaaaaaaaaaatttgctgattatgccatgtataaggagccagacacaaaatagtacatattacatgattccatttacttgaaatttctagaaaaggtgaaacaatggggatagaaagcagactgggattgcttggagtggtgagtctgagtggggactgactacaaacacatgtaaaggaacttttgggggtgatggagtgttctaaaactggaccatagtgatgattgcaaatccagaactcatcatgctgtacacttaaaatgggcaaattttattgtatataagttatacctgaatgaagctgtccaaaaaggataaaggagatgaacggatatttttaaatatggaaatagagatagtaaatagtcacatgagaaaaattcacagctttgttaacaaattaacaaataaacttacaatctttaatgttattaaaaaatagcaaaaatggaaatgataaaataagtttacagagttgtaaaaaatagaggtctattccctcacacagcgctcttgatactgaaaattttccatttgctttggagcattatggctatttatgactaacactatgaaacacttatggccccaatacctagcttttatttatttatttattttttcatggtcttggcctttggatactaatgacatctggctggaagattttatttctcatccggcatatatcatgccatcaaacaagcatgtcaagtgcaagagtgacttaaataaactaacaagctttcacaaagatattacaatcacaaaggatgtattttctctagtctttttctcctgtgtccttgtctcaacatcatagtgatccatatttttaaagggtgcagaagttgtgatccatccagagcccaatagagaggaaaactgactgacttattttggtgaaaataagtagtggtagctccaaaggaaggaaattcacaatgaattctccaaaacacaagtgaaaagctttgctgtaattcatgtaaacatgcctaatatatttaattttatactgaagaaacaagcaaaaatgtttagtgcatctaaatggtcagagatactggaaataaaaagcaacaggacctaagtaaactttaggtagttcttttagtaataggatataggtcaacagaggaaaaataatgtgtataaaaatgctgagagcagtattaattacatttagaaattgtgatagcccaaatgcctaattatagaatgactgtctatatctaagtagtagaatactatggaaatgtttataaaaagaaacattgaaaagttggaacataaaatatgtatacagtaatgaactgattatttcaaatggaaattgtgctattacaaagaactatttgaagaaaggttaatcttttatggaattaacagcaaaccagatattaataggtattatgctaaaaaagaggagagtggggttctttgtttaaacagatttgaaaatctctaggtttcttctttactccaggaattcaagtattttaatatgctaatgtgtaatatatagctatattagagggacagagctcacagagctaccactacttattttcactaaaataaacccatagaacacattttaaggaatactgatttatactgaatgcccactaattttttacattagaaaaaaaatcacttcagattgttaaatatatatacacatatctatagatatgtgtgtgtgtatgttttgagacagggtctcactttattgcccaggctgaagtgcagtggcatgatcatggctcactgcagcctcaaccctctgggctcaagcaatcctcccacctcagcctcctgagtagctaggaccacaggcacgagctatcatgcacagctaatttttgtatttttttgtacagatgggaactccctatgttgcccaggctggtctcaaacttctgggctcaagtgatctacctgccttggcttcccaaagtgctgggattacaggcatgagccaccatgcctgaacaaaatatatatatatatttacagtaatttcaacatttaggaaaataaattggtaatacttcctaaacatccttaacatttatgactatccagattgacagaatttttatttgcttggtgtcagtataagagttggactattcagtgctgctatatttcctgtgcattaaattattgtatctaacattaaaaccacacatgtatatgtatatgtatacatgtcttctgttttctctttgaaaagaattccctttggttttccctttcaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaaggtaagagagagtgacacgtgtatttctttattttaaattattttcagtgcctattttcaaaaatcataatcaaatctgaacacttcattccttcaaatccagcattatagttccccaaaggtctacaagttaaattttccaaagatgtgtctataactgagagatgagggggaattttcaccagaatccaccttcttcaaccacctgtgtgtgaggaggaagttagtttactcaccactgaaacagttctggctagagatggctaaaaagcaacaaaggaaaagttcaggaaaaaacttttaaaaacctgtcttatttcctaaaagattattattggagggtgagaacgtagcagataacatccacaagatttactttatacaagttacataatgtattttaatatggggaaaccagctttacttaacgcatatatcttgggaatgaatcttcatttaaacctatttgtttcagagattaatgagcctcctacactgtttatgtttgtcttgatcatggtgacctttactcagagtacatttattgagaacctacaagatgctcactgtgttggaagaaactagtttgtgtccactctgtagtggcaccttattgtgtgatgctttcaaattttcaaagtaaatttacatcttagatctcagtgccgtgccacggaaagaccattctctacagagctgttatttatggagctctagttactgttactgcagttgaatttaaagaatccccacctgctgtcccagacacaactttagtgacttcttgctcagtgccagagctgcctggttgcttgagtgtccttatacacctgtgtccctgtcttagtccatttgagctgctgtaataaaaatacgttagaccaagtaatttataaacagcagatttgttactcacagttctgaaggctgggaagtccatcaaggcaccagccaacagatttggtatctggtgagtcttgctgtctgcttccaagatggcaccatcttgctgcatcctcacgtggccaaaggaacaagggaactcactggagtctcttttttaagagcactaattccattcatgagggtggtgccctcatgacttaatcacttaccaaaggccccacctcttaatatgatcatactgcatattagactccaacataagaatttccgagggttacaaacatgaaaatcatagcagtccctgtgtaccagtgcttcctaaaacattgtatttaagtgcatcgccaagtgtagcaagaatgaaaatgtggaagaagctcctcagcaacctttttccttttagtgaatcgccttttcatggaattccttaaataacattttttccaaagtaatgttaacaaacagcttccaccatattttctgtagtgccttggtgacattctttggcccactatggtcctcttgagttatgtggtctagttggtctagttttaattttctcagctctataacctcacaagacagtatacccaactgaatttacaaaattgagcatgaattttctatatgatcatttttcactgctgtctatggagaaacttatatgttcaaactaattatataccaataatatgtggccacttattgaagcttctgtttcccaccaaattattgacttttggctgctgttttgtttgtttgtttgtttgtttgtttgtttaggggccatgaatacatcaaaagattgtgtgttctgcctggaagaataatgaaccctgccttttttatttcttagtgttttattgtattctttagaatgcagttacagaattttagaaagaaaaggtcttaaagaccagctcaaacctattattttacagataaggaatggaggcacaaccaagttaaattattttccaaatgtttacctaactaattagtggttgttattttgaaacactgataaggggctgggtgtggtgggttcatgcctggcatctcagcactcaagaatccgaggcaggaggatcacttgaggccaggagttcaagaccaacctgggcaacacagcaagaccttgtctctacaaaaaaaaatttttttttcaattagccaggcatggtggcacatgtttgtagtccccactactggggaggcttagacagggggattgcttaagcctaggagttcaaggttccagcgagttgccatcacaccactgcattccagactgtttgtcataatttactgttttattgattattcatgtgtatcagctgtttacagatatttgatataacatgtaagcagctatgctacttgaatgatgtctagcttttacaacagagaacagaagatttcttaaatgagattaagcaaacacattgtgaaatgtaatccctatttctaagactctgcctttattatcagtatgaatgttggtaaaccatagacagcaacttatgtctaagctttaaaatttcagacatgaaattcaaaactaattgtgaaaatcaaaatgtattattatttactggtagcagtattaagaggcagaaaaatttagttcaagtgtataattggaaatagcactaaaaataaatattgctataaattagccactcattcctgtgtgcctcgaagccacttaatagaaaataaattaacaatttgattgagcaaaccaagatactcatatgtttggttggtactggtatttttatgttaaactcattggtattcattaactaattacatacatttcttttttttctttttttttttttttttgagactgagtcttgctctgtcactcaggctggagtgcagtggcacgatctcggcttactgcaacctctgcctcccgggttcaagcagttctgcttcagcctcccaaatagctggaattacaggtgcccaccaccacacccagataatttttgtatttttagtagagatggggttttaacctgttggtcaggctggtcttgaactcctgacctcaggtggtccatccaactcggcttcccgaagtgctaggattataggtgtgagccaccatgcttggccagttacatacgtttctgaaaacataatatggacatttgccttgctctcccagcattggctccttccacactaattctccttgctttgagggaagaaacccagaaacgattttatcggcattgtttccacttttaaccagttctgcctgaaagaaaattattaccccaataatcaacagtatcagaaaatttgtagatgcttccgtttaaaatgatcattgattttttttttttttttttttgagatggagttttgctctgtcacccaggctagagtgcagtggcgcgatctcggctcactgcaacctccacctcctgggttcaagcagttctcctgccacagcctcctgaggagctgggattacaggcacgtgccaccatgcccggcattttttgtgtttttagtagagacggggtttcaccatgttgaccaggctggtctcaaactcctgaccttaagtgatccacccgcctcagcctcccaatgtgctgggattacaggcgtgagccaccgcacctggcccctgcgatcattgatttttaaagttgatgtttgtaaatgttgctaacgcccccaataaacaacagaacataagactgctcttctccaccagtgcttattgtataactaagttattccccaaaagtttaacccaactttaagggacactaaatcaaatgccataggacagactgcagagcaacttaaaaacttgagttagtggttagtgggctcaagagaatcacccttaattttatgtcttgggtatgttgcaggaataagaaaggtccaatttaagtgtgacatgcagtaaagagaggggcttttaggatggttttgcaaaattaaaaacattcaaaacaaatgcctgtaataagaacatatttaaagagaagaaaagtaagcttgaaagagctgtagatgttagaggtttccaattcatgcagaattcaaaattaattttatgtttgttttatgacagatatgtaaaattagaagatagagataattggatctctgtggattctgtcacatctgaaattaaacttgcaaaacttcctgattttgaatctagatatgttcaaaatggcacatacactgtaaagattgtggccatatcagaaggtaagttattaaatagatctttttcttgattatatgtatttagatttttattttccaacatcagaaaccattgatttgattgtgtataaaaacctaatctcggccgggagcagtggctcatgcctgtaatcccagcactttgggaggccaaggcaggtggatcacgaggtcaagagatcgagaccattctggccaacatggtgaaaccccgtctctactaaaaatacaaaaattagctgggcatggtggcatgcatctgtagtcccagctactcaagagactgaggcaggagaattgcttgaacccaggaggtagaggagcggagatcgcgccagacaaagggagactccaactcaaaaaaaaaaaaacaaaaacaaaaacctaatctcaccccagcacagttgcttgtgtctgtagtcccagctactcaggcaactgagatggttggaacacttgagcccaggagtttgagaccagcctggacaaaaaagcaagacaccatcttcaaaaaaaaattgaggggtagataaaatttaaaaatagatgtctaaaaaaattttttagtaagatgaaataagcacctaatttctccagtagataaatctcacatttctacttggtaagtggattaaaagatattacttggtccaaatttgaaacatatctaggatagaaaatgtcctaagtggttagtaccttctccactccaaattggcaagggaattcaaactatgtctgttgtcagcaataggaacagaatgtacatactttttctctcttatttttaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaagcaaaatcactggactacatagaaatctaaatattaagcatgatatctaaaatatttgtaagttgtatttcttctcataaattatatttccaatatagttttttaaaggagtttatgaaatgaggtcctgaacctactgacatatagtatcttttatatgcttatggagagaagaaaaataatctaaaatgtcttgaaggtagctgggtattccctaaatagcccttgaagtagttttgtctggtaaggtgaggagtaccaagcctttgtcagcaccacaatcgtagtagtttgccttctaaaaatcttgtagtaacagtaattccatttaaaacaacatttattgagcacttgctatgtgctaggcattctgctagcccaccctatgtattaccatatttaatccttccttcaacattattccctgattaaagctgaggataccttggtttaactgggggtaagtaaagctcaaacctagaacatgatagaaacaacataacaggggagttatctgattccccccttccccatgtcagtggacatgtccatatgtccacatccaggacatctagacacatggaccatatgatgtgttgatgtgagttttcagatgtccttcagggtggttctgaatgcagaaaagtctatccagaaaactattttgttttaaacaactagggttcatttcagtaaaatttcaaagacaatagtcagttttttttttaatttacagctttattgtgttaagtctagcaaatgtttgaaatcattttaagagggtttgaataatgtttagtccaattaacaaattaaacaccatcaatatttcaaactgtatttacagatttaatatatttagtttccttatatatttcagtgatctgaattaacaaaacctcccagccaggtgcggtggctcacgcctgtaatcccagcactttgggaggccaaggcaggcggatcatgaggtcaggagatcgagaccatcctggctaacacggtgaaaccccgtctctactaaaaatacaaaaaattagccgggcgtggtggcaggcacctgtagtcccagctactcgggaggctgaggcaggagaatggcatgaacccagaaggcagagcttgcagtgagccgagattgtgccactgcactccagcctgggtgacagagcaagactctgtctcaaaaaaaaaactccctatgatccttatactctaaaattctaataaatttaacttacaaatacactgagttgtatattacagaatattatcaataacaagttgaagccgggcatggtagctcatgccttaatcctagcactttgggagggtgaggcgggtggatcacttgaggtcaggagtttgagaccagcctggccaacatggtgaaactccatctctactataaatacaaaaattagctgggcatggtggtgggcacctgtaatcccagctactcaggaggctgaggcaggtgaacctgggaggcagaggttgcagtgagccaagatggcagcacagcactccagcctgggcaacagaacgagactccatttcaaaaaataagaagaagaagaagaagtgtaagagtgctaatgttccttgatcttagaaggtgcatgctgaagaatgtcgtgctatctgtaacttaccttgaaatagttaagaaactttaaaaaaaagaaaaagtgggtatatagagggcaaagaaagcattgttgcaaaatgtaaacagttagtaagggtttgttaatattcactaaaatattctttcaacttttctgtaggtttgaattttttttccattttgaatgtatatagtgttgagaacaaaaaaagaagggactagagaaaacaagatcagcccatcattgaaaatgattaacgctgaggatgggtaccatgggggttatgctcttctctttattactatgtttgaaaaattgccttaatgaagtttttttttaaagaaatggtaaaataaaggtcattcagtagaaatgttaactcaccacttgtttgtcactgtattcccagtgtatagaacagttcctagctttcctagacccacacacattggttacagctaatcatcatgaaagtaggtgtccaggtctgaacctttgctatttaaactgcatattcagggcctatagacaaattttaatgagcacacttcaataagtgaaggaagaacaaagtacctaattggagttaaatacaatcagcaatgaaagaacatttgtggaatttaatgttgcctcatccttggtaatcgttcgtttttatttccttctgcctcccaaccttgtaggtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctatgtaagtctttaaaagccactctgttgtgcttttgggaatctgagtgcactcctggagatgtgttactatggtagtcattgatttcttcacagttattctttaaccacactagagcactttgagggtgaatagggaaacaactgatgattggcaaatcaccaaagcataatataagactcttcagaattttgttttataaatgtatatccttttctggtttcagtaacttaggaactattggcataaacttcactggtattcccattttgatgagctctgtgagggcagcatgctgtctgttctcttcactgctgtattcccagtgtgtggaacagagccttgcatgtagtaagcgctcaaaaaagatgtgttgcatgactttgggttatgggcacaaggttttttacaaacccagtttattccaatcaatcctgctttgtacattcaacttatcagagctccgcctccctgatattccccgcttgccttgtttcttcgtcagcaccaaaagtaggcagaccctctgagcacttcctgtccttcctgaccgtaagatgttctcaaccagtcctgcctgccctacccacgctccaaagacctcgggtttccttttataaaagaacaagggactgcatcctgaggtcacatgaaatatcactctacttgaccactgaatatggacagagggccgcctccaaggcagcctaggctagtgcagtgacagaggagaggtctgttagacaaggggtccccaacccccaggctacagaccagcacctgtccatggcctgttaggaaccaggccgcacagcaggaggtgagtggtggaagagtgagtgaagcttcatctgtatttacagccactccccatcactcgtgttaccacctgagctctacctcctgttagaccagtgctggcattcgattcttataggagctcaaactctatcgtgaactactcatgccaagagatccaggttgcgtgctccttatgagaatctaatgcctgatgacctgtcactgtctcccatcacccccagatgggaccatctagttgcagaaaaataagttcagggctcccactgattctacattatggtgagttgtataattatttcattatatattacaatgtaataataatagaaataaagtacacaataaatgtaatgcacttgagtcatcccaaaaccaacccccctacccctaacttccctgtggaaaaactgtcttccatgaaaccagtccctggtgtcaaaaaggttggggactgctgtattagagccattggtagatgtgcaattgaaagcacagcactcaacagtctgcagtgtacttttataccatcatctccatgctatggctacatatacagatacataacggtaaatgacttgtctcagcttaccaagtttgtaggtaggtactggagctgggactgtatcttttgctcagggattccttgcactgctttctcatctcagattccctggagcctaatgtggtacttggcacataatagacacttgatgaatgtttgttaaaattgttgaattgccactggctgatttcagtcttcttattaatcgtagtagctgtagttaatgtgctgttgactgtttgacataaaaacgaatctaggcagtagccagttcatcattggaagctgccaaatgggagtggcagatgggcatgcaggtgtgtttaattctttactacattgatcaaggggtcagccttggtctttgcttcctcctaggggtaaaataaaatctaagaagagggctctgaaattgttatatgtttcactttattatttctaattactgttttcaatagtacatatatttttgcaacagtgatttttttttaattggaccatagttttaaaaaaattaatctttaagctggttttgatgatttggatactatctgaacctagtcttggtattccactcagcagccacagacagcctctttttgatgaacaaggccttgaatctgtaagactccctcatcctgccttcgggttttggagtaattcacccaaaacaagcttggtaaggttggatcagggtgaagaaaagaaaaatagagctgtaaataagtgaagacaagtccaggaagggacatgcaaattccaaaattgtgcaatataaatttagaaatatatcaaggttaaccttatctgtgttcaattttgtgtctgtacagtggtaccacttttactgctgatgtgccattgcggaaagggcgccaaaggctttacccccatacctggcaccatagagatgctgcatccttggaataatgaaggagcaccacctgaagacaaggtcagtggatcagatgtcaatatgacttgtcttcttcttgggttttaaaggggcctagggaagtgtttcttacatgtttggttgagtgagtaaagtgatcactatggatttcactcatgtgcctttgttaagcaaagagttcaaatgacagcatattttgtgtttgttgctggggcagaattgagatagttttactctgttttgacacttcccatgttgtagagaatgtagagcaaggttcaggaagagcaagagtgtgtaggaatctaagtcttttgtcctaacattaaatgggcagttttcataaccaggaactgcttcatttccatttccctcaatacatagggtttgcagaggtaagcccacaacccccatgacacttgtaaaatgttgcaaaaccccatttcccaactacatcatagccatatccctttgtctctctgttgcaccttcaccctggacctctcaccaccatctgttatgagcaccatttctaataggataggatttagcatcaggtggcagagaactcagaataacagtggcttaatcctaaaatgggcattccaagatcaacatgatgattcatccgcagcatggtccccagttccctcttccttgtttttcttccatggttgagttccattcccacactgtcctcatgtcctagttctagctacctagctgccgtccccacattctaaccagcacatgggagaaaagtgaagaaccctctttaagcacacttcccggaacttgtgtacaccatttctgcttcattcacattgaccacagtttagtcaggtggctatacctagtggcatcagaggcttagaaatatagtctttattttgggtggccatggatccaggtcaaaacaaagttaagaattctgtaactatagaagaaggtatcaaactgtagagggaggttgaaatgccattggtcgcatagagtaaaggagctgagactgtttgggctttgttttctctttgggttctatccacctataaaacaagaagagagaagaaaggagatcttcataagacttacataagttattcaactcaaaatactttttctaactggcctcagtggaaatagcttataccttcctatgcccacttgactcagatccttctaccaaggatgaaggattccctccatcctcctgactcagttctcagctgtgtttgctctcacaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgatgtaaggatgagttttatgtattggtggtggggggtggggggaacatttgtatgtgaatgtgatattattagggtaatcattgccttggatccaaatgagactttgggttttttttttttttcttttttcagggaatacttataggcaataaggaaagagaaatgggacccacagaatcagtcggtgttagctaaattatgctgcagtaaccatgatcttagttctcacacaggcatatttctcacttacagttatgtttttgccagtcagtcagctctgctttccttcatgatgtcttcatatcaagatgcacactgagagagcagattgtacctgggaagctgccgtccttgtgacccaaagaaaagaacaaggcagaaccaggcaatggctctcaaagcctccacctttttacaccacatttcattgaccaaagcaagtcatatgaccaagacagatgtcagtgggtcggaaagttgcatccctctgcaggagcaggcttggtagggatgagctccgtaggagaggcagaggatatataacctaaaaaacacaatctattaagtccatttaaattttaccttctgtatgagagtacttggctttgctattatgagggtccaccaaaaaatgatgagaaaagttccaggaagatgatcagatgcaataaggaagctcatgctagaattgaggaattagaagcagaactgaaaataaaagtataatgtagaggtcaggcacaatggctcatgcctgtgatcccagcactctgggaggtcaaggcaggcagatcacttgagcccagaagttcaagaccagcttgggcaatatgttaaaaccctatctctccaaaaatacaaaaaattagctgggcatgctggcacacacctgtagtcccagctactcagaaggctgaggtagggggatcacttgagcctggaaagccaaggatgcagtgagctgtgatcataccactgcactccagcctgggcaacagagtgaaactctgtctaaaaaaaaaaaaaaaaaaaagtataacatagagataaagtatacttcagaacaaggaatattaccaggaataatgagggatagttcataatgaaaaatgagtcagttcatcaggaggcctgaaactcctaaatatgtcagaacctaataacagaaatttttaaaacttaaagcaaaaacaactgaaagagaaacagacaaattcataatgatagttggagagttcaacctgatctatcagtaaatgaaagaacaagtgacagaatcagtaagcatatagaaaacttagtactgtgaaccaaatggatctagttgatactgacagaacactctatgcaacagaagcagaatacacatgctttttcatatagactgtattctagaacattaaataaatgtaaataacttttaaagaactgcagtcatacaatgtactttgatgaaaaaaaaattaaaaccagagatcagtaacaaagagatatataaaatatactcaaatatttataaatacacatgactgcaaattaaattatacttcatgaaaatttgtggggtactactaaagtgatgcttgaagggaaattgtagcaaaaatggctatattagaagatggttctcaaatcagtgacctaagcttccaccctcagaagttagaagagcaaattaaacccaaaacaagcagaaataagataatgatgaattttagagcagaaatcaatgaaatatttagcaaaaagtaataagaaaaaaaattgaagccacaagcttattatttaaagaggtcaataaaattgataaacattttaccagactaattaggatattaagagattaagcacaaactatggatgttagaaataaaataaagaactttactacagatcttacagacatagtaagaataattttttaaaaagtaggactgggtggttttcttgagaacaaggccctgtgctcccatgagaatggacagagttggaatataaggcatctgaagggccctagagaggagtaaggggaggggcttccattgaggaaagcaagttacttctgtccccctcttctaaatttgcaaattattagcgtgctttcccactttctgctcctttttaacctcccatctttcataccatccttcacccaccttcaagtattagcttaacagggatgtgggtggtgtcaagcaaaaccatttcttggcctttcctgtctcactgctaagctcaattctagcgtcctgtttgttttcttttggtaagttttccctctctccactctaatcctgctccagtcattcttggttatgtatgtgtgtactaacttttgatttggaagtaatttcaaagttatcagaaaatttgcaagaataatagaaattttgaacccaataaacattttgccacatttgctatttgcttttccattttctctgtctctctctcactgacacacattcacacacattctcttacattactatagtacagttaacaaatgtagaactttaatattgacatagtccatatttcagtttagccaactatcacactatcttttacagcaattttgtttttctcaggatcctgcattccatttagttgtcctgacactttagtctcctttaatctgaaacagtcccctctgcctttctattttttccctgatattaattttttttaagaatacagtccagttgtgtcgtaggatctctctcaatttgtgtttccctgatggttccttgtaattaaattcacattactgcattttgaacaggaatatagagtcttgttttaaaatgaatttatattgctaattatttgtctgttttgtgtttgttttgttttgttttcattttagaaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagttaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaaggaccacactgtctctgcttccaggagtattttagaaatgttccacaatttactgaagacatagagatgatgctgctgcttaggtgccttttagcaagctatgcaaacaatcctgataaaacaagatacatagagagtcaatctggcttctgagaatttaccaagtgaacagagtacctagttcatcagccgtccagtaaagcaacccaggaaactgactgggtctctttgcctaccgtattaacattaaacattgatgttctgtattctgtactttactgcacccagcagactttcaacaactcattgatccaaagatacatgcacagtctgagcaccagctatggtgctcataacttctttaagacttgaaccctttcaatctgtgtgattcattaaattggaccattgatgataagaatacacattgtatgtttctgtgcacatgacagtgtgtgtgtgtgcacgtacatactgtatagtcttaaaaatagcattatactggccaggggtggtggctaacgcctgtaatcccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaagaaaaggaaaaaaaaatagcattatacctcttccttgtctcaaccgccatgaaaattctgaacactccaaattcagttgaataatccaaaacaaaatttataagtataaaataattttacttcttatagtaatagtatactttaaaaagcctcagggtatattatcttctaaacagctacaattcagtgcagctacattaaccaactatgttctctagttgagaacaactaggcctatttcactgctgtgtagcctcagtgcctaacatgggtgccaaataaatattcgtagaattacactgaattgtaaaaaccattcgtttttgtttacaattgccaaaaatctcaaaaggccctgtatttatgtaattctttgaaattattattttattttgatttctcagttattgactggctgggtgtgacttagtacataagtactcaatattataaaaacctcaaataattgacttgattttacacaacatccttcccttttctacaagttaatttttttacaaatcatttgggttatctcctaaataggttatattttattgcttctagaaacaatgtttcaaaatatatgtgcattatcagtaataatttgtataaatatttcccacaacaattttcataattttcaaagactaatttcttgactgaagatattttgctagggaagtgaaactttaaaattttgtagattttaaaaaatattgttgaatggtgtcatgcaaaggatttatatagtgtgctcccactaactgtacagatcaggacacatatttttagacatctaagtctgtagcttaaatggaggttactcttccatcatctagaattgtttacttagtaattgttgtttcttttattattatagacttactatcagttttattttgccaagtatgcaacaggtatatcactagtatatgaaaatgtaaatatcacttgtgtactcaaacaaaagttggtcttaagcttccaccttgagcagccttggaaacctaacctgcctcttttagcataatcacattttctaaatgattttctttgttcctgaaaaagtgatttgtattagttttacatttgttttttggaagattatatttgtatatgtatcatcataaaatatttaaataaaaagtatctttagagtgaccctttccccatagatttttatttctctattatattttacaagg

SEQ ID NO: 14099 - DNA, 22431 bp, Human
  misc_feature (1)...(22431): n = A,T,C or G
aaaatttatgtaagtctatcactttactgttaagaaaaagccctcaaacgcaacgttctcacaccaagattaattatgtttgagaatcagaataatgtttaaagcgaaaagacagggaagcgggtggacagacccctgagatacacagacacctccaagactgtttcacatgtgtacaaaccatctgtctcccctgccccccaaggccaaaatgccatcagccacagggctcagtcagaagaaagctcccactacctgctgcttcatcgcttacctcccactttaatccaaacttgctcaggcaaaactttgtttctactacctaacgtctgtttagtggattcaatttcttgctgataacagaaagaaaatgctctaggcaatccaatatcctggtgcttggcagcttcaagtacagaacatgagttactagaactctggaaaaaaatgaagcaacaggaattttatcaatatgtggcttactctcctctttactgcacaaatgaaatgcacttaacaaacatcaaaactactaacacgtaatttgaagaactttagttgcactgaagatttaaaaatattcgcataccacataaacactcaactttcacaggtatttttttgtttttgtttttttgtttttttttttgagacaggctctcactctgtcgcccagactggagtgcagggtcgcgatgtcagcccaccacaacctccacctcccaggctcaagcgattctcccgcctcagcctcctgagcagctgggattacaggtgtccgccactaccacctggttaattttcgtacggggtttcaccatgttggccaggctagtcttgaactcctgaactcaaatgacccacccacctcggcctcccaaagtgctgggattacaggtgtcggccttggcgcccggcttaaaaggttattaagctcactgaagggaaaaaaaagtacttgggacctaaccaaaataagttaaaatttacccatttaatacaaaagagcaaagcttcacaaatcatgttccctacctgtgtctgtgaaagattagaatttccactagtagagcaagcatttgtagtaaacagtgggtatgtaaattgcaaagcagtagttgtagccgcagttttatttttcactaatgctgtacatttgttttgttgctgaagaggaacattcattagttcagatggatgtcgaatgagagttaccaaactgccaagacaaaagaaagcccagaagtgtcagcaatacgtggcagacaagcatccaccatcccactcccatggctctggctagtttttccagacagcaacccaactctcatcctggaaatctctacacaacaattagcaactatcgctgctgtggaagtcctcctcttcctatggaggaaaagcaaaactgcgccacctccctgctctcatcacatcctgacaccaatctcacttttgccatcctccagtgtgaccacgatgggcaactacaggctgggatgagcagaaaactgcggacgcagccccttccacagccatccctgagggtcgccaagggggcggctgcaggctggagcctcattttagagctcaaagcctgcaaacccccgtcgggccttcctaggcttccctgacatccaagagtgccacccggagcacatggttcccaggaattctgcgcgctcggccccactccaggcggggccactgagggagggggtgtttagtttctggaagtacctgctccccggggcccgcacagcgcacacagcctttcggggcggccccagacccggtgaggtccgcgccctgtgccgccgggagggcaggctgggggcgtgcacagcgagggccccctttgcctccgccccggccccggccccggcctcggcctccacccgggccccgccagcccccggccgccgggcacgcacttgttgagcgccccgcccggctcggggggctcggggccgcgcggcgcgggcggcggctcggcggggatgctgttgaagcggtcctccaggcggacgcgcacggccggcttggcccgggcctcgggcgcgccgtcgggtccagccgcagccgcagccgcgcccgcgccctccttggcggcgccgtcggcccgggccctcgctccgtccccgccgcccgacgtcttctccgccgcgcccgcctcgcttagcagcatcatgcgcagctcctggaagtcgatgtggcccaggcagggcgcgtcggccgccagcgcggacgggcacagcacggggtacacgggcgccgcgcccccctgaccgcccgccgcgaagccgcccgcgcctgcgcccgggcccgccgccgccagcagcgccgagttgaggcgcgtctcgagctcgccgtcagccgccgcctccatgtgcgagcagaggatgtgctgcagctgcgtgtactccacctccgtcatctccaccaggctcaggtcggtggtcgtgaagctcagccccggctcgcccagcgccgcgtccccgccgcccgcgccctcgacggccgcctcgccgcctgccgcgcctgcctccggcggcggctcccgcggtccggggcccgacatggcggcgcggcgcggcccaacggcggcgagggcgacgcgggcggcgggcggcgggaggcgggaggcgggaggcgggaggcgacccccggcccgagcactactctgcgccggccacagccggcgcgccgttgggggagggaaaaccgctgagtgccgcgcacagcgcctgcgccgccccgccccgcaacggcaaccccacccctgcgccagccccgccccctccgttacccgccgccgccggccccgcccccgcccaaccgcccgcacgcccggccccgccccacgtcggcggatgcttgcgcggagggcccgcccccacggcccagccacgcccccacagctaggccacgcccccagctcaggccacgcccggttcccagccacgcccctgctgcccggccactccccgctgaggcccggcgagggcggctgcgctggaatcagcgtgatacctacgcggtgacaccctggggagaagccacgtccgtgcgtgcacgtgcgccccattacagcggcaggaatgaagacgttgtcaaaacagctccctggacccacagtccacagtgcccaggccatccgcttcatccgcgtaaaatgcgcagcgcatggccgggttctgtggctcatgcctgtaatcccagtactttgggaggccgaggcaggtggatcaggaggtcaggagatcgagaccagcctggccaacatggtgaaaccccgtctctactaaaaatacaaaaattagctggacgtggtagtgcgtgcctgtaatcccagctactcgggaggctgaggcaggagaatcgcttgaacccgggaggcggaggttgcagtgagtcgagatcttgccactgcactccagcctgggcaacagagccagacttcatctcaaaaaaaaaaaaaaaatgcacagcgcgacggtggtggtacattcccagcgctgggcccgcctccaccgctgcattcaccaccggtctcctgtagcagtcagcacactgcccctcccccgcctgcagccactaatcttctgtgtccaggagtttgcctaggctgggccttccctgttaagggaactatgcaatatgtggtctttaagagacttatttttgcaatcttgaaataattcctgtacttaacctctcacccacattcccatctcactcagtggttgtctgttctctgtctaggcattaggacacttaaaggcctgtgacttgcacatcgtcttctaagccgggtctgaatctttcgctcatttcatcacagtttagacacagaccaatatattacaatgattcaacgatgggctatgaaagctcagccatgcaaatctaaactcacacatgtatacatgaaaataatatatcagttttgggcaaaacatcaggtttcagaaaacactaccaaggaggaaagcaaggacttaaaactctcaaggacatggcaacagaagtcgtctaacgtaaaacagagagggaaggctaagagagtgagcagagcatcagtgagctgtggggccgcttcaagcagtgtgatttgaagtcccctgggggtggaaggatggggagaaagacattttaagaagtaatgattgccaggtgaggtggctcacgcctgtaatcccagcactttgggaggccgaggcgggcagatcccttgaggtcaggagttcgagatcagcttggccaacatgatgaaatctcgtgtctactaaaaatataaaaaattagccaggtgtggtggcatgtgcctgtaatcccagctactcaggaagctgaggcagaagaatcgctggaacccgggaggtggaggtttcagtgagtagagattgcaccactgcactccagcctgggagacagagcaagacgctgtctcaaaaaacaaaaacaaaacaacaaaaaaaaataatgattgaaaagtttttttaaaactacaaacctacagacccaagaagtttaacatacctcaaactcaagaaacatgaaggaaactacaccaagatggaaagcaaattgctttatttatttatttttttattttttgagatggagtcttgctctgtctcccaggctggagtgcaatggcacgatcttgactcagcacaacctctgcctcctggattcaagtgattctcctgcctcagcctcctgaatagctgggattataggcatgtgccaccatgcctggccaattttttgtatttttagtagagacgggattttgccatgttggtcaggctggtcttgaactcctgacttcaggtgatctgcccaccttggtctcccgaatgctgggattacaggcataagccaccgtgcctggcctcaaattgctttaaatcagtgaaaaatcttaaaagcagctgtacacacacacacacacacacacaagacattgtgtacagaggaacaaagataagaatgattacaggccaggcgcggtggctcacgcctgtaatcccagcactttgggaggctgaggcgggcggatcacaaggtcaggagatcgagtccatcctggtaaacatggtgaaatcccatctctactaaaaataaaaaaaaatagctgggtgtggtggcacaggcctgtaatcccaggtaactcaggaggctgaggcacgagaaccgcttgaacctgggaggtggaggttgcagtgagccaagatcacgccactgccctccagcctagtgacagagcgagagactccttctaaaaaaataaatgaaaagattgcagtgattgcagacatttcttcaggaataatgcaagtcagaacagagtggaatcacacctttgaagtgctgagggcaagggagaagctgactgatagtgtcaggcgtctgtattcacaggctctgcgtctgtggattcaaccaaggatcaaaaatactcagaaaaaaattacttgcaccgaaatgcacagactgctcttccttgtcattattccttaaacaatatggtataacaagtattcatttagcatgtacatcgcatgaggtattataagtaatctcgatatgtatatattttagaaacagggtctcgctctgtctcccaggctggagtaggataatacggttatagctcactgcagcctcgacctcctgagctcaaccaatcctcctgcatgactctgccgagtagctgggaccacaggcacacaccaccatgccctgctaatttttattttattttattttttgtagagatggtatcttactatgttgcccaggctggtcttgaactcctggcctcaagtgatcctcccacctcagcctaccaaattacagagattacaggtgtgagtcatcacgctcgccgctacagatgatttaaagtgtatggaagaatgtgcataggttatatggaaacactatgacattttgcataagggacttgaacattcgtggattttggtacccatggcaggtactggaaccaatcccccagggatactgaggaataactgtagttctatgcccagcaaagatatttttcaaaaacaaaggcaaaataaagacttttttgcacttacaaaagctaaaataatccatcactagcagacttgcagtacaagacatgttccagaagtccttcagacaaaaggaaggtgagactggatagaagtcggggtctccacagaagaatgaagagactggacgggttaaagctatttattacgagccttaccacaaccactgcaatacagcaacaaagggtgatggctaataaatcaataaaggagagaaaatggaatcagactctcaaaggggcagaaagtgagatatgattgtgccactgcacaccagcctgaatgacagacctcacctctaaagtaaataaataaatgatacaaaaattaaaaatgcaagaggcagaaaaaagaaaaatagaacaaagagcacacgggacaaatagagaataaatagcaagatagtagatttaaatccaataaaaaaaaatcacatgagatgtaaaaggtttaaacacgtcaatgagaaagcagagaccagaatggataaaaagtcagaacttggaggccgggcgcggtggctcacgcctgtaatcccagcactctgggaggccgaggcgggcggatcacaaggtcaggagatcaagaccatcctggctaacacggtgaaaccccgtctctactgaaaaatacaaaaaattagccaggcgtgggggcgggcacctgtagtcccaggtactcgggaggctgaggcaggagaatggcgcgaacctgggaggcggaccttgcagtgagctgaggtcccagctctgcactccagcctgggcgacagagtgagactctgtaagtcagaccttggagtgcccgtaagaaactcattttaaagagaaaggatggaaagtgcgcacctccctagcgctgtcgaaaggcagctggaataggcatataaacactaaagtcaatttccaggaggcgggtctgaagaaaaagaagaaaacaaatactaaagtagatttcagagccaagaattttgccagcgattctggtcatttcatagtgaaatagggggcagaacattttcctgattaaatgcatctaattagaaagcttaaaaatacatggagcagggccgggtgcagtggctcacacctgtgatcccagcactttgggaggccgaggcgagcggatcacttgatgtcaggagttcgagaccagcctggctaacatggcaaaaccccatctttactaaaaatacaaaaattggctgggcatggtggtgtgcgcctgtaatcccagctacttggcaggctgaggcaggagaatcacttgaacttgggaggcagaggttgcagtgaactgatattgtgccactgaactccagcctgggcaacagagcgaaaccctgtctcaaaaaaataataaataaaaaataacaaaacaaaacaaaacaaaccatggagcaggccgggcgcagtggctcacacctataatcccagcactttgggaggccaaggcgggcagatcacaaggtcaggagttggagaccagtctggccaacatagtgaaaccccatctctactaaaaatacaaaaaaattagccgggcgtggtggcgtgaacctgtaatccagcgactcgggaggctgaagcaggggaattgcttgaaccagagaaatggaggttgcagtgagctgagattgtgccactgcactccagcctgggcgacagaggaagactccatctcacaaaaaaaaaaaaaattctgggcacggtggctcacgcctgtaatcccagcactttgggaggctgaggcaggtggatcacctgaggtcaggagtccgagatcagcctgaccaacacggagaaaccccgtctctacctaaaaaaaaaaaaaaaaaaaaaaaaaattagctgggcatggtggcgcatgcctgtaatcctagctactcgggagcctgaggcaagagaatctcttgaacccgggaggcagaggttacagtgagcagagattgtgccattgcactccagcctgggtgacagagtgagactccgtctcaaaagaaagagagagaggagaaagacagaaaatcagaaaggatgcagaagacctggacaatgccatcaaccaacttgctctagttgatgtttatagaacaccccaaccacccacatcagaatacagtcttttcaactggataggtaacatctaccaagataaaccataatttggaccataaaatatgtctcaataaatttaaactttagaaaaatatgtcctcaaccacgactgaatttaatttcaaatctaatgtaaagatatttgagatattgtaaatctccgaacatttggcaactaaataatacatttctaaatgtctcacgggtcaaagaaatcaaaagggaagttataaagtatttagaaatgagcaaaaatgaaaacgacaacatcaaaattcatggaatatagctaaagaaatacttagaaaagtatagcaatcacaaaagaagacaagtatcaaattattaatctcaacttctgcactgttgaaaaggaagagtagaaaaggaagagtaaagtaagcagaactgtgcgtcagtttccattgtatttctaaatacaataaaaaacagaaaaaccgtagagaaaagctcaaatgaaaccaaaggctggccgggcgcggtggttcatgcctgtaatcccagcactttgggaggccgaggagggtggatctcctgatgtcaggagttcgagaccagcttggccaacatggtgaaaaaccccgtctctactaaaaatacaaaaattggccgggcgtggtggtgggcacctgtaatcccagctactcgggaggctgaggcaggagagttgcttgaacctgggaggcagaggttgcagtgagtggagattgcaccattgcactccagcctgggtgacagaacgagactccgtctcaaaagagaaaaaagaaaaaaaactgaaggccggttctctgagagaagcaataagatgtatcaacctctggccagactgagcaggaaaaaagagaaaaacaaatgaccagaatcaggaataggcggtgacagcagtaaagattctaaagatactggatgggtgcagtggctcatgcctatactcccaacactttgggaggccagggtgcacaggccgcttaagcttagaagtttataaccagcctgggcaacatggcaaaaccccatctccacgaaaaacaccaacaattagccgggagtggtggcgcatgtctgtgattccagctacttgggaggctggaggtgggaggatcacttgagcctgggaggcagaggctgcagtgagctgtgatcatgccactgcactccagcctgggtgacagtgagaccctgtctcaaaaataaaatgaagaaaaaaagcttctgtagatattgaacgtatattaaggggctattatgaacaactttatggcaataaaatcaacaacttagacaaaatgggcaaattcctcaaaatacataaattacaaaagctcactcaagaataaatagataactttattttctctatatctgttgataaaattgaactggtaattaaggaccttctcataaagaaaatgcctctaacagatgtcttcacgagctaatcctactaaacatttaaggaagaaataataccagttctattggtaatacgaactcttccaagaaactgaacaggaggggatactttctaaagcattctatgaaacaaacataactctgatatcaaaaccagacaaaacagaactacagagcaatatctgacaggagcaaagatgcaaaagttatttttatttttatttattactttaaaaaaaagtttcaagagacagggtcttgctctgtcacccagactagagtgcagtggtgtgaccatggctcactgctgcctcaatctcatgggctcaagcgatcttcccacctcggcctcctcagtagctgggaccacagacatgccagaatacctggcaatttaaaaaaatttttttgtagagacaagagccttgctatgttgcccaggctggtctcgaattcctgagctcaagcaatccttccacctcagcctcccaaagtgttgggattacagttgtgagccaccatgcccagcccaaaattctttttttttttttttttttttgagacagagtctcactttgtcactgagactgaagtgcagtggcacgatctcggctcactgcaacctctgcctcccgggttcaagcaattctcctgcctcagcctcccaagtagctgggaatacaggcacccgtcaccacacctggctaatttttgtatttttagtagagacaggtttcaccatattggccagggtggtcttgaactcctgaccttgtgatccacctgcctcggcctcccaaagtgctaggattacaggcatgagccaccccacccagcccaaaattatttttaaataatgttagccctgtaatcccagcgctttgggaggctgagatggacggatcattggatgccaggagttcgagaccagcctggccaacgtggcgaaatcctgtctctacaaaaaaatacaaaaattagctgggcgtggtggcgggcacctgtaatcccagctactcaggaggctgaggcaggagaattgcttgaatccgggaggcagaggttgcagtgagccgagatcgtgccactgcacttcagtctcagtgacaaagtgagacactgtctcaaaaaaaaaaaaaaaaaaaaaacaaaacttagaaataaatttgatgaaagatgtaaaagactgtacactgaaaactacaaaatactgttgaaataaattaaaaagatggacaaatatagagatatactatgttcatggattggaaggttcgatagtgttaagatgtctgttattcccaaaactgatgtatgcagttccaataaaaacccagcagtgtcttagtccatttgtgctgtcataacaagacaccttagactgggtcacttataaacaacaaaaatgtattgctcctagttctggaagctggaaagtcccagatcaaggcaccagcatatgtgatggctgatgagggcctgttccgctcagatgctgccttcctgccacatcctcatgtggcagagagagaaaatcagctcccccaggcctcttgtaaaagggcactaatcccattcatgatggctctcccgtcatgacctagtcacctcctaaaggcccctcttcttattttttatttatttatttttttgagatggagtctcgatttattgcccaggctggggtgcaatggcatgatctcggttcactgcaacgtctgcctcccgggttcaagcaattcttctgcctcagcctcctgagtagctgggattacaggcacgtgccaccacgcctggctaatagttttgtattttcagtagagacagggtttcaccatgttggtcaggctggtcttgaactcctgacctcaggtgacccgcccgcctcggcctcccaaagtgctgggattacaggcgtgagccaccgcacccggccattgttttaaagacccctcttcttaatgccaccacagtgcagattaggtttcagtatgaatcttggagggatacaaactcagaccgcagcaagcagggttttttttctttctttctctctcaaattcttggaaggttgagcagggcagggtcaccaggcctgccggcaactgctccccttcctctcatcctcctgtagcttcttggactcctgggccaattgatttttctgttccgtgatgtggagtgatcaaagctggttctgggttttctggagctggatctttgattgcctttgatttaaaagcattggtaaccgtttctcacgggaaagaggcgctgataattcatgcaaatgagcatcaatgggcaaaattcaaccaagtgcctctggaaccaaggctgccattgaacattctagtaaaaatggggtggaggcttttgcccaagtgctctggataatctgggaaaagaaaatggtgagtcagtgctttattttatttatttatttatttatttatttgtttgtttttgaggcggagtcttgctctgtcacccaggctggagtgcagtggtgcgatctcggctcactgccacctctgcctcctgggttcaaacgattctcctacctcagccacccaagcagctgggattacaggcacatgccacgatgcctggctattttttgtatttttctggtagagacagggtttcaccatgttggccaggctggtctcgagctcctgacctcaagtgatctgcctgcctcggcctcccaaagtgctgggattacaggtgtgaatcaccgtgcccagccgaattttttttttctttttttttctttttagatggagtctctgtcacccaggctggagtacggtggcacgatgtcggttcactgcaacgtccgcctcctgggttcaagcgattcttctgcctcagcctcccgagtagctgggattacaggcacgtgccaccatgcccagctaatttttttagtagagacggggtttggggtttcaccatgtgagccaggatggtctcgatctcctgacctcatgatccccccgcctcggcctcccaaaatgctgggattacaggcatgagccaccgtgcacggcctttttttttttttttttttaaatagaggcaaggttcaccatgttgcccagccttgtctccaacaagctcaagggattcacctcctcacagacagtgctcccacaggcgtgagccaccacgccccaccttatttatttttatgtatcttaacttccaaggtggatttatttaaaggttttacaataactatgtccaggctttaggctcatgggaagtaaatgaggacacctttttcccaagaagaatttctttaaaaccaagcacattgctaaataacaacattatatttggcaaacaataattggcaacaaaataagtttattattctgcccaagccagtcccagatgctgtttcttaaccaagatacaaacaaattttgctgtagcaagtctagaccaattttatcaaacatgtctttggttagatgtctagtttcatttaacgttttgaaaactcatttgacagccagtcaagtccctcatctacaccagctccgtgttgcacaagtggcttgaacataccatgtcctgttaggaagagactgaagagctggctggctcatctgtcgtcacactgatggcccgagcgctgggcaaaccctgtttgtttgcagagagcagtggcgctgcgtctccacactcaccggccagaagccttttctgcagcgcgtccgccacttcccgaattctttcatgatcgttgctatctaccagcaaaagaaaaccctgggtattctggaagtaatgcttccagagaagcctaattacatcttgaccatgaacatcccacaccatgaaacaagtgttctctttttgagtcagagtctcgctctgtcatccaggctggagtgcaatggcgcaatctcagctcactacaacttccacctcccgggttcaagcaattctcctgcctcggcctcccgagtagctgggattacaggagcccaccactatgcctggctaatttttgtatatttagtagagacagggttccaccatattggccaggctggtcttgaactcctgaccttgtgatctgcctgcctcggcctcccaaagtgctgggattataggcatgagctaccgtgcctggcccaaaacaagtgttcttatattctactctttccatgttaaaaccaatggcaggaactgtggtgagtacctcccctaacttcagtttatacacaatgtataggcagcatccaatcgaaccgtccaaatgtgcatctgcttcttgctgaagaggcgggagaagagagaggagatggcggggaccatgggttcgtggcacttgcgatgggcagaagcagaggggcttggggggccctgtgctttcttctttcatgcttccaggcaaattgaacaagggggaagagaaagaactgaggaagaaagagggaggcagggacatctcactggcccgtgtgctggtgaagctgtagacaggaattagcaggacgaggacctgctggtgatggacacagcagctccagctctcgatgctttaaatgcctggcttggagtctgaaaaaggaacctgaaagcctctatgactgccttaaagtaagtccttatctcctgtagccatggggctgagatttctgcaaagcaaacctgaagcctagtctcctggatgatttaattacagcctaaactgcagtttcgactttgcagtgcctcttttgttaaagttagggaagttgggaaagaatgggaacctgacgttgcaatgggggcatgtgggcggcaagccacccaggtgccgaggcaagagaccgagggcacgagctgttccagtgtaataaaatatataaaacaacaagagttataccagatacagatcatagacatgattatatatgaatatctttcatcattagtttgtagcaattactctttataatgcttgctctataatcataatctaggaaaaaccaggccatacagagacaggagctgaggggacatggtgagaagtgaccagaagacaagagtgtgaaccttctgttacgcccggacagggccaccagagggctccttggtctagcggtgacgccagcgtctgggaagacgcccgttgccagacggaccgtggtctagcggtagcctcagtgtcacggaaaaacacccgctacttagcagacggggaaagggagtctccctttccccgggggagtttagagaagactctactcctccacctcttgcggagggcctgacatcagtcaggcccgcccgcagttatccggaggcctaaccgtctccctgtgatgctgtgcttcagtggtcacgctcctagtccgccttcatgttccatcctgtgcacctggctctgccttctagatagcagcagcaaattagtgaaagtactgaaagtctctgataagcagaaataatggcgtaagcggtctctgtctctccctctctgtctctgccttggctgccaggcaggggagggccccctgtccagtggacacgtgacccacgtgaccttacctatcactggagatgactcacactccttaccctgccccttttgctttgtatccaataaataacaatgcagccagacattcggagccactaccggtctctgcgcattggtggtagtggttccccgggcccagctgtcttttcttttatctctttgtcttgtgtctttatttttacactctctcgtcaccacacacagggagaagcccaccgaccctgtggggctggtccctacaggggcatgtgggaagatcccagtgaagctgaggaccacgagccctgcaagtccattgggatctgccggtgaactccgcaggtcgtctttgaaggcacatgtggctcttctgccactgcctggggagctgagacccctttgcccaaagaccctcaagtgccttccctagggagctgccctgtaaggtgccgccgtcctgcccgggactcaccaccacctctgtgttccttctagacctagatccagactggagttccagcaggccccaaaagagaaagtgtgaggtgtggcctacaaatatgtttccctacgaaaacctgcggaaaatgtgtggaaatcgatgttgagagtgcgggatctgggtgggaggaatataagcttgcgtaagtggacagggactcagatacgagattctggatttgatgcgttggagggaacggctgggagtgacccaccccccacccccattttcttcatcagtcaccgaaactttcgccccacaggtagctgaccctaaattcagtgaaatccagaactttcctggcacactggagaggacggcagaacgctgggatggatttatcgtgcaagaccagcttgatgtccttagggcttggaggtcaccccttcacgaggattgtgaggagtgaattcatcggggagccccgcaccctcacctgcaccctcacccccacccccacccccacccccacccccacccgcacccccacccccaccctcccccccacccgcacccgcacccccaccctcacccgcacccccaccctcacccccaccctcacccccaccctcacccccacccccaccctcacccgcacccccactcgcacccgcacccccaccctcacccgcacccccaccctcacccccaccctcacccccaccctcacccccacccccaccctcacccgcaccctcactcgcaccgcaccctcactggcaccctcacccacaccgcacccacacccacatcggggaagagctccatgatcattcttttctgtaggcgaaaaactgcggcgggaactgctgccatgcagctgggctcccaatgcagtggggatggtggcgctctgggctggcgggagctatcctgccggacgtgattcccagcnnnnnnnnnnnnnnnnnnnncgggatctgggtgggaggaatataagcttgcgtaagtggacaggggactcagatacgagattctggatttgatgcgttggagggaacggctgggagtgacccaccccccacccccattttcttcatcagtcaccgaaactttcgccccacaggtagctgaccctaaattcagtgaaatccagaactttcctggcacactggagaggacggcggaacgctgggatggatttatcgtgcaagaccagcttgatgtccttagggcttggaggtcaccccttcacgaggattgtgaggagtgaattcatcggggagccccgcaccctcacctgcaccctcacccacaccgcacccacacccacataggggaagagctccatgatcattcttttctgtaggcgaaaaactgcggcgggaactgctgccatgcagctgggctcccaatgcagtggggatggtggcgctctgggctggcgggagctatcctgccggacgtgattcccagcacagccgtgagcggcagcagaggcgcagtcatctgacccacatagttcctgcgttgcctgatgggcgcagcttccctagaactgaaaaaaaaggacatcctgccaaaggcgtccccgttctgtgctggcagaaaggctgtaggtccgagagcaggagtcctgcgctctgactggaagccccaacacagagtccggggccctcggccaagttccagactctggacagacccaggcccctggaatgaaggacagactgagtctccgagaggaaggggnnnnnnnnnnnnnnnnnnnnctggcaccctcacccacaccgcacccacacccacatcggggaagagctccatgatcattcttttctgtaggcgaaaaactgcggcgggaactgctgccatgcagctgggctcccaatgcagtggggatggtggcgctctgggctggcgggagctatcctgccggacgtgattcccagcacagccgtgagcggcagcagaggcgcagtcatctgacccacatagttcctgcgttgcctgatgggcgcagcttccctagaactgaaaaaaaaggacatcctgccaaaggcgtccccgttctgtgctggcagaaaggctgtaggtccgagagcaggagtcctgcgctctgactggaagccccaacacagagtccggggccctcggccaagttccagactctggacagacccaggcccctggaatgaaggacagactgagtctccgagaggaaggggccctgctaaatgccaaaaacatgcagctaatcttcccaccgccccttcccaaaggaatcttcctctgtttatcaggagtctgtgcaacgggaatgggaaataatcaggccttttaggaattactagaccctggagctgaaaggacattcatttcaggaggcccagatgccaggcagagctgtggtttatggaggcggacgacggagttggttcaggttttcctctgaggaggcccagtgagcctcccggcctcctgtggaacagacatactcagccaatggcagggtccccacatggtcccctgagccctggagtgaggtcggctgggagcagcagagcagccggaggaggaggagcaaaccccaggccacagcgtgctcctggagggaccccgattttgtcaaaatttagatgcagagagaaaaagattaaggaaaataccaaattaacgacagcagtgactgctgggtgtgacgttttgggcaggcttggttcttctcccttttgctaggtgtcccacaggaagacggacccagcatgtggggacctgcacccagccagtctcgccctggctcagcctgttcactggcgctgccctgccactgagggctgaggtcactgtccgtctgggcatgtctcatgtggtcttttcttttctccccttctggttaggccccctgagctcagccacagccacgatccccactgccgcctcctccctgggactcgctgatgcctggtgtggggagggtgctggctgctttgggtgttaccccccgttggaggcccccgtgccgagttctcgagtgagatggctctttccattttcccccgacagctgcctcggcctctgtgctagaacagggagctacagctcagtgaccctgtggtgccttgtgggcctgtgggtgccagggctccggggcctgggccttttcctgcttggtgtggctgaccgggacgcggccgaccccaggggcatactggagctaggtcttcctcgccatgtttccacagtgagccctttggctgcacaggtcacggtctggagctgttggaggaggctgctcagagctgttgctgccccaccagacacttggccaaggggcctgcaccggtctgcgcgggaacgtcccaccggcgtctgctcatggctgggctgtggacccatacgcttgttcggaagccaagctctggcccacaggcgaccagaggaagctcgcaggccaggcgccagctccccgagcctgtccctgcagccgcgctgtgtgcaggcacgtgggccaccgcgtctcctccactggcactgctgggtctgggccgccaagcccacctgcccacctgcatcctcagcagcagcacgccccgcagtcggcgggtgcacactctgctgcagcctggatgggctggggcctcggggctcactccccaaccatgagactccttcaccgcagttgaggctgttgcagtggtctcgggctcccactcagccccaggagagggtctgaagggggtgagtccctcctcccgaccttcctgcccatcgtctccagagctggatggtgctgggtccccacagggagcgagacagctgccccgtgacggaaggatgtggggacccgcacccggccggtctcaccctgggctcagcatgagttcagggaggggtccaaagggcactcctgcccacgcccaggcaaaccagcaacaagaaactgggtggccagggcgtccgtgcacgaccccaaacttctccgcgttagaaaaaggctgatgaagacccgagacagaaacttcctgtagctgtttattctactgcgagtaacaaaacctaggtcgttccatgttctcatgtacagtgatataagcctccgcaatataaaatacaatgtacaggaatctctatcaagtaaactaaagaaacacacttgatttttacatttgtgtatttaaattagaaaaatttgctttatatgttaaacaaacaaaaccttctcatcgtactagatgttggaacgtgacacctactttaatgtaatttaacctatggacacttggctttcaacaccaaacatctcaaactgatacattctcaatgttttcttaacttaaaaaatctgtgctataaagtgaaaaatctgtagtgacgtacaatggaataacagactccaaagaacaagtgaagttctttaattttacatctgtaaaagtttatgaaaatataaaaaattatcaaagtgtatttgtacaaataaattagccagatttttttacttcacacttcagaagtactcgaaaaatacacgacaagcaagagactgtttcacagtgaacagcttcctgtctcatttgcagttcttgagctagtgatcactagttcccgtctcagactttacacaagtcttgttccacgttcaaggacaaacttttacatgtatcgtctgacaaataccagtttggggccgagcgtacttttcccgggatacagaagaactgctcagaaggcgaaactggaccaacaaaactcctgattattcaaatcaaggactcctccctgcccccaaagtacacttaattggtttgttactttttttaggctggtaaaacttaacatttttcaataaattgttatttaaaatgcaacaattatactaggacagatgttgctttaaatcatgttttggaaaaaattgataaggtgatatataaaatctgagcacgctaagaaatgtgtttctgtttcccagttgaaaattgtaattccaattttatgacaaaagaaagatgcatttgtaaggtttgtgtttctcaagactccagatacaagctactaagacttctcccgtagccgcagggtggacgcctgcaggtcacgcccacaccggcctccggggcggcggctaagacctgtaaaagcagcttttggaaacacaaacggatgagatgtcagtgaaggtatggctctagggtccaacgaaactcccttaaaatttacaataaagttattggaaaagataactatgatctgaaaagcaatatgctccgtaggcaatttcccatttcttttaattttaaatggaaatattaaagtttagtttttttaaaaaagcatcagaattgtaaagatgtgaaatcttgtaagaaaccatttacacaaaattacagtaatgtttaagtccagaatattctatcctgaatctaagatcgtggctatttcaaaagctatttgttcaacgcatcttacgaacgtggctttaaaaagggtctctgcccggccggggcgtctaggcctgcgaggcggtgccagcgtcggaggccctcgaggcctcgggcttcgggtcccgagcgctctctttgctcttgctccggtccttgcggtcgcggccccgctccctgtccctggccttgtctcggtcccgctctctgctccgggaccggtcccggtcgcgcctccggtctcgctcgcgctctcggttcctgctccgctcccggctgcggtcccactccttgccccggtcggcctcgcgctctcggtcgcggttggcgctcctctcccggtttctgtcccagtcccggctggagtccttgtcccggtgtcggtcccactcccggggccggtcccagtcccgctctcggctccagtttcggccgcgctcgcgctctctcctcctgtcctcggacgcccggccctgggcgtcgggctcctccagcggcttctctttgggccccacgtcaaaccgctctctctgcctcccttcgaaagtctggtttctgtattcgtggcctttcccctctcggaagtcggccgatgcccactgtccgtcggcctcggggccctgtccgggcgcactggaggagagcgcggagggcggcccggcctcctcccagcggtccttccggtgctgcggggggtggctgggaagctccagcaggggcctggggcccggcttcatcacctgcggggcctggccctggaagtgaaatcgcgaaggggtctgctcatttttttcagaaaagggtgcggacccccgtagtccaccaaactgcaggggtgcaggcgccctttggtttgtgaatcttggtggtgaatggaccctctggtcttcgaactgctgaggctgaatgcccctgggacctggcataaagttaggcgcttggcctctgggtccttcaaactggttgggatgagggccccgggcagtttcaaactgactaggatggggccctcttgggcccacgaaatgaccagggggtggtcctctctgacctccaaactgagagggaggggggccgcctcgggggcctttcagctgagacagcagtggccttctctggcctccgaactggaaaggcgcgccgcctctgcttcccagaaatggggcttgctctgtcccttcaaactgggcgggggcgcccgtcacctcgttatacggggcgtcctggaactccctcttctccccatggggatccttgcgttcttcaaattgggatggtgccactcctcgtggtccaccaaggtaagagggtgaggggcctctgctgtccccataaggaggtggcccatgttgccccgaga

SEQ ID NO: 14100 - DNA, 32721 bp, Human
atttgatcttttgaaattttctttcctagtggaagcagattttaagggttctctaattatttctctattagcatcaacactcatcagatttgtcacaaatccatttaagatatatggtaaaactcagggatgagcaatttttctttttttctgtaaagaacaagaaaatatttttgactttgtggccatacagtctctatccatatcaactctgttgttacaacacaaaagcagccattcacaatgcatgaacaaatgggcatggctgtgttccaataaaactttatttacaaagtctttatttcaaaaccaagacttttctggaaatgaagagtggtaatggtcatggttgcacaacaatgtgaatatatttaatgccactgatttgtacacttaaaaatagttaaaatgatagattttatgttatgtatattttaccacaatttaaaaagaaacaaaaacaaaattttgttcacaagatgttttttctaactcctagactacacagtcctttctgcttaaaatactctgtgattggcctggcgcggtggctcacgcctgtaatcccagcactttgggagctgaggcaggaggatcacgaggtcaggagatcaaaaccatcctgactaacacgtgaaaccccatctctactaaaactacaaaaattagccgggcgagttggcgggagcctgtaatctcagctactcgggaagctgaggcaggagaatcacttgaacccggaaggcggagcttgcagtgagccgagatcgcgccattgcactccggcctgggcaacacaaagagacgcagtctcaagtaagtaagtaagtaaataaataaataaataaataagaataatgtttcattttctgtactactcgggagcctgaggcaggagacagcctcctcaattcaggagaattgcttgaacccgggaggcagaggttgcagtgagccgagatcgcgccactgctctccagtctgagcgacagagcgagaccccgattcaaaaaaaaaactgtgattaagtggtttctaaaacctaatgtgtaatacttgcaaagataaaattgctcttctaccaaacctttctttcaatatttctgaaactgtaaaaagtactttaaattctaatgttataagcaaagtagctaaaatggggctggtaatttttcccctctgctttatcttgggttagagtcgaagtatttaagcacttccgagtatgtaacagcaagcaggttcaccacactggggaaaatgtcttgagtaatgaaaagagcaccaagataatctaccttattaggcaatctaggcttttttgaaagttataaatgaaaagaaatacagtataaaagatgtcatttgagtattatcagagtaattttgcaacgcattatttatatatttcaaatattcaaggcaccatataactgttcaattttatttctttttttttttttattcaaagcctacattcatagttgcttaatgggatgtttttcttcttcatatttttagtgcctttcaataaaatatatcattgcttaacatctacattttgcttaactttagatctacccacacatactcaggctgaaaataaatgctcttttacaagttagattttgggggattttgtacgttttgctttgcttttcggttttcattgtaaccatagtcaactagattcagccataagacatcaacactgacaaagtgtagtccggactagcttttgcacttccacatcatgattaatttattattcatctggtaccttcctattaaactttgtctttagcctgtgaacttttctttcagcttccaacaaaggatttcattgctttaggaatcgaggtgtggctaagtttttacctgggagcaaaggtgatgcaagcgtttctggtgagacctacccttggtttagggtggggagggaccgcataacagaccatctgtagactccttcggaaagcagcagagacgctgcagagggcttttcttagacatcaactgcagacggctggcaggatagaagcagcggctcacttggactttttcaccagggaaatcagagacaatgatggggctcttccccagaactacaggggctctggccatcttcgtggtaagtcctggattttcctaataatcacaaacttccctgcttcctcccttgttaaagaatattatatttgattgcacaatctttattataaattctaaaaggagtgcagtggaaatcaacactttgaaatgaaatcgtgaagattaccaatttccttcttttgttgttttttatgttgtattttacatagaaaaataaaccagaaagaaatgagttttaaaaaccatttagaattttttttagttaatgaattaagtaatcttaatcacaggttatattttccacaacattttcactttctttaaagttatgcttttactagtttttctaacccacaaacaagaacacaggagccacttctattttccaagattacatgtctcttagcatatagctaagaactctacacgcctgggcttgatacctgacacgcttttaaaagtaaaaaatcgcagaattaaaatcaaagcagtgtttgactctagagaagttgggaggattattaagtaagtatttatgtttagctattatgtgccaaaagaaaatgtcagcctttggggatggggggaaagacatacaacattttaaagccatttttttcagaaaagtaatacttctgttgattgagaaagtcgtacatagtattatctaaaagagaaacggaatgttacagactgtttaaaacctggatgttacagactaacttactccttaactgtgttcttatagcaaaaaaaaaaaaagaaaagtcacaatattatctgttacacggagatatcaaaatagttaaatataccttaaaaatgaatgtcaaaacaattcctaatgctaatttgtatggtttccatgataagctgggttggcctaggcatcaatttacctcatttcttcatgaaaaaaattgagataaatggacttcaagaagtcacagggagatagatctcaagaaaggactttcttagctctccctaagatttttgtttttgtttttgtttttgagacaaggtctggctctgttgcccaggctggagtgcagtggtgcgatctccaacttctgcctctggggttcaagtgattctcgtgcctcagcctcctgagtagctgagattacaggcgtgcaccaccacagccagctaatttttttgtattgttagtagagatggggttttgccatgttgaccagtctagtctcaaactcctagcctcaatggatccgtccacctcggcctcccataatgctgggattgcagatgtgagccactgcacccagcctctaagattctatttctattacgacaatgtaactgtgttcagtacctgattttatttgaaaggaggatgttgttaaagagaaatgtgacagttgtatgactttcccacctttccagatgggaaatgtctgggctgaaccccaggtggtctgataacccctatgtccaagccaatggcaaagctcaggaagttaggggccatgcagcatgggctgtcgggatagtattgccatgaggacataggattgggccaccataagctaagggggattcttttttttttctaatttgacatataggacactctcaattactcctctgattctggagtgactgtgacatccttatattgaggctaatttttatttttatattctcaatgcttattatatctgtcttagagtggacatgcaattgtttgaagaatgagtaaatgaatgatttaatgagccttctctaaactaaaaaacccccgcacaatgtccctataattctagtcataaaggaaactatgaaatgacatgtatttggttccactcaagaaaattttacatacacatgctgtttaaacaacagtataacttcatacataattgttcaactgagtggtctagacctactctgtcccatatggtagccaccagccacatgtggttttaagccacttgaaatgtggttggtctgagttgaggtgtgctatttaatataaaatatacatcataatttgaagaagactttgaatgaacaaaagaatgtaaaatatgtcaataattttttatgttgattacatgttgaaatgatagtattttggatgtattagattaagttaaccgtattgttaaaatgcatttcaccttttaaaaacgttttaaatgtgactaaattttttaattatatgtggttcgcatttgtggtttttatctttctattggacagtactggtctactattaatgctattgatagaaggcagtgtcagtcaggagagaggcaatcaagtctttatggattcagtgaaatttgagctgatttgggataagtatagatggacgggccaaaaggagatctcttgggttgtcagaagagtataatcaaaggcaggcacagttaggatttgcctaggggaaatggacacaccagtatgactagcatgacagtttgctttggagaatctggacatgaattggaaaggcagctgagggtcagattgaaaagtgcattttgtgaaggctcatggaaaccttttacaagtggggagccacccagagttttgaaataatgtggtcatgggggggaaaagcaatgttttctaaagcattctcaagtgggaatgctcattttttgttgttgcagggtgggttctgaaagttggcagatgtgtttgaaggttttgtaataatccaccatccaatgaccatacatgggttgcccagaacagtgagaaataatagcaaagtcatagacttaaatctctggctatgccactgactcactacaggctttgtttcctcaactgtcaaataagaatcacaccccaccccctgcctaatgaaaatggtcatagtgagaataaagcagcaatgcatgcaaaacaattaaaaagtgctgtgagaaagatgaagtgatttgtaaaccctttaatttttatcacttgtactatttttagtaatggggtaattcttgataacttcttcacattgtgtcttactatcttaaataaccatggataccagtgttagtaagtcaagaaagggcctgcatttgtcttgagctaaaaagtatatcaaaaacagttgtcgtatcaatttttaaattgacaggaaaaaataaaagctatatttgggaggagaaggcatggggaataactgtctactattgaaaaaaatgtggtatttatcagtttcttgtgcttgtttgatccattttatgcaacgtaaaataaacgtttttgaggaaaggactcatggttgaaaatgcttatcttcagagatttaatcttttgaaaaaaaaatttatcttcagaggaaaccattgtgttttgtagtccaccaaatccgaaacagtttgtcatccaacactgctatgagcatttggacaatttgctatataactttatgttactatattaggtaaagctttcctcactaaaaattaatagagatgtttgaaatctaaagatttttagagtacaatttttttaaagaagttggtggtaggaaaaaaaagagagaagcagtttaaataccaagtttgagttagcaagtgttctaaatacagcacaactatcttcaaccactttgttttctataaaacatctaaaaagaaaatctttagaaaaagaattctaggctaaatggcccaaatgtttaacaaaatgaaaaatctctaagatatctcttcttctcctgattgacccagtttccagcactgctaatatatataaaaataaatgtcctactgaacttcccaaaaagttaatattctaaaatcagaatacccttgccaaatggttcttccagccctgcctacttgggcagaagtcaggaaagatgtaattacttctaccaattagcactccctcttgcttcatacctgaaaccggttttcatctggaactagaacactcagtgctcatgaggtttctcacaaaccttttagcctttggctctttctgtccacttaagagtcaagctggtagcctaaggtgaggccttgctttgggtagttcaccataagaaaattacatagacaatttggttactactcataatcacaagatgaataattgaatctgtctaatatacacctttttcttggagagctgctgtgcagctggctaggttgtacactgcacaactccaggaggtgcattcacataaactacagcgtgaggagtgccctggcattactcaaggagcaacctacacaattgtacagtggagtactgtttcttttctccttctcatggtcaagaaagagaacaatcttatgcaccttgacagtgaataattacaggtcacttcacataaaaatggctcttttaggctgggtgtggtggctcatgcctgtaatcccagcactttgggaggccaaggcaggcagatcacgaggtcaagagattgagaccatcctggccaacatggtgaagcctcatctctactaaaaatacaaaaattagctgggcttggtggtgcgcacctgtagttccagctactcgggaggctgaggaaggagaatcgcttgaacccgggaggcagaacttgcagtgagccgagatggcgctactgcacttcagccttgtgacagagcgagactccgtctcaaaaaaaaaaaaaaaaaaaaaaaaaaaaagctcttttatgcctcttttgaagtttggtgacagaattggttaacattttattaaatggcaatttaataaaactaacttactttgggctgggctcacctatgtgctttacacctattaatttaatcctcacaacaaacctataaggtaagtaaaattaatttttattcctattgtacagatgaagaaactgaaagattaaggaatgttcccaagttatatgctagtacatggttgggagttggatttaaattcagtgattcagaatccagtatccaattttatattatcatacttgactgcagcctacacagcatttcaaatgagcatttaagaatatccagggatatttatttttcttagcattctgtcatgatacaaggcttaactttctaaattaattgaatttactctaaaaatcagttattggaaattgaattcttcacaattaaataatttccaagtaatcagatatatatcaactttgttcaattaaggaatttgctttgataaatacaaagtttatcacaatgtttcagagtttttaaattttaaatttcaatatatatagaaagctatgagatattatgaaagatgctaatatgaatgatattacttacctgtgtatatttcatgacatttttcccaaaaaaatttaataaatacaaaatcatgtttaaaatttggactgatttatttgaattatctaattcattctacaaatttccccaagaatccccattctagaaatcagaagtgtagtcaggccctaggcctggctgggatgagctacctgcatctaatccatagtcttatgttctgtcccctgccacactaaagcatgaggtaaccccaaacaagatctcggccaaactaaagagcaggtgctattatacttgctttttgtttaatctagctacccatatcctcagattatatttattgtgtacataccatattcaataggaaccttagtgatacaaccatatacatttttattaacaaatagagcatatggatatcaaattgctttatttcatatattttttaaatttaataattagatttgcttttgataatatttgtaattcatatctataccaaggcactaaggctatatcaatgctttaaaaatcatataattaaaatttacaaaataaccagaaaacaaaaagaaagaaaagtacagtaattctcaagataagggaggttttctccatgttggtatttccaatccaggccaccaaaagagacaacttagttcattcaaatcgtcagaaaactatgtaaatatttattggcttgatttagtcattccacagtttatacatatctcaaaacaacatgtacatgataaatatatacaattttgtcaatgaaaatagatttacaaataaaaacacataaattgtttttaaaatgtccaaaattattatattagcaaattaactaaaacaagtagccattatataaatattaactaaaataatttttttaaaaaaatactattctaaataatgtaaggctgtgctgtcctctaaaaatctgaagatcattgcaatattcagaaatgtttcccatcacctacttcctgggaaaacaaatattctaccttattgtgtattagaagaatcattctctgtagggctagtccaagcatgattcatattttcgggatgactctccagttttcctgtaaaggggagcctgcctggcccatccctcctctcatgtgtagctgagtcatttttatgcgctgagaaaggaattgtgcagttactacatttatctggtcttttctaccaagtaactcaaggtactgctttaaaaagagcaacaatgttggaaaataattttgagacatgttataaccacaagtaatggttcttttccatgacaaatttgaacacgcactctttggaatcaaggtttcagctggaatgtctagaagggaagagtcctgacatcttatgtctgacataattactcatttggttcagacttggactagtctattcattataaccctagaaaataaacaatctacattgtttcaagagcaaccatagtcttttgccaaatagaaatctaaattgactgtcatataattttctttgtaccattagtttgttttttttttttttctctttatgacaactttggttagaatttagcagtagttggctcacacctgtaatcccagcactttgggaggccaaggcgggtggatcacctgaggtcaggagttcgagaccagcctaaccaacatggtgaaactccgtctctgctaaagatacaaaattagccgggtgtggtggtgtgcccatgcctgtaatccctgttactcgggaggctaaggcaagagaatcccttgaacccgggagacgaagcttacattgagtcaagatcgcaccattgcactccagccagggcaaaaattgcactccagccagggcaaaaagagcgaaactccgtctcaaaaaaaaaaaaaaaaagaatttagtagtagtgaggtacatgctctggagttaggctactgcggtcgctatcctattatggccattagctagggcaaagtattcattcccttgcatctccaattcttcatctgtatactagggattataatactagaatctccttcaggtgcctgctgtaagtattacataaaacagtaagtataaagctctaggagtagcagctgataccgaaactacacaataaacattagctactgttattactcttctagttttttttttcttctgacttattttccaccattattttccgaccagattcatccgataatcagtggattagcaaatacttgttaagcacctgtgagggttacaagaaaaaaaaaataacctaatagcactgaactggaaagtttacaatactcctggcttagcacagaaattctttcatgtgcataaaacaagaaataataaactgtggtaaaccatcatgggctaaatttcatggtacagaatatgtgttgtacaaactcagaaaaagagacatcagtaaagacaatttcatggaggttgttggaacttgatggatctggaaggatgagcaatatttaagtgggtggagtagaaagaggtaatgcatgccaggcagaacagaagatgaaaaatgacacagatgaatgtctcatatgctcttgagaaggtgaagaccctagcctacatggcttcattttactgtcatttaattttttggggccactctgaaaattaagttcaatatttaaattgaagtaatagagcagagatgaacagatccatgtctcactgcaaacagggtttgtgattggaatagcatatcctcatcttttacgttttgttctctaaaccagactggttccattccattcttttcacttgtacaattaaagaaaatgttctgtaattgtagaggactaatacaggattgccttcctacaaatcagttgggtggctgaaggtttttaataatcccctgtggcccctttctgaagcatttcacaatggtgcttaccaatgtttcccaaagcaatgactttcatagcttccaggaacggtgtataaagcagccaggtaagaattgtgtggttgctgcaactgactattaggcatagtttttgcaaagtccaataggttcttctttatgtcatcaaaattctgtagtcaattaaaaaactggtggaatgtgtttatattgacagtaatattccttttcctggtaggaacttaccctttgattatggcttcttgaaacttacttcttttgaaatagaaacaaatcacaatatgaacaatagaatataataatcaggattattcattgtatataattccttatttgaagaattcacatttaattcgactttatttaaatgtctgcaggtggtcatattggttcatggagaattgcgaatagaggtaaagtatgaaaaaggtttttgtacttaaaataatagtttagtttaaaaaaaaattaaattgtgtttagtagaaatgaatatttaatttctaaaattattcaataatttaattgtgaaaatatataaaattaaaattctaataactgataacaatattttaaaactagtcatccataaatgtcattattataatttatttcatgcattcttttcttcttatcttaaacaaatcagctggtcaaaccctatgggcccagtaagatactgtggagtataaaaagaaaatataaaatacgactaaatgctaatattaaaaatcacatagctttgtagttattttagttatttaacatttattacttgcttgacaaagtatcaggtagagctaattagatacctaacagtcttagtgatcttgaaacatagggggttcctcaactaggtgtctgtaatcaatattctaagcaaaaattgccattaatttccataacaaatggaatccctttttacataagactaaaggtcaatatgatgaagaagagatgactatgcaacaagctaaaagaaggcaaaaacgtgaatgggtgaaatttgccaaaccctgcagagaaggagaagataactcaaaaagaaacccaattgccaaggtaagttatatcaacaggagcgtatgagtttttagaataaatgtataaggtgtaaattaaaataatacggcaattccaaataacaaaatgaagactggggagtccacagaacaagtgaactggtatcctcaacaaaatagtacaataataataataatgagagaaagagagaaaggaaggtagcttctagggttatgaaaaagaattgagacaaagaattgagacatattgaccaattttaatatagaaggcttacttggatacagagtctagcaaacaaataggaaaaataatgcatgtataagacagaaatggttgggagcaaaatatggattggtcatgtattgataactgttgaagctcagtgataggatgtatcaggtttattatactattctctttctttctttctttctttctttctctttctttctttctttctttctttctttctttctttcttctttctttctttctttctttctttctttctttctttctttctttctttctttctttttctgagatggagtcactgtgcctcccaggctggagtgctgtggcgcgatctcagctcactgcaacctcctcctcccaggttcaagcaattctcctgcctcagcctcctgagtagctgggattacaggcgtgtgccaccatgcccggctaattgtttttgtatttttagtagagacggggtttcaccatattggccaggctgatctcgaacttctgacctcatgatctgcccacctcggcctcccaaagtgcttggattacaggcatgagccaccacgcccagcctgttatactgttctaactttacatatatttcacatttttcatgttaaaaagctttaaaattacaataataataagtaaattattttaatacatattttaaccctaccatacaatctctttccctttttgtctctccacttccccctatttaaactaaataaatatcttttgttttttaatgttgtcaggtaaagagggagccttcaggagtagccttgtcaatattaaatgactttgactttcttttaacattttaacactatcatgtggccacagtctgagcaaatattctaacactaaaatgattagtgcacatcattggttcaggctggttgtcaaaaacaacggtttgattttatttcatattcctagtatctatcaaggcaaaaagtaaatggcacaatgtcaaaaagagtgaatcgaatgaacagatgactttagactatggaagtgggggtggagagggaaaggcttgagtgatggtcacctcaacgtttttggtatttggggctgtagattacttcagattaccaagcaacccagaaaatcacctaccgaatctctggagtgggaatcgatcagccgccttttggaatctttgttgttgacaaaaacactggagatattaacataacagctatagtcgaccgggaggaaactccaagcttcctggtaagtttgggtcctcaacattgggctacccttctccttgtataccatcgctttagaaagtgacagttttctactggtaaatttagaggagagttcagtacatgcatcagtccaccagcaaataacaatattagtccctccacagagcctcgcctgagggaacacagcagagggtgcatgagtgagggttgaaatctagcacgccaagtgcttcagtttgccatgacacagcattagcctggtggaaggggcaacttgcccagttggtctgcccagagcaggcacctttttccactttgtctaccctttggggaaacatttcttctttgcacaaaagtgatgtccatgccaacagaggccttatttatacaagttttaatagtatgaaaactgattgcagagtaatactccacattttccctctgttcctagatcacatgtcgggctctaaatgcccaaggactagatgtagagaaaccacttatactaacggttaaaattttggatattaatgataatcctccagtattttcacaacaaattttcatgggtgaaattgaagaaaatagtgcctcaagtaagtcttttacagtacttaccactttcagtttatctactttcaaatatgagtcccactacaatatgtcattcttataaactaatttatgctcttagtttaatcagtagttttgaaaaataaaattcattaagataaatctgggtcttcctttctaaaatgtgtatttgagctaattatttactatcactgtatttctagttatagtctggttatcaggtcaatagtatcttattctatatatacaatttatatgagcatttggcagtcacaaagctaaacaggcagccttgggtagcctggatgcatcagctgggctctttcaggttataaaggacagagacacactcacattacttggataatttgtggaaaggggagaattatgacaatctatcaagggagaaaattgagatagaatatagcctcaatctcagcaaacgtaaggcttagagagaatcgaagagtttgtatggaaggaagcacagttctacctggttgggagagacagaaagaggtatcacaagtgatatacaattttttgaacatacagatgattttaggatatttaaaaattagcatcaatgtgaacttgtttggaatatttaaagtaaacataatgttaattgttacatattctttaataaacgttttcctgtattcctagactcactggtgatgatactaaatgccacagatgcagatgaaccaaaccacttgaattctaaaattgccttcaaaattgtctctcaggaaccagcaggcacacccatgttcctcctaagcagaaacactggggaagtccgtactttgaccaattctcttgaccgagaggtacagcaaagcacttgggggaacattcaagattaaagggtttgattataagaaaaccaagagaggtgactccattttacccgaaaattaaaaaagaaaagaggttctcagtacttaacttggctaatctagggaaattgtttgcatttttaagtgtgattctggtgaggcgagatgtgtaccgggcacctgcagaatcagttgtaccctgaacataccagtggaagttaaataggggcaatgaaagaaggcattgacatagacatacatggacaaagattgaactgcagctaattcctcatgtgatggaggagaagcaagtgtcttagatgaagggagaaatttctgtctggaataaagccttcttttatatcacactttttctcctgacttctcttaattttatccctgcttccagagcactaaagaatctccttctccaatccccctcattacctaccaccaccaccttctatctccattaccacaggctacccggtcagaccccatattatttttgtacaaatggctttcccaatagactaacagagaagctccataagtgagcttattactcccaccctactcattgcccatttttgctctaaggttacggtagagtacagtcctgccataagaagctcacaaaacagaaaacctgccctagccccttaaagacctccacccaaccatccagagtcccacaaatgtcttctacataaaattgaatatttctacctccttacccataggaatcaagtagtttccatttataattctttgggattaattatttttctttattttttatccaaaattagcaagctagcagctatcgtctggttgtgagtggtgcagacaaagatggagaaggactatcaactcaatgtgaatgtaatattaaagtgaaagatgtcaacgataacttcccaatgtttagagactctcaggtacacccattgctccttaaagaatcatttagatatatatttaatactttgaaatcctaattcaggacttgcctgtttgttggcttttatttaagttctctgcacttatctttaaagaaatatgctttttaaaaaatataagaattcagtaataagaagaaggaaatacataatttgagaaataaggattaccatttagaagaaacataatctctccatgtaaaacctgtcattaggtctttaattctgcttctcgccttttcagtattcagcacgtattgaagaaaatattttaagttctgaattacttcgatttcaagtaacagatttggatgaagagtacacagataattggcttgcagtatatttctttacctctgggaatgaaggaaattggtttgaaatacaaactgatcctagaactaatgaaggcatcctgaaagtggtgaaggtaaggtctgacttcccttcattggtaaaaaaaattctgtattaaccaaaatgatcatttctacagataaaatgtatttatttgttaatatcactttattacagaaaacacataaaagtagattgaattttttgtaatccccatagagccgctttacctgaggacaacctctcttaacatcttgaactcattccaagctattgaactttctatagtaaacacaaacacactaacatgctatgggagtgatgatgtatactttaagcacatggtcatatattatgggtgtccatactttaagcacaagaaagcaaaacacatttcttgacttaatctcatttgcaacaatcagattgaagttaggacaagataagaatggatggaatcacgtcttgcccattcgtcaatcggttttaaatggattagctacagtcaatagagaataaatggcaactcttcctacaaaatgggaatttatgaacaaaatctgcaaaataaaagataaataattgggtaaagcttttaatatgcttggctatgacagactccttatctgagagtgtgatctgggccccttccttggtacagcactttggtttttcgtttggttggttggtttttgttttttgttgttgtggttgtggttgtggtgtttttgtttttgtttttgttttttttgagacaaggtctcactctgtcatctaggcaagagtgcagtgatgtgattttggctcactgcagccttcacctcccaggccccagtgatcctcccacctcagcctcctgagtagcagggtccgcatcatgtgccatcatgcccggctaatttttatagttttagtagaaataaggtttcaccatattgaccaggctggtctcgaactcctgatctcaagtgatccacccgccttggcctcccaaagtactgggattacaggcatgagccatcgcatctggcccttggtacagcattttggattctatgagagcgtccttatttaaaccttaaatccagttgagtgacagaccatataatcctttaacaagggggctgctgaaagctgtacatgcagtcctttgttactgtactctttgggacaagtgccacagccatccccacttgtaagggttttgttataaactcccaccaatgcctgggagtgagctattctctatcttgtgtattggtgtcattcagtctcccaaactagaaacgtgggccttaccctgaattgtgacatttcctcacagcatacagccttagaaattgtctttgaagtctgaccctcttctacctccttactgcctgtgccctggcctggcttttcctctcttctcttagatgattgcagtccctcctaatagatatccctacctcttgtctccattgactttgttctcctcattcttaccagtgcaccaccacatttttcttaaaaacaatttggatcccttactcttctctttaaaaccatccctggctctacactggctatgaagctggccttcaaccctaattaccaactcaagttacctgcaactttcccttgacagtaagggtgtaggaactattggagaagcccaggcagcagtgggtccttaagactcctcaggtgactctacagtcagccagggttgctagctcctagccctttaagatgaaattcacaaggcaatttgttatctgtattcagcctgcaactgctttcacctatgcctggataatttcccggcatccttcaacactcagcttagatgaatacctctcagaaacccttcatagctctcctaagtagaattattcctttgctttcacacatagaccctatcatctcttttgcctcttaccccttgtattatagttccatgtttagacatctttctcttccacttcactggaaaatgcttgagcacacaaagccagtcattgcaaagttaaaacttaaatccagatctcttacttgaatcatttttagtgatatacagttgtaaccaatatgagcattttcttatctcatcactctcagaaaaatttactagtgagtgaagaaaagttatcctgggattcctcaggccttgatttgggccacctcaataaggggatcaaacaaatggctatcatgcaagaccttctgaaaatgagtccacaaagagtttgcctttcccacctaagaatttttaaagtcaggaaagataccattgtacataaatccagtgaagattctgcaaatgaccataactgccagttataagaacgtattaggggccttgatttgttcagtcctcactacaccctgatgaggtaaggcttttttttcagaagtggagagttgaggatcagagaaaacaaacattgttccctgagtcacacagctattaagcagcagaaccaggattcaaatcatgttaccatagcaaacttggggttctttccactgcacctcatagcctaaagagactatgatgatgtctttctagtctgaaagaggtacccttattagtaccaaactgaggtctcatgagttaagaatcctaaagctttctctgtctcaacattacaataatttctgaagctgttttgctatttaaaaacaagagaattcattcacagcatcttgcatagtgtgctgtcatcatctactgggtttgcgggagtgtatttttgtgaaactgccttctaattttattttttctccaggctctagattatgaacaactacaaagcgtgaaacttagtattgctgtcaaaaacaaagctgaatttcaccaatcagttatctctcgataccgagttcagtcaaccccagtcacaattcaggtaataaatgtaagagaaggaattgcattccgtcctgcttccaagacatttactgtgcaaaaaggcataagtagcaaaaaattggtggattatatcctgggaacatatcaagccatcgatgaggacactaacaaagctgcctcaaatgtcaagtaagactatttttatttatatcctatttcttgatgaggttttaatctataagctatcacaacataacacataaactattatgtgccaagaatagagatatgacattgattaaaaacaagaaactgggtaactcaaaaagtaacatttagctaaatcattaggtgatcatctaactgtactagaagcaaagataacataagcacaagttacagtggaaaccaagggaagaatgccttagcctatcaacagaaattgggaacatgtctcatggaaacttacagttgagtcttacaaaggagtagaagtgcaccatgagaacatgtttttatcatataaaacagcacttacaaagacatatatgcctaaaatataacggcaccatgcaaaataattgctatattatacagagcaagaacacaggtattttattttattgtgcatagcagatatgcttaagaattatgaaatatgggcctggcacagtggctcacacctgtaatcccagcactttgggaggccgaggcagatggatcacttgaggttgggagttcgagaccagcctgaccaacatgaagaaaccccatctctactaaaaatacaaaattagccgtggtggtgcacacctgtaatcccagctactcgggaggctgagaatcacttgaacccaggaggcagaggttgtggtgagccgagatggcaccattgcactccagcccgggcaacaagagcgaaactccgtctcaaaaaaaaaaaaaagaattatgaaatatggtcatctatgctatgttaattttctgttgctttttataaaagcatatttcaatgtgaacatatattaaatatgaatatactaaatataaaatgagtcattttcattaaatatgtaacattccacatttgaaagaaaactgatttttttaatattatgaaacagatatgtcatgggacgtaacgatggtggatacctaatgattgattcaaaaactgctgaaatcaaatttgtcaaaaatatgaaccgagattctactttcatagttaacaaaacaatcacagctgaggttctggccatagatggtaagaaaaatatttgaatcatttcagaggaatgttatcgtaattgatgtttctttatgcatagatgattatgattattcaacatattatctttaccactggagagagagaattatcttaggagtgttgggcctcaagtttgaggcagctgaatccgggagagaaaactaagagtttcaacttctcagtggagattgaaccagtgaattctgtgttaggtccctgtggtttgctgtggttgaagcagaaattttttgactgacagaaatccctgggtttgagggaatggataaggattcatagacaaagcgcatcagggaatctcaacttgaacgtcaggtgcttttgtgaggtacctatagagacctcatgtacttttatcattgaacaatgcaatttcctcttctggaatgttttaaaataatattcattgagtgtatgtgtttccccaagtataaaattaatttatgttgaaggtaataaaaaagataacaccccccaaaagaaataagtatcaaaaagattgccatttgggaaaacaagaaaagaagtagtaagggtaacaacagaaatgacacataatgcccccacagagagatttttatttcattattttttattttcagcatttaaaatttttctttaataaactttaacattttgagtaataaaaatatacaattttttattccaaataaaaaatgtgtgctttagaagcagaaacttttcacacattgattacaagtgaaatcaacacatttaagaaagttactatttttgtgctgattttatttgaaattggtgaattcatcatcttactggtcttgggttcgagcatattaaattaattctcaattaattatagttagagacatcagcctatttggtaaatttcaatttgctttttacaagatgcagaaataggatgactatttttacttctgaggataatatagtatttcatgagaagacacactgagttggctacagaaaagagaaatgtaaaagattctccttttttgtacaactttgttctatacatttctttaactctaaaacattgttcttacagaatacacgggtaaaacttctacaggcacggtatatgttagagtacccgatttcaatgacaattgtccaacagctgtcctcgaaaaagatgcagtttgcagttcttcaccttccgtggttgtctccgctagaacactgaataatagatacactggcccctatacatttgcactggaagatcaacctgtaaagttgcctgccgtatggagtatcacaaccctcaatggtgagtaacagtaaagttgcttctataaatgcaaactgctcctttgtatttccagaagaataaggaagatcatttaagagcaggtccttccaaaagtaactggaaaaattctttgcaatgaagatgtggctgtagcattgtgaattacttctcttttcagaagagaaaaggaatgatatactgttagcaccatttcatattttattttgaatcctttttagggttcgtttgatattttaacattttaaatctgtttatttctacttccatagtgcacccaaaaaagattagagtcaggcatctaggtggggcacggtggctcacacctggaatcccagtactttgggaggccaggatgggaggatcatctgagttcaggagtttgacaccagcctggccaacatggtgaaaccccatttctactaaaaatacaaaaattagctaggtgtgctggcgcatgcctgtaatcccagctattcaggagactgaggcaggagaatcacttgaacccaggaggtggaggttgcagtgagccaagatcctgccactgcactccagcctgggcaacaagagtgaaaactccatctaaaaaaaaaaagtcaggtatctatttatcacagagctgtttagatttctaaatactaaatacataaacttgttctgatggagcagtctatgagcagacatgtagcatgaagaagtcagtctgctcaaggctcacagggagtgccgcttacactatcactagtcaggaacattgagagcatagcggactgaaatttgcaaacccattatccaacagggaggagctaattcatcctttctctttcccaacctttatcatactcattgtacattgtctgtgctttccagaagtgtcatagaaatagacattagactccctaaaatctccatcctttctggattttataatgacgatgagaccacttcaaatccttagtaaactcatttttccctagctcctttctgaaccagccttgcttcctttcatgaatgtacatgctgttaaagcatgtccttcagtcctaagtagcagccactgccagagttaccaaagggatcttgatcttcatggtcatctttccttgggccctcacacttctgacataaagatctatctccaaactgtgcatgtagcattttgctccaaatgagtttactggatacgtggccaatgaagaggctgccaaagaaagatcagagagggccgggatgtgtcacaagacatacctgcccaggtgtggctgggcaaggcaacagtgattggactaggtgggcaaggcacaatgtcaaaggatatggtgggatcaaaaagattcaacaaatgcaatgctgaaccttacaagaactgtcgtgggatccactttaaaaaggcaacatagcaatgggagatagaaaacagtctatgctcaggactcagataggcaataggccatcaccacaaggaaatcccatatcatagacctgcagctcacgggataagaaccaggaagagcacttgaggtagtagcagccaaagttgaaagtcttgataagtaaaacacaagaacacaaagtcaggaacactaacactcaaagggccacacaagtccaaggattggtgcagacatacaagagagtggttaagccccagaagaggagtacctgactctaaatgatgtcgcccatcttctttagtgggaaaagcagagtagaactgagtttcatgggagagaataattggcctacctgcaacagagaggacaaggaggcaggtgtagacagatttacccacttgaacccattatagccctcatcactgctcaaacatcactctattatcaaccctattgtttgtggcaactaactctgctaatgaaaataagtagtaagagtgtaagacactgctgtggttggaataggtcttccaaagctcatgtgttgaaaacttaatccccactgcagtagtgttgagaggtgagacctgtaagaggaaatgaggtcatgagagctctgtcctcatgcatggattaatggtgttaccatgggagtgggttcattacagtaagagtgagttgttataagggtgagttcagcccccacgtgctctcatgctctcttgtccttccaccttccaccgtgggatgatgaagtccaaaggcctttgtcagattctgacaccttgatattgagcttcccaaccttcaaaactgtgagaaataaatgtgttttctttatgaattatccagtctgtgatattctgttatagcaacacaaaatagactgaaaagacacttcgtcctactgttgatttgcatgattctttctctacagctacctcggccctcctcagagcccaggaacagatacctcctggagtataccacatctccctggtacttacagacagtcagaacaatcggtgtgagatgccacgcagcttgacactggaagtctgtcagtgtgacaacaggggcatctgtggaacttcttacccaaccacaagccctgggaccaggtatggcaggccgcactcagggaggctggggcctgccgccatcggcctgctgctccttggtctcctgctgctgctgtgtgagtagccaatgtttcattctctgttggaccaggtgtcctcatttgcaaaggcctccatgctgccctgctcatctgtgcaatggggaaagaatattctctgatgttttataggtaaagctaggggaaaatggcattttcagaaagaatctgaaatgtgtaacatgtcgcttgctaacagtctatattcatatagcaacacaagttatatatgtcagacatttagaagacagcacaagataatcaagagaaaagcaaatcatgaagactttctacacactgttagtaatgttcatggtcaaaattatggctttatccaagagtgtggcactttctaagatgttttctctatattcattacatctcatgagattctaagataaaaagagaacactagtcaaacaaagttagggaaatacaaatagggtatcataggctattaagatatcaccacatgctattaatattaattaattaattaacccccactaatattaatcaatagcatatgatattaatattaatatcatatgctattaagatagctaggttctgagaagttattgcttcatctagcatttcctcaaaatagattgccatctgaatatgcatcccctttaatactttcacatttaatataactaagtttattaaacacatttagaaaactatgcgtaagtatccttttccaataaaggtaaaatttattcaatagataggtttctgaaaagttgtatttgaatcaaaatcatataaatcaaatagtatttgattgtaagaggtctctatttaaaagaacttcctgactaattcttgtataaacaagagaaatccttgctaaattcacactttcttaatttattataaaaatcacagttttagagttaaaattaattatatgattattaattttaaaaccacaaaaagtagagaaaatgtgtagacaactacacatacaaccatcacttcaactgaacagatatgaatgttttgcaatattttttcaggtccctttttttaaaaagaaataaattgctatagatacagctaattgccacacatgctatatttttcccttccttattctccaaaagcatttactattctaaagttattatacaccatttagtttaagagctgaaattgacactcagagatttggtttttcaatatcgtattaatcaagttcaagaaccagaaatttttaagtacctctatgtgaatcactatgctagcttctagctgaaaaggaaacttgattttggttttcatgcatgtctaactataggggaaaaataccatgataaagctgtaatagaaattactacaaaggggtaattacagaacatttcacggaatagaggaatcattcaattgagccttgaagaatgattaggatataatcagtataaaaaatggaaaaggcatttccaaaaattgacagcatcagccaaggccagaaaacacttagtattttctgttttaggaatcacacagccttcgaaggctaaagcgcggggaaattgtggaaagtgaaggagcaacagagaatgcattgggactaatttgaaagggctacatacacatgctgtggtgtttgtactttatcctatgagaaagaggagctgctaaaagcatttgaataaaagactaacatgatcatatttgtattttagaaagacaaccctggcaacagtgtgtacagtataacagtgtaaattagaaaggaaagaacacttaagaggtcattgtaaaagttcaagagagatgatgaaggtcagatttcgagctgtgacatgagactggaaaataaaggacaagtgtgcagtgcattacagtggcccctggagaggattgggagattaattgttatggtctgaatgtgtgtgtccccccaaaaaaattcatatgttgaaacttaaaccctaaaaaaatagtattaaggagttgggcctttacctatattaattcaatcctcataacaacctatgatgtagatactatttattcccccattttatggatgagttaactgagcaaagaaggatgatattacatgcccaacattacatagctgttaagtggtacagccgaaatttaaaccctagaatctgacttcggaggctgcatgcttaaacccctcactaagctgcctctaagtgaagagagttgaaacattaggattcaggtggccttggcagggcagaggtggcagtggggccactgacaacaaagtgtgggaaacacctgctttcaagaataagtatttcactcttggtcagttcacatgagaatgacattaatctttattgccaaggatgtgcacagaaagatatttacgctgccagaagagtcctccaagcttaagccacaactaagaaattcttaaattacaattaagaatgcattgacagccattgattaggctatcaccctagttactgagggagttttctggttaattactgtttactgagagataattagagactagattaccaaaacaccatcgtgcccacctaaaatctggaccattctggtcatatatttatctgtgtattcacctgacacaatatacatagccccaacatgtgcaaataaatgcaataatcataaaaatgtattaaggaaaaggattgaggagccaaacagccactttcattcatacatcagtgcctattttaagaaaatataccaaaaaaataacaacaagaaatgatctgatctgtctccttcagtttcataatcacatgaaattctagtgtgcttactgtaccaagtttcatttgtagaaactaattttggttttcattaggaattttctacaaatatttaagatactgtattttctttgtaacatttctgaaaaattatcacattaaatagttcctaaattagtcaagtgttctgatgttttgttttgtttttcactagtggccccccttctgctgttgacctgtgactgtggggcaggttctactgggggagtgacaggtggttttatcccagttcctgatggctcagaaggaacaattcatcagtggggaattgaaggagcccatcctgaagacaaggtaagcatccagttcataaattatgtatttcaattacatagagaaaatgtttgatttacattgagataggaaaagaggcaaagagatttcttgaccttcagtttcagagtcagtgctgaatagatggaggcttttaggattttagctcttcagatgtcaaatcacagaaatggttatcgctgaaagaatttgcacttcttgtaatgttatcatttacaaatttgcaaagggccacatgtcactatattgctctgaaatctggttcacttttaaatgaatttatttttcacatggtttgcaggaaatcacaaatatttgtgtgcctcctgtaacagccaatggagccgatttcatggaaagttctggtaagtggacataaaatgtttgaaagcaatggtgagttaagtggtaaatattaaaaaataagaagtgttcaaactatcttcttaataatttgcatctgtgtgcacatgtcaggagctgttaccactgaaatggagaaaagctgttttaatatttttatattagtcaattccctgacatgtctggcttcaataagttaatttatccattgatgccaccattgtcaatatctaaagatctgttatactttttccaaactttagtgacgtgtagttctcaggcaatcaattactaattttttaattaggaaagacttcacacatatagaaaaatgtaagggaaaatataacgaacatctatgtatccaccacccaactttgtcttttccaaacattagtcatattttcagttaaagtctcatgtgcacatccttgatcctgttccccttctttcttccccagaactaacagtatcctgatttcagttcaattactaattcctgcattcagtcatactaggacatgatcacttatgttgtcatacaggtcatacaggtgaatttgtttatttctttggttttaccaagtggctattgcattaatattatctgagtgccacaactactcagtgaactaaaagaacaataatacttaatgcctaatattaaagttttgcttaattccatagattgttttcaagtgtccatcctgcaaaatccgcatgagatttccccaaatatgtaactgtcttcctttatcagatgctccactcctcacctgcttttcccattagaattacatagcaagagctatgtaaagaattatctagaaaaaagtaactttccatgaaagcataatgtcaaggtaacaggctgaatagtcatgatttgttaaattctctttaggtaccaagacatgctaatttgcatgattacattacgtatgtttcctctttggtttccatactgagctcataggactgcttaactataatgttttttcgtgaaaacaaacaagcattgcattagaagcttcccataactgtgtactaaatatcctgtcttttctatttctggctgttgtcactgaaaatcttatttctttgtacacttttaaaattagtatatttttagagctttttcacccgtttatatgccctcctttgtgactctcacataacacattgtgggatgttatcacctctagtcatataattgtattttctcccacttacttgtttgcatggtgactgcttatagacacccaagacccattttataaaaatgcaacaaacaacagcataagatattacagaatgttctcccttgtttttagaagtttgtacaaatacgtatgccagaggcacagcggtggaaggcacttcaggaatggaaatgaccactaagcttggagcagccactgaatctggaggtgctgcaggctttgcaacagggacagtgtcaggagctgcttcaggattcggagcagccactggagttggcatctgttcctcagggcagtctggaaccatgagaacaaggcattccactggaggaaccaataaggactacgctgatggggcgataagcatgaattttctggactcctacttttctcaggtaatttggtgaaaaactttgtggcttgattatcttatttacattagagaactttttatttgattatatacttcagttttgcagtttttatttacagcttgttaaaatgcaagaaaaaaatggtttgtttgttttttgccaaaataatacagataacctaaggtagctgtcaaaatcgggtcactgatcaaaagaagaatgggagccaggcacagtggtacatgcctgccatcccagctactcgggaggctgaggtgggaggattgcttgcacccaggaggtagaagctgcagtgagctatgatggcaccactgcactccagcctgggtgacagagtgagacctcgtctctaaaataaacaaattaataacaaaagaagaatgagtagataaccacaacatgagagcatatagcaagtagtatctcattcctccaactgaacaaacaattgagggcaaatctcttttatgtgagaatttctagcatcttctttaagaatacaaagcagttcattttgtatttcctgtatcataaaggatatccaaatacctgtgtgtatattttcctgagagaggggtagagtattcacattatctgtctaaaaaagttgaagaaccactgaattaatgacccccaaaaaaggggaggcaaaaagaataggatggaagatcagtgatgggaggaatgacatgtcaggaagcatagaacagaaaaggaacatagttatgaaaacaaagaagactttgaaaagtaggatgcttgcctctcatttgataaccaaagattagtgggcagagaggcacggttagaatggatctcacattgagttttggtatcaatactggtaagtgccaaggtctgacctagtatccaagcagacaaagagtgatattgtgtttgaagaaagactgcagggcaggggagaaagggaggggttgtttgagatgaggactcttgggatatttctaggtgggatgtgtgttacagtcacatgtcaggctcccacaagatttgtagaatctagacaaaggttctagctcaattttgaggtaatgtcaaccatactgttgtccaaacaccagataatgttttgaacaagattgttaatagacagtgtcctttatttctatggattacctagtttgggcattcataatccaaatgagttctacaaacagtattatattgttcaactgactctttcttaaaattcattttttcccactttttctctgtcttagaaagcatttgcctgtgcggaggaagacgatggccaggaagcaaatgactgcttgttgatctatgataatgaaggcgcagatgccactggttctcctgtgggctccgtgggttgttgcagttttattgctgatgacctggatgacagcttcttggactcacttggacccaaatttaaaaaacttgcagagataagccttggtgttgatggtgaaggcaaagaagttcagccaccctctaaagacagcggttatgggattgaatcctgtggccatcccatagaagtccagcagacaggatttgttaagtgccagactttgtcaggaagtcaaggagcttctgctttgtccgcctctgggtctgtccagccagctgtttccatccctgaccctctgcagcatggtaactatttagtaacggagacttactcggcttctggttccctcgtgcaaccttccactgcaggctttgatccacttctcacacaaaatgtgatagtgacagaaagggtgatctgtcccatttccagtgttcctggcaacctagctggcccaacgcagctacgagggtcacatactatgctctgtacagaggatccttgctcccgtctaatatgaccagaatgagctggaataccacactgaccaaatctggatctttggactaaagtattcaaaatagcatagcaaagctcactgtattgggctaataatttggcacttattagcttctctcataaactgatcacgattataaattaaatgtttgggttcataccccaaaagcaatatgttgtcactcctaattctcaagtactattcaaattgtagtaaatcttaaagtttttcaaaaccctaaaatcatattcgccaggaaattttcctaaacattcttaagcttctatttttcccctgccaaaggaaggtgtttatcattttaaaatgcaatgtgatttagtggattaagcaggagcgctggttcttgtctccattgccttttcttatatcattgataatgatgtaagaatcacaaggggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcatgaacccgggaagcggagcttgcagtgagccgagattgcgccactgcagtccgcagtccggcctgggcgacagagcgagactccgtctcaaaaaaaaaaaaaaaaaaagaatcacaaggtatttgctaaagcattttgagctgcttggaaaaagggaagtagttgcagtagagtttcttccatcttcttggtgctgggaagccatatatgtgtcttttactcaagctaaggggtataagcttatgtgttgaatttgctacatctatatttcacatattctcacaataagagaattttgaaatagaaatatcatagaacatttaagaaagtttagtataaataatattttgtgtgttttaatccctttgaagggatctatccaaagaaaatattttacactgagctccttcctacacgtctcagtaacagatcctgtgttagtctttgaaaatagctcattttttaaatgtcagtgagtagatgtagcatacatatgatgtataatgacgtgtattatgttaacaatgtctgcagattttgtaggaatacaaaacatggccttttttataagcaaaacgggccaatgactagaataacacatagggcaatctgtgaatatgtattataagcagcattccagaaaagtagttggtgaaataattttcaagtcaaaaagggatatggaaagggaattatgagtaacctctattttttaagccttgcttttaaattaaacagctacagccatttaagccttgaggataataaagcttgagagtaataatgttaggttagcaaaggtttagatgtatcacttcatgcatgctaccatgatagtaatgcagctcttcgagtcatttctggtcattcaagatattcacccttttgcccatagaaagcaccctacctcacctgcttactgacattgtcttagctgatcacaagatcattatcagcctccattattccttactgtatataaaatacagagttttatattttcctttcttcgtttttcaccatattcaaaacctaaatttgtttttgcagatggaatgcaaagtaatcaagtgtttgtgctttcacctagaagggtgtggtcctgaaggaaagaggtcccctaaatatcccccaccctggtgctcctccctctccctggtaccctgactaccaggaagtcaggtgctagagcagctggagaagtgcaggcagcctgtgcttccacagatgggggtgctgctgcaacaaggctttcaatgtgcccatcttaggtgggagaagctagatcctgtgcagcagcctggtaagtcctgaggaggttccattgctcttcctgctgctgtcctttgcttctcaacggtggctcgctctacagtctagagcacatgcagctaacttgtgcctctgcttatgcatgagggttaaattaacaaccataaccttcatttgaagttcaaaggtgtattcaggatcctcaaagcattttaaccttgccgcttaaaacccaatttaccgtgaaatgggaattttgctgcattgttaaactgtagtggaaaccatgctatagtaataaaggttatataagagagaaattgaaattaaatgtgtttttaaatttcaaaaaaaaatcaatcttta

SEQ ID NO: 14101 - DNA, 65518 bp, Human; identical to SEQ ID NO: 12421

SEQ ID NO: 14102 - DNA, 5125 bp, Human
taagagaattccataaggtaactaggcaaaatatcaaaacacaaaatagattttctatttattgggggaaaaaatcaagtagaaaaggtaaacattatagtggaaattggctcaggaataggaaataaatacaaaaggacacagaaatggacatgtgtaagtgggaatttagtacatgatagaggtgatatttcaaacaaataggaaaaagatggacttttcaataaatagtattgaaataatgtattgcaataagtgccaggtgaataaagactaactttttaaataaaagtattacaggaaggtgcaccaaagtagcttcataattttggaagttgagaaatcttttaaaaatcagcctcaaagagtaaaatccagaaagagggaaactaacagattcaactacatcaaaataacaacaacaataatagtaaaaatttctgttggctaaaaagtatgatttaaacaaagcttagagagaatattacacacatatcaaataatttgcattgagaataaataaaaaactcctacaaagaagaaaaaaaatccgacataaaataagctaaggatatgaataggtaatttaagaagagaaatacaatggccaagaggggtcctataaaaagaatgctcaacttcattaataatcagggaaattaaaatattgaaataatgggttgtcatttgcactaattcaatggaaaaaataataaaatactgaataaacagcaagcattgtttggagtgtggaagaacagtaactatccttctctgctggtgggagtacagtcagttcgggtactgtggagggctgtttggcagccaaaaattgaaccacatatatcctgtgatgtggcaattcaacgtcttagtagttcctctagtgcaatacgtgcacatgtctagaagcagacaaacacagtgaggttcattggtaagactgaaaaattggaaaagcttaaatatctatcgaaaagaaaacggctaaataaaagaagtgtacactgtgaaatatgacgtagcagttaaaataaatgaagtagagctctatacagatatggaaagtctccaagtcttgctattgagtggaaaaacagaattagaacaacatggcaacagataggtttaatagtccatctatgcatagatgaacacacacacagacacaatggtctggcagtaaatatatcacactaagtacttttggggaaactggagattaggattgacagaatggccaaaggtgaatttaggtttatctatactgctttctcattttcaaggagcatgaaatcatgtattactttataatttaaaaagttattacctaaaaaacctagtctagtcagttttgtggttgtcttgggtttattccataataattttggaacaagttgacagcttttagatcaggagttggcaaactttttctgttaaaggccagatagttaatattttaggctttgtgggccatactgtctctttcgcaattggtcaattttgctgactcaatgaatcagctatagcaggcactattcctctcccacatggcctctaatgatatggccagagttgaaaggatgttgtagggcaaaaacagccatatacaatacataacgaatgggcatggctgtgttccaataaagcttcatttataaaaacagctggtgggccagagttagcctgtgagccatagtttgtcaaccccaggtttagacttttatgacataactaaaatatttttaaagcgtatttgtgtaccacaaaatactttttcccattaaccaactgattaaataagcctctgaggcctcccttagcatcctttcaactctggccatatcattagaggccatgtgggagaggaatagtgcctgctatagctgattcattgagtcaagactcagtggcctcagaggtgtctgttgacctgtcctagatatggagtggccttaaagcagtgcctctggccatagcttcagccgagctgggctgtaatgtggagagaagaaggacttggtggcactgaccacatgcaggcaagactcggttctgtgggacaaggtgccctttcaatagtagaggtagaaaactcactggtttgaagccaactcagccgcagcactgtgcaggggtatggcaggtgctctgagggacccctccttgaagtggtgagtcctggtgactgtcatgctgctgtccttggcctcagggggctgccagcactaacccagcaggccaaaaggaatcaggactgagttgatcccagttcccatagtccccagctcccacagtccttggaggtggtatttcctgggtccagggactccagccctgtaacagggagctggttgtatgtgtgacttgtggtaactcatgcagtagttaaggcttctcctgtggtgatttttctaggaggctagtgcaggaccagagagcatcagtaatggggctcaacattaagtgattgttttcatgcttttttttttccaccctagaaatgaggagacagcagcaaggccaacatgattcacgacccactatgatgctgacctcaaacagaaggtatatttgtgttcacacacatcttttggctggagctgaagggcggtcagcccccagcaaaagagaaagaaagaaaaaccatacctgcttggtggtaagttctttgctccgacttctcccctggggtccactttgaacaatccggtgcaaaggatcgatcaaggagtagctttaccaaggagccgctgcctttttcaggacaggagtattagcttattctcttgcttttctcactgtgaacacttggcttgcaggctgaggccgagattcccactgaagtaaaggcagtgcttcctcttcccgtcctagtcataggttatgatttccccggatatgagacaatcttgtctctcacctatatttcagtccaagtcagatgtaggcactaagcggctccattgcccctcctaagtcccaagtccagcacttgaactagcaaatgaagagattaccgtatttgttctcattatgttctccctacttttttctttcaggtctcttcactacaaaaacacaggaaaaggggaagagagtggcaaatatccgctttgtctaagtaattctgagcgcatttcatcagtctgagggtctctgtcctttaccactaggggcaacattaatttgaacctagatctccttatacttcctcctttgttgaaaccacctccctggatagtgttacttgatgtgaaagtgagcaaagtattgatttatgacggtgccaatcaccagcatggttatgtaagaggggggcaggcacacagggagagggaaagggtgtgagatgagggggctgagcacagttctcgagaatgtgaccccaccactttgatctcagaacagaaggctgaccaggagtggggaggatggaccagctgagggctctttcctctcccgggtcctgccagaggggagctgaagagtcctcactcttcagcctcaaccttcttattccctagcagcaggtgctcccaagtgaacagaatcaacaaaagccgaatgtggtggataccaggatgtgtttcttctacttgctttgtttataaagatgctttatggcaggtgaggggagtggaagtaactgctcctacctaaaaggcaaacaagtacaagcctctggcaacagtaaagcaggggcatgggccccaacaagagagggagagggagaccacgattgagcaaacaggtagaaaagagaacctgggattgccaaaaaatgaccacagttgtcttcaggtgaacatttggacttccttacatttatttattgacttaagttgttattattttgaagtacatgctttaatccagccctggtgagaaaagccagaatatctaagtatgatttgtttgttttgtttttaattggtttcttctctatccaatttgcacttcccaagggatgagaaagacttgaggctgggatttcctaggggttgacatttctcaagtggatgcttgccttgctgttttcaaccaagcgcagaatgtaaggtgcttacacagctcactgctggggacttactgccagcagtggggactgggacccacagccatagagctctgtcctttttccagtcacatttctgattatccacatgggattctgctagggctaggaggcattggattacaaatcccactggacagaaagttgacttgggccttaggcagggaggacctagagtaagtgaaatattgaatgtcatgaggatattggaaagaaaaagagtaagtgaaatactggatttcagtaccagtggaagtagcctgaacagtgtgctctggggtaggaggacagcatggggctatatctggggcctgcaggtcccctgagaaacacagatcagaaggccatggctaaagccaaagagggtgggaaagctggaaagggttaagaactcaccccaggaaacttatttccaagatcaaaagtaggcctttctgcactgacaggtatctccaagtccagggaaaaaaggcatgactccagctcaggtaggccaccttgccagaagtccttaggttatgggtaacatacgtagctttcatcatctctcaaatcccttctggctcacaagggcctgaccttctctctcttaaaaatatagtgaattatttacagcagaaacaggaaactaagaacagattatgaaaccactgaggtaaaggaaatattctcaggtttctgcagggatctttgggtctcttttcctctgggtctgtggtgtgaagtcccagctagaagacaggagaaggctgtaggagtgccaggcctctctagtctagcactgcactgttaatatcagacatggctctatagtgaaatgagttaagaatacagccagaaaatacactctcgttcttaaggacagcttactaatgccctcagttgagggccagagtcactctcaagcccagctaggaagtcagagaaatttgaggccttgacctccattctatactttgcctattgcagcaaccagaaatgtagagctcctaagaaactcatcagagaaaagcagatctgatcagcctgaagagtttcttttttttt

SEQ ID NO: 14103 - DNA, 11124 bp, Human
taacatcatttttgtgctgccaagcaaaaagtcagatctgtttcaatactgctaagtcatgctccacagtgaaacagcagcagcatgtctgggatccccttttctagtttgtctgatgggaaccctggtactcacaaggcactgtgcacttggcttaacaactatacaccaaggtacacactgcgggattataaaagtccctgccctaaaggacacaaatcacctctcaattctggattgtgcctttatttcttcctaccaacactgccaatttttaagttgtttataaagcttttagttatggaagcacgatcttggattttgatataaaaatcaacatagctgccaattctaacctcagtgcaaatgcaactggtccaaaacaaagggcagccccttatctacctcatcctgtcctcagcaacatttctcttttccagatcgggaaacctgcacggccgctcaggacttctcgatgactgcaccttagagaccagagtgcaggttagcggggctctcgctccatcagtcaagtgaggtcttcaaacttcagggtgaactatggatgtgtttttaagactcaagttttcacaaaaaaaatccaagtttcagaaagaatgggagagtttcaacagaactaaaatatgagagcctctctctaaataataaaaattttctttttttttttttttggagacagtctcgctctgttgtccaggctggagtgcagtggtgtgatctcggctcactgtaacctgtgcctcccgggttcaaggattctcctgcctcagcctcccgagtagctgggattacaagcgagccaccacgcccagctaattttttgtatttttagtagagacagggttccaccatattggccaggctggtctcaaattcccgacctcaggtgatccgcccacctcagcctcccaaagtgctgggattacagacgtgagccaccgcgaccggcctaaataatagtaattttcaacggaatacattggaatctcattataaatgcctgctctgggctacgatttgcttatcaaagaattcacaagtcataaactagagggggtggactcgacgtgatgcccactaggagaaaggtgacaagagaagcacgaaggatagcgcttttcaaccctgggagagcagggaggccttcaccagaaggtgggaacccaccacgaagcgccttcaggaggccccaggattccaaaccaattaagggcctcctcttccgaaaacgggaggcgacgcgctgagctaagcgcgcaggctgggttgcgggccgacaccgaggcggcgcggcctcgcgaccgccctgggcggtcactggcgagtcacggactcgttccgccagcggccaatccaccccgagtccgaaacagaagacgtccctgggatgaaagacccaggcctggggcttaaggtggaaaaacaactcattcctcgaggcccggagtcgggcgtcccgggagaacgggaaagggagatgagcgcccgctgcggggagaacgcggtcgggttcctctccccgaaggtggcagccgcaaaaacacggcctcgaaagcagtttcgaggacgatggctcctgcgtcccgggagtcgccatgacgccgcggcctgtcccagacccggcgagggaggggaccaaccaccatctccccctcaaggcccaaaccgacaaagaacggcccccggtaccccggccccgccaccagggccactccgggtctcgcgagaccccaagggctgcgccgcgaagacctctgggaaaggcggggggaggggagaggaaggaagcgagaccggggctggaggcgggccgaggccgcgagttgagcctcaggaagcagaaggggcgcggaaagatgcgattgacgtcgcaagcgaaccaatgacgagcgagctgtggcaggcctccagccaatgggcagtgaggcctgacgcggggggcggacgctggggccgagggtagcttgagcgcggcggcggcgttgttcagtcagagcgagaacattccagaggtgagtccggtgaaggggcggccccctgcccggtgcttcccgccccctcgacccctcgggccgctggctggcggggaaggtgcactccccgaccgcccacggctcacggcgccgtctctccgcgccaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacggtgagtcgcgggcgcggcgggccaggagatggcggccgcacaagatggcggcggccgccgcgtgaccccgccgcggcgtgtggcgcagtttgggcggacggcgggcgggcgcgggcccgggcgccggccgccccctccccgcgcgctccccggcccggcctcgccccctccccggcatggcgggagcgcgtcgcgcgtgcccgccgctcgggctgactcaggcttcagctgctgcatttgtgagtcatcgcgcgctctggggcgggggcggcccgatcccggcacccctcggccgtgtgtcgcttcccggctgtgcaccctccggggccgccggctctcgggggacgcgctggggatggggccagacgccccggtcgcgcgcccccctccttcgcggagctgcccggttcgccagcccccgcggaaacgcctcggagcgcggtagccatggggaccagggcgaaggttaaccgagtatttgaatagcgaggaaaagggaggccggggcgagcctggcgttcgctcgcgctctcttgcttaatggcaaattgtgggcgagcgctgcgtttaaggaagtgctgctttgaagtaagccatggttgccgaagcaacgattagttgtagagaacagttccctaggttgcccttaaaaatgaagacgaacgggggtgtgcctgagaagtttgcttatccaggcggggtgggcggcggagagggctcgggttcgttcttcagcacttccaggatggccgcagaggcaaacctgctgattgccctcggtctgatggaatctcacggcggctgaggcagcacagcttgtgttttcttgtcaggcatttccctaccagtcacagcttagtcgaaatggaggcctttttatgttcccgcagattgtactgtgttacatgagaatggctgtttgcatgtgatctcagatgctttttaaggtggagttaagcagaagcataactaggatgtaaaaaggaggcgtttccatccagcgatgatgttaaacctggggggatttttgtgtgttctttccctttttctttcagagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggtaataaactgctcttcaatttagttgatagctctttttgtagaattttgaagtttgcatttgtcaggggaaactgcacaactaaaattcttatttcctttaggttgagggcaaaggcaatggaatcaagacagttatagtcaacatggttgacgttgcaaaggcgcttaatcggcctccaacgtgtaagtaaagcttggaaaagtccacagggcatattatggatagagtcttcaaagtctttgagctgcaaaacttgttctaattgtatgctagctaattaccttacaagttaagtgaggaaccgtggtttattggttgccatgagtttacaaaactaccaggggaacgcatttaaagagtggatggctgggcgcgttggctcacacctgtaacccccagcactttggaaggctgaggcaagcggatcgcgaggtcaggagttctagaccagcctagccaacatagtgaaatcctgagtctactactaatacaaaaattagccaggcgtggtggcatgcgcttgtagtcccagctacttgggaggctgaagggggagaatcgcttgaaccccggaaacggaggttgcagtgagctgagaccacgccgttgcactccagcctgggtgacagagtgagactcttgtctcaaaaaaaaaaaaaaagtggtgttcgtacaaatgtgagtgagtagccagagatctagttaactgtaacgatccaaactcctttttcattcaaatagatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttggtaagtgcttttgtggttgtcgaaagaaaaagccatatacctgcttctgtgataccgctaagtcaccttcctgagaaggcagagcaaatgtaattttaaatcaaacacaaaactccagttttcgagatatttccattcttttttttaaagtaggtcactgtgtgaaaaaagttttctttgcatgtgaagctgtctgtggtttagatgtcctctgattagatattttcatgttatattatggataacatttgttatttttttggcagcatgtcaatccaaagaagcaaacaataggtaattcttgtaaagcctgtggctatcgaggcatgcttgacacacatcataaactctgcacattcattctcaaaaacccacctggtgagtcttccatgatgaactcctaagatcctaagataagttactaactgttgggaacaaaatagaaggtttttttgtaataggaatgtaagggagactgggcacggtggctcatgcttgtattccccgcattttgggaggccagggcgggcacatcacttgaggccaggagttcaagaccagcctggccaacatagtgaaacccgtctactaaaaacacaaaaactagcttagcatggtggtgtgctcctgtaatcccagctactccggtagctgaggcatgagcgtcgcttgaaccttggaggcagaggttgcactgagctgagatcgtgccactgcactccagcttgggcaacagcgactctgtctcaaaaaaacaatataaggaaccttttagtccttgtactatattttatcaaatctaagacatctttcaaaagtgtattgttaattaccattaaaggtgaaaaataggctgccaattaaactgtgccatatcaattaagacattatctgagggtagatgaagtaatgactaaaattctgctggaaacccagcaaagtttcttttactggcattgtttggtaaagagggcccccttcattaaacttgaatattgcaagcaacactctgtggcagatgatcaaaactgtctgacacaatttgagcttgctatagcaagaaagtctaacctattccggtgttctctctcccatgagacaagccgttatatagacttaaacagtgttccacctgttggctaaagctgggttgagttaatgactttgttcatgagggatgacagggatccttagggccacctctccctagtggaggcatcatcacttcatcttactctttcttagcagttacaatacccctaatattttgtgtcactccattcttagactaacattcttacgtatgaaatacatgatgaatttgatctgtgaagcctcttaggtagcattgtgtgtgctgtgtggtttttctgaggggatccataggaaaataagggcagggttttaaacgttaatgatgggcaatgaggtaatgtaagttatggggttaaatttttatttccctttttttctgtagagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggtgagtgcagggttgatggcctagtgggcactaaagttgtgtaaagtatatggcatttggttgaggtgggtggaaatgttgaaactagccttcagtgtgtaatacactaatattgtggattccaagtactgtttgttgtttgaattaaggtgaacccaattttggatggagatggacttgatgccattaacttggcaaaatctgaacctttttgttgttgtttttaaggcctttgatcaagtagctctgttttcataaacaggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaaggtaaaacatttgcttggtctgtaaatcagcttcaacccagccttgtttgtgcctttagatatatgatactttagcagtgtaattaggattactctaatgcacgactttttagaactcttgttcatttaaatattttttgcgcgtgattccaggcactatgtgtcacaactgccaaattaggcaggaaaaatatgttcatcagagcagggactggctggtgtcttgagcctggcaaagtgtgcctccattgcactgaattgttttccttttctttgcagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgagtaagcaaagtgctctggattcataaatgagattacagttgtgtggctttcgagatggtcatattaaccacttttgcttgtcctgtcatgcttgaaagtggggaaattgacccaccttacaagcctctgagtatctgaaagtgccatacctaggcccttacaaagtaacagggatgtttatgcattgacctttttgaacaactatggtatgggccatgcacttgcagacactcttatttgggtaatagagttgtcaacttagaacacataaaaaagattgttaacaccaaggtgtctatttgcagttttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggtggggaatacataggtgggctcttaaagttcacaggttttggggggtttttttgtttggttgattgtttttggagacggagtctcattctgttgtccaggcaggagtacagtggtatgatctcagctccctgaaacctccacgtcccggcttcaagtgattctcctgcctcagcctcccaagtagctgggattacaggcacctgcgatcatgcccagctaatttttgtatttttagtagatggggttttaccatgttggccaggttggtctcgaacacctgacctcaggtgatccactggcctcccaaagtgctgaggttacaggtgtgagctcctgcgcccagccgttcacaagtattgagacggctttgagatgaagaaaaaatgtcttaatatctatagctaaagttcagtgcctgtgctgtagattgtgattcgcatcatgtcagatttgtagtcataacagactgctgagactaacgtgttcactgagtacattgattctgtttgaggattcagacttgttaggacccagtcccctcagctcagtaagggggattgtataaataatcaaaagttgttaaaattcctcaactaagagacttgtactcacattttttaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtaaacattgggggaggagggtattggatacagtgctggcatgggtgtttgagatttaaaaaggtttgtgaggagtgatataatggcagtttggggtaatttcaggtttagaatttaagatgcagtaaaatacagcctctcaataatttggaaaataatagaaagggtgatggaaactgtgttcctactcctacacattatagtctataaaaaaactttaaaaatgctcttagactggagcctgtgtaagagaacttgcagtgtttgcataacagagctgttccgtgaagaagaaatagctgcatctaggcagtttcctcctctgtgaccacaatttacattgatttgttttataaacagatttatcagcttatgttgaataaaatcattcctcttaacaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgcaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaaacaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggcttta

SEQ ID NO: 14104 - DNA, 10204 bp, Human
atcacgccactgtactcccacctgggcgacagagggagactccaactcaaaaaaaaaaaaaaaaaaaaaaaaagaagtgtatatgacaatagagaaatccttatttgggtgctgttgtttctttccagcacaagttcacaaaataagctagggaaaatcccccccgcccgggaaatgtcttggttgatttcccgtttgctctcttagagcattttcagacacctgctctatctttctgcccaaagatagagatgctgggtgggtttctatgttctagggatagaaggcaaggacttggtcactgtaacacagaactgagctagccacttgggtgtctggttggcaagttgccctggtaactccttgtttaaattgtaaactagatagaccttcaaagctacaattatgaaagtgtactaacagccacagcccaacagaaatgaaaatgtacaagcaagtacatttgcaatttttaattagctttttttttttgagatgaagtctccctctgtcgccaggctggagtgcagtggcgcgatctcgactcacagcaacctccgtctcccgggttcaagcgattttcctgcctcatcctcccgagtagctgggtctacaggcgcgcgccactatgcccagctaatttctgtatttttagcagagacgtttcaccatgttgggcaggatggtctcacctcttgatttcgtgatccgcttgcctcggcctcccaaagtgctgggattacaagcgtgagccacggagcccgtccaatttttaattaacacttttttaatacttctttaattattgtttaaaccaagttttccagcctccttcattagcctgtttggtatttgcatgctttgcttgaatattttatctccagcccattccacaccgttagtcaacattttcatctgacagacggaatcaaggcctaggcctcccttaaacaaaacatccctcccaaaagtaccacttataaaaattgcttgccacagacattcttgctacagacattctttgcggatctttggccagtaacatgcatatacccacacatagtttgcaaataacaactattcaacgtgaagtgctacaaaagtacgatgataaagtgctcgccgcttgaagaaaagcactaataattgtaacaaagccaacacacacacacacacaacgaaaaaaaatgcacggtaagccaagagctctttaaaaataaaaaataatcattctcgggaacaaataaggtaggtacaaacttgccaggtgactctgttacgcttaaaggttctggctgtcaacagtccccggcgtggtggcggcggcaccctcagtcccatccgactgagggcgttgatgcgggagcctcggggctgcgggactgttcgggataggacgcgagagcacctggacaaaggcctgaggcggctgtgcagaacagggagtggccccgaggcccgggtttgtcttcccttccggtcacccctcccggcccaatgtccccaggcccctgcttaccccgctgggcgccgtatccctgcgctcggcgccgcgctccggagcgagttgacagccgcggcaggcgaaggcgcggcagagaggggggagaaaggtcttcttccccgcccgcaagaccaccatggccccacgccccctggctcccgcggcgcacggcagcattgcgacggcgcgaggggccgctttacggcagggtcgcgaagcccgaggaagcgcggcggcgcggccgaccgtgcgctttcccagcggtgcgacggggtgagggggcggcgggcggcgcgggctgacccgggcggccgctccttggtcgcggtcactccaggctgcctcgctgcgccgctggcggtgggcgtggcgctgccggcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacaggtgagcgaagcgcggcttgtagccttttccctctctcggggggacgagtggggcaccacctccgcgcggggctccccgctgggccaccccttcgccagcgcccagccccgtgcggcctgtcggatcaggcagggcagagtcggtctcggcgctgtccccgcccctggggtcggaagcgaccggggctggccgggcctggtctctggtgtctccggccgggcctcggttcccctcctcccccggcttcccccggccgggccgagctcccctcgcgcgcccattgtgaggtcacgtcctgcaggcgcgccctggcacccgggccaagacgcccggagcggctgctgcagccagtagcggccccttcaccggctgccccgctcagacctagtcgggaggggtgcgaggcatgcagctgggggcccagctccggtgccgcaccccgtaaagggctgatcttccacctcgccacctcagccacgggacgccaagaccgcatccaattcagacttcttttgggtaaagggccaagagggaagggcgaggcggggaggaagcagctcgggccgccttccctccgtggcctccaggacatccgccggggatagattatgcgtttccattggttacccaccttgagcgagccgtttgatagaaaccaagagcttgaaacgtgcattaggccattgtggactcccagtgggaggcgagtgaatgaattattcatagttaccacgttttcgcgggttgtttttttttgagagagtggagcatgttgggggctgaggaggtgttgggcctcgaaagcccaaggtggtgcccttcagcgctgtcccggtcgctcttctttacctgtggggttttaatctcttcagggagacttctgtgagggaagatgtgtgaggagctaaaagggtggggaggggaagtgcacaaagggatggagagaaacgaagaagcggggaccttggggatgtctgagagccactggtttttgttctggttctttcttttgcttagagtttctggaaactaggcatagctgtgtggcggggcggggtactgttagtgttcggaaggttacaagagctactgtttcacctttcataaaggtgccctgctggttccaaatagtttgtgtcgcgtacggtgactcacaccttaatcccagcactttgggaggcggaggcgggcggatcgtctgagaccagcctgggcaatatagtgagacctgtctctactaaaaataacattagctgggcgtagtggtgtacgactgtagacccagctactggggaggctgaggtgggatgactgctcagaagtatacctttttaaaatgagaattttagaatgacttaatataccattagtgttctgcagaagccttgtgctgtagtaagttatcattcttgtcgtcttttagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggcctttaaaaaaaaaaaaaggaaacactcatacctgtagttggaggatgaatactggagacgggttaccaatgtcaggttatactaaaactaaatcagaaagtctgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggcagtcagctgttaaccactcacttagtaaatgtcataactacacctgctccaggaccaatcagtgaaacctgctcggaattaaaggcttcctctgggtgcctgctgaacaactgagctcatgtcatgggcatgtggtggtttctctgttgcctgaaagagccattaaagtcagtcgtgcgtgaagcatctctcttctaaaggatgtgtatttccataaatgctttctgaggatccggtacaaaatgatttcccaaagttctgaagtgccttgagaacatgtgggtccgagtgttataacagactcctcccccgggtcaccttttgcctggtcatcctgttagagtacatctttggaaatccagggtaatattctctttcagagatgctcattgtgtaactctgtgtagggagatagtcactttaaacagctcaaagtagctagctaaaggagtagccttaaatacctaaaagatgacagaagcatagcccttaacaaatcttcagcttgtctctcagtatttcccaatcatgaaaatcccttgctatgtctttcctactagaaatgttctagaatcgctggacggtggggtcagagggcagtcggtatttaggccgtgagcttcccatactactgcaggtccaactcctggcaaccgcgggctcaaggcaggtcattggaatccacgttttggccacagtagttgtaggattgcttttctgtatcataattttagaatgctcttaaaatcttgaggaagagtttttattttttatttatttttgagatggagtctctgttgcccaggctgcagtgcagtggtgccatctcagctcactgcaacctccacctcccaggttcaagcgattctcctgcctcagccacctgagtagctgggagtacaggcatgtggcaccatgcctggctaatttttgtatttttaatagagttgagatttcaccatgatggtcaggctggtctcgaactcctgacctcgtgatccgcccgcctcggccccccaaagtgctgggattaacgggtgtgagccacggcgcccagcccaggaagagtttttaaattagagctctgtttaattataccactgggaaatcatggttacgcttcaggcatattcttccccagagtactacttacattttaaatttcattttgtaaagttaaatgtcagcattccctttaaaagtgtccattgttctttgaaagtagacgtttcagtcattcttttcaaacaagtgtttgtgtaccttttgccaagctgtgggcatcgtgtgtgagtacagggtgctcagctcttccaccgtcattttgaattgttcacatgggtaattggtcatggaaatgatcagattgaccttgattgactgtcaggcatggctttgtttctggtttcaatctgttctcgttccttgtaccggattattctactcctgcaatgaaccctgttgacaccggatttagctcttgtcggccttcgtggggagctgtttgtgttaatatgagctactgcatgtaattcttaaactgggcttgtcacattgtattgtatttttgtgatctgtaatgaaaagaatctgtactgcaagtaaaacctactccccaaaaatgtgtggctttgggtctgcattaaacgctgtagtccatgttcatgccaaaaatggctgggaacgtttgctttatttacattcagtcagcgttgctttcagatcacactttatccacacaggaaagccagtcagcctataatgaagtagttattaaaataaatgtaatgaatatgtctacaaagtatagtttagtggtttattttgctaaaatgcacatatatttgatataatttagtttgagaagttcagctagtttttctcctttgtttgactttgtcaatttctatctggtttttaagggtctgagcttagcttgtgcatgcaaggttttgggtttttttattttttttttgagcacagcttttcaccttttaatttgttgggtatttttctcttaataagagaaatattggccatcgatttttacatataatacaagtgtgtttttccagtacattggttcctgtcccctctctgtgaactgtttgagtattggaacagtatgtcttcaataattcaatgttactttgagatacatgtgttaatatacccttagttattcttgaaataaaaccagtctcttacgcttgcagtggagaaaggctgtgagtctgaggtgtgtgttctctatatattatcaccttcatgaactgtctgacctgggtgcggagccctttttttttttttttttttgagacggagtctggctctgtcacccaggctggagtgcaatagcacgatctcggctcactgcaacctccgcctcccaggttcaagcaattctcctgcctcaacctcccgagtagctgggattacaggtgcctgccacaacgcctggctaattttttgtatttttagtagagacagggtttcaccatgttggccaggatggtctcgaactcctgacctcaggtgatccacccgcctcagcctcccaaagtgttgggacacaggtgtgagccaccgtgcccagctgaggagtccttccttaatggagcccacagcaggcaggcctgggggcaggtggcctccttggctgcagttggtggccatgctgtaaggaggtgagggtggttgtgtgtgggccaggacccaggcccaggtgaccaggtcactgtgctcttgttgagacagcctaggaagtatgtgtgtgatgggggtgggggcctcatgctctgctccctcaggaggatgcctgggtctcaaataagaattgactttatttttagaaagaagaacctctgagacagttcttgaaagatccactctccagaggagagttgtgatagtgtgctatgaaaccgtcttcactgctttgtgacggaggtgtgggagtctttctgtctattcggcccttcccggctgtgtgaggtgttctgactccggcctccggccctctcccagccctaagtctagtgaagcccgtgtgcttggactgcagacgtgcctggctcacttcgggcagttgtttgtctattttaagtccgctatgtgacagcaataagttttcctatttttagccctttcctattgtattttttgttttgttttttgttttttgtttttttggggggagcgttttgtttgtttgtttgtttgaggcggagtctctctctgtcacccaggctggagtgcagtggcgcgatctcggctcactgcaagctccgcctcccgggttcacgccattctcctgcctcagcctcccgagtagctgggactacaggcgcccgccaccatgcccggctaattttttgtatttttagtagagacggggtttcactgtggtcttgatctcctgacctcgtgatccacctgcctcagcttcccaaagtgctgggattacaggcgtgagccaccgcgcccggccttccattgtatttttgttgtcttctctgcctgcttttatcttccaggtgatccaaacaggggcagcctttgcaagccttgcaaacgcatgataggcccagagccaagaacaacgatgtgtataggttgaagagaaacactctgggggaaatgtgagcttttgaataaatccttggccacacgtgaggattcttatcacttatactggcaacagcattaaccaggctcctagtgtatcctcgtgttgcgctgaggattgaagaatccatcatgccaccagtggccatggagaaattccagtttagtcagagaagggatgaggggagtcagctgcgcctggtctgtctcaggtgtgaatgtctggtgtcaggtcaggtgtcaagtgcaagccggaaaaagaccagtggcttagggaggggtctcactggcccttcaaggctggttagaagtaggacaggagacggtgggtgtggcaccgggaatcatggcactttgggaggctaaggtgagaggactgcttgagcccaggagttcaagaccagcctgggcaacacagaccccatctctacaaaaaaatcaatataattttttttttttaaagaagaaaccctggagtgggctgagctggaacgaggtggcaggggctgaggggcagtgccctggcaagcttggctcttgattctgggtacaagctgagccctaattgaaggcctcttatatgcaggtctggggtcgcccctgctggtcaggacatgtctgagggcatcttacaaaatgttttgggttcttttgtttttttattgaaacagggtcttaatatgttgcccaggctggtctcgaac

SEQ ID NO: 14105 - DNA, 121982 bp, Human; identical to SEQ ID NO: 12085

SEQ ID NO: 14106 - DNA, 7158 bp, Human
tctgagaagctgcagttgctgaagacagaggaagtcctgagtgtggcccccaagtctctccctccccccaagtctgcctccaggggctgcagctatcccttccagaaacagaaacttaagcccttcaggttttgtggggtagcaggtgggcagctgcagaaatttctaaaactgggcgaagaggctgcacggggcacagagtgcaggaattccaggcttaagggacacctgctgtctggccagcccagaggggccgtttgcctttttacatgggttggttttattaagtctaaaaaatgctggcttggaacaggacgaagcatgccaaggagcaaagaggcatgtgtctcctctgcagtgaccatggggatgagacaggagaaaaggcccccacaccgatgctcacataggcagaggtgaacaggcttcccctgcctttgggccttggctctggtgccttctgctctgaggcacctattcggggtcccttatacctggaacgccactgctctgtgtccccctggccccagcagcaccgatctgatgtcatctggtttgttgggctgctggctcatggccagtcttcctccagcagcaggcgctgtgtacctcgctgcctgctgtatccccagcggctggcacctgttaggtgctcattgtgccactgctggagggatttgtatcaaatatacccacagataagagttccccccttctttgctttattcacagagcaacagatgagggtccctgatggatattaaccccacatcctccacttccccctcttaacagctgcataatattccacagcaagcagatgcctccctacccttggccactcccgcctgatggggcatcgggttgtatccagttatgtttgtttttccctccacagatctcttggtccattagtggagagaactgagacatcctttctaagggctgcattcctagaaggggagattgctgggtcacggagttcgaacattgttaacgttaatagattctgccaaattatcttgcaaaaagcatgcagcaatttaagttgcaggcagcgtgtggacgcctgtcttcccgcattccagctcaaagccagcaatggctggggtcgatctgggagtgttgggggtaggggcaggtggagtcactgcttaatttgcatgattctggttattcgtgagatcagtttttttttttaatcgcacttatgcttattgtttattagcgtttcctcccatctttgcctgaagtctccggggactgcctttgggggtcgggtaaacttgtcccctgcgaagagggcccagggttggggtctggaaactccgaggctgcacttgccagcggcctcttaaggccacagcgtccccgtggtttctggctcgcagccccccgagacccaggacttgtccaaggtcagggcaccgcgggtgcccccgggctgggccgcagccagactgcgcttcccgcgcgccttcgctttgcaccaggatcgcccaggaaatgcctgcgggcaccttgaggaaggtcggcggctccgggccagctcgcactggccgggggtggggcgggggccgttcctgctgcggaagccccgaaagctttcgcccggcccctcgccgccgccgcgggggctggctggactaggcgggcaggctcgaggatgcggatgaacccaagcgtcctcgagtgcccggaggctctccgcctcagtttcccgcccagaggcaagggcgtgcgaggggatccagatatccaaggacctgaggtttcggcctcgaggtcttgggcgggggactgggcaggctgcgcggggtcccagcgaggggacagctcgggtgggcggccagggtgttgggggctgcgggcggcggacaaagcggcggcaccaccccgcggcgcgggccaatggaatgaatgggctataaatagccgccaatgggcggcccgcgttgtgccccttaagagccgcgggagcgcggagcggccgctgttcgcctgcgtcgctccgggagctgccgacggacggagcgcccccgcccccgcccggccgcccggtgagtgggcccgggggccgggggcgtccgcgcccgggctaggggcgctgcgtgcaaagggggcgcgtcgcctggagcgcgcgccggaccggccgggggtccccggcgatgatggcgctccccgcgcgcgctgcggaccccgctgaccttggccgcgtcccggggggcgccggggggcccggcggcgggggcctgagtggtacgcgggagcccgggaaccccggcgtgccggtcccctctgaccccgcgtctccccgcagcccgccgccgccatgcccttctccaacagccacaacgcactgaagctgcgcttcccggccgaggacgagttccccgacctgagcgcccacaacaaccacatggccaaggtgctgacccccgagctgtacgcggacgtgcgcgccaagagcacgccgagcggcttcacgctggacgacgtcatccagacaggcgtggacaacccgggtacgcgccccctcggggccggggttccgggtcccctccccccgcgcagccgcagggtcctcagcagcgcgctcgggcccggcagtgacgtcactgtccccgtcccgcgccccctcccccaggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcaggtgcggggctgcgggcgggccgggcgggcggggccggggtcttcgggcgctcactcccgtctcgcctcccagggcggcgacgacctggaccccaactacgtgctgagctcgcgggtgcgcacgggccgcagcatccgtggcttctgcctccccccgcactgcagccgcggggagcgccgcgccatcgagaagctcgcggtggaaggtaggggccgggcgggccgaggggcggcggcggccgcgtccccctcccggcgcggtccccgcccgcttttgtttacgtcgcccgggagcggcagccgccgtcgcgctcttatctgcgcgcgcccgggttcagtttcccggagggaccgagggacggaggcccagccccgcgcccacagcggcctggggcccagggagggcgggtcctggcgcggggtcaccgcctgggaccgtcgcccgggccgtgaggactggacgcccgcagatccgggcgggtggggccctctgacgtcccccgaggtggggcacgggggcgggcgggtccgcgctgcgggctggaggggcgggcgcgggagccgagcgtcctgagcgcacccctcgcagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggtgcgtgtccctctgcgccctctcgcggcgtcctccctccccgctacctccgctttccctctcgcccccctcgcgggggtggggcccctcgcggcgaggaggaggaggaggaggagggaggggccggccgcgctccgggtctgggttccgtgccgcgcctcctcctgcgccggtgaccttggccgagcaggtgcgttaagggactgggccccggcccgtgggggctcaggactcagcaacacctccccaccccgagacgtgaggtgggggcggggctctctggcgcctctccccgacggccctgggagctggagctctttgttttcttttctcactcctccgccgctgggattctaccaggggctggtgacgccaaagcttctccaggggcagggctcctacccccactgtggggggcgggtcgggctgtcctggcggtccctggccccgccccacctcaggccacagcgcatgatggcagctggggttctcctgctgtgaggcgtcccggttcccccgcccgccccgtgttggcgggtggagtcttggcagcagcctccactcctgggcatggcagggagcagcacctcagggacttgggaagttcctttggtctgggggcggcctggggcttttttctgggtatgccctgagaccagccctcccgcaggcacaatgacaataagaccttcctggtgtgggtcaacgaggaggaccacctgcgggtcatctccatgcagaaggggggcaacatgaaggaggtgttcacccgcttctgcaccggcctcacccaggtgccagggacggggcaggcccagaccccagggccccagcagggatgtgggtgccccagcatcagtccccccgggggatttccggcactggggagtctcagggcctgtaggggtttcaggcaggccttctccctcataccctcttctccgtctgcagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggtgagcagggcaggtgctgcggcttcccgtggcctttgggcagccctgtttcctccgccctgacttgctgtctccccaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcctgcgtctgagtggtgcctctcctttcccaggggggagggggaagggcagcagccaggccccaggagtcttgagtcctgggcctgctgtgggcctcgccttctgtgagatgggacaagagccaggaggtggccactctgttctgcctgccctacctagtccatgggccccttccctcgtgtctatcgggctgtgcaggcaggaacatgggagagagcgagggaggagctccaggcctgagcatctgagggcattcaggcctgggtgtggagcctggcacgttcctcaggcccatcctgcagggtgggggaggtagggatagtggaggtggggggttgacctcagaaacttgagagctttccggtccctccaactggcttcctcctccagtcttccaagctgcaacactatcagatgcaggcatctccctgcctccttcctaccccgccaacacctactctctatcttctcttccctgcttccttccctcccagcctcggccttcaggctgaacagcccccctggctccactggtcattgggctcagtcctcaagaccctctagcagccctggggagccactggtcccccctttactggcaggctcctcttcaggggcctctgggtgtccagccccttggcctcaaggtggaaccacaaggtagggaccctgggcagaaggggggttggggctgtttagggcttggtcgccctggtccctggtgcaacccccccgccaactcaccctagttgccagttgccactgtccctgcccagcctctggctcagggctcctaccatgattgggcaccctgaggggctcggccagctcagggagtggaggcggataggtgagccagcgggggctaggaatcctgctccccaccttcctccagctcctaagcgccaaggacgcagcctgtgctgccacctgctggccagggcctcctctgccccacccctggggatcagggtctgggacaggcctcatcctgcatctccatgcccacctggacactaaaagctgcggatcactgggctctcacctccttgggacacgaggggattgccaacctagacactggggcccaggagcagcagtggggtgcatccctgaatctgctgctgggcttggcttgtggggggtcctaagggcagggttgaagtgtccacctccctgagtgaacacctggtaggctaggggcatagggggcaggtcccctggtgcagaaggctggggggacttctgcatccagcctttggaccctagactgggccctccctggctgaccagcctgggcacaaggccagtttctggcttagccttttgctaggaaggcccgggccaggataggccgagctgtacaatcgagagtcttgggagaagggcggggacgaagggcccgaggtgagcacaggaagtgagcccctccagaaaggggaggctgagggcagtgaggaaggggcgcagacccagtggggacctgaccagcaaagccccacccccagggggccttgtcagtgctgccctcctcccgctcaacagcggcagcccctcctgctggctcagtccctctcatcacggcttgggcagagccagcctgacaatcgctggggtggtgtgggccccactccgaggtgaacacagggctgagggcatggctgggcaggcctaacacttgtgtttcaacgctccccttttcccatgttgactctcagagtggggcactcctagaaccaccggtggtcaaacaagcggaacccctaatcaccccatgcaggcctctcaacgcactgtccggggaggccgagaaggctgggcctggctcaggaccacttctgaggcagtaaaactctgaaggtgggtggggccttggctggcctgtggcgcccacagggcctggacccccagctctccgggccccactctcctccctgtgcctcacgtattttatcttactgcattaattcttttggggaccaggcagggcctaaaatacact

SEQ ID NO: 14107 - DNA, 19319 bp, Human
tcacgaggtcaggagttcaagaccagcctggccaacatggtgaaaccccgtctctactaaaaatacaaaaattagctgggtgtggtggcacgtgcctgtaatcccagctgcttgggaggctgaggcaggagaattgtttgaaccaggacccgggaggcggaggttgcagtgagccgagatcacattactgcactccagcctgggctacagaaaaagactccatctcagaaagcacacaaaaaaaagaagaaaatgtttgttcatcctgcctttaattccttattacaaggcgtgaatttttattgttttttttgagacagtctggctctgtcatccggggtggagtgcagtggcgtcttcacagctaggcacaacctcgacctcccaggctctcaagtagctgggaccgcaagcgccactacactggccagctatttttctttttttttttttttttcggtagagagtaggtcttgctgtgttgcccaggctggtcttgaactcctgggctcaggcgaccttggccgccttggcctcccacggtgctgggatgacaggcatcagcagtgttgaagcctgtgaggtggggtccctgtggctgactctgccctctcctggggccattggcagtgcaggggtccttgtgtgtggaggaaataaggagatgatcaaagtatgattccacgaatcacacggtttattgtcaaagaagatttgttctcgggttcacagtgctcagaggggaggagaggggaggaggtgaagacacctggcagggaagcagggcctccatggatggggtgcattcacggcagggaggtgagtggcagaacggccagggtccggttgctctgctgggatggagcgggcccctggagagtgagatctggtgagagttcgaggtttgccttggtagcagtggagagcgtgagagcgggagctctctgagaagctgggaccgaggtccagctcccaggccagcagcgtatagcttgcctcaaagcatctgcacaaccttcaagctgatgtctgtttttgcagtccagcagtcagggtcagtaactcacataagggagtgtctgacaaggtttaagtggcattcccaaggttgcggagttcactcaagtcctcacatatgtggtctgataagacatcacactcttgcaggggggtcaggtcaccccaaaacatcagactatgtaagtgctgtgaatcacttcaaagctacacagcaggtcccagggcccaaggcagaggagtgagtccacctcggaaggctcagagcagctccaggcagtaaccacggcatttccagagtctggtgtgtgagcctaacagctctggtgtgaccgtccgtactcacctagcagcacgtgacatcagctctccccctgaagtcattgctcagctcgggtgctgcaggaagacatacaggtctgtcttgggccagccccttgcctgctgtgggctgctccctgtgtgtggccttcaccccggtgtagagagatgggctggtcacacccctgcccctcacagcggcgagaggacagaggcatgtgccgggctgtctgtggagctcccaggccagtgtctgggatgcggcaggtgcttggtgttaaagggaaaatattccaggatatctgtgaaagcacgttaggcagagaccaggctttcattcagaacctttgagagatgtgggaaccaccacactgcggtcttgcagtgggagagaggctgggctcagctctgaacaggccatgggctggtggcggcttacagctccagagctgggcaggggcagaggatggaaggttgctaagaggaacccccaggggcgaaggggatgcaggttcaactgacctgccagatcaggccgcccgggggacagtggaagatgaggcgcctaatcagctgtcaagggtgatgggacacgggaggaggtcgtcgctaaacagactttgagccaggcctgttaaaccaagttctcagcaggatgtgcacagagggcccaggaggagcctcaggagccggactgccgttggccaaccggtgagtctgttatccgtcagtggacactctgcttccaggtgccttggcctcggcccgcgtcctgaaggcgggagacgttgcagccacgtgctggccttcccggtgctcctgccagcgtcccgctgcttgacacagtccaagttttgtatccagacccagcctgggacagcagcctcccgacagcccccaggcccagcctgtctgtgacagtcacgcctgctcagggaaccatccctccgtgcagatctgggctgtgttttgggtggtacctcgggtgtggggtcccctaccaggtgcgaggttcatactccccaggctgcctcctgtcctcagggcttggagagtcccatgttctgaaaatgacctcttttcgagccgggcaaggccgcatctcctttggcagtgtagtgtcttccctggaggtggcattcctttttgatttgccttctgtgcttgggaacctcacttcctcactctggccagctctgccagcagtttggagctggttcagcgccccaccgccctgccttggcctgcgcccggccctccagggtggcttctcgccagttcctgtcaggcctgcctgggcaaccaggcctgggcacctccctgtcccttgctcagaaaacccacaggctgtgggggcccgggagccaagcctggtgcgcgggcaggaaacgcatcctggagcaccagcttccctgccctgcccgcctcacggggtgcctgggggcgtgcctcagcctgctgctcctgtagtctgttctccacgccgggcctgtctccctgagcaggctgaacatgggcatacgagtgaccagcgtgatcgtgtccaggccagtgccgcattctgtgtggtccaagggaaaaccttctccaagtccacggcccgccctttcctctgctgggttacggccaagggcgccaggcctcactggaggacatggatcctggacccggccctcgaggctgctgccttccagtttccccatgtcctggacactcttggtctcaccatttgggaggccgacaggggatgcagagtggcctgttggaaaggccttatgtgaccccaggctgagtccctgagcagcctgctgaggccggaggggagaagagctgagcttctcccttgctgggccaggctcgggctgtggaatggctgccagctcccttcctgggagaggctgggtggggtccacagcaccttcctcccgtcccacaggaagctgtcttctgctgttggctgctgggggcgactgatgtttggatccctgagcaccctgccaatcccagactcaccttcccactctttccagagtccccagggagacacttaagggaaattaaactgcagagtgcaagagatgcctcagtcaagtcagccaaaaacacgcgggtcatccccaagccccagagaggtgagtcgggcagggcactcaactgctgcaggaggatggtcttatttctagcactttccacaggaggtaaatgtggtgggtttggggggtttttcaaatgcatcagtgtctggaatgggttctaagctgctaaataattcttagaggtaaatgacagacatgttgccctagatgtagctagacagccttccctctacagtgaagtctcctccaccctcagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaaggtacatttatttctatttacataaagggtgtgggtgggtgtgtgcagtttatataaggcaggttaacaaaacgctggctggctaagccttccttcctttgcctaccctgattattaaaccgagggcgggatgtactatgggattttcaggtgtgtgtgtgtgtgtgtgtgtgtgtgtgttcttaactacatggatttctttcagttacttttatttttatcaaagtaatacatgcatattgtctaaaaggtaaaatggagccacataaagtcttttagttttttttttttggagacggggtctcgctctgtcacccaggcttgagtgcagtggtgcgatctcagctcagtgcaagctccgcctcccggggttcacaccattctcctgcctcagcctcccgagtagctgggactacaggcgccagtcaccacgcccggctaatttttttgtaaatttagtagagacagggtttcactgttttagccaggatggtcttgatctcctgacctcgtgatccgcccgcctcagcctcccaaagtgctgggattacaggcatgagccaccgcacccggccgtcttttagttatttttttaaaaaatatttacatctgggctcctaaacgtgtttatgttgtaatgtttgatttgtcagtgttactgattatccatggacttctcttgggggctgtgaggactgagcgtgcctacacctgtgtaccccaacttcctctccccccagctccctgcccatacttagaacctagtttgggtgacatcagctgtcagggttgtgactgggtgcatactggccattgttgaacctggtgtggtggtgcaggggatggttttctttcttacagcatcttttttcgcccgagttagtaaatgctcaaaactcaggccccacgtgcagcccctgccccctgctccccatgccagccgcctggctgtcatccggggaccctcctgccagcttccatcctcccccgtctccccgggcctcagctacgtgaacctcagcacgctgtctgtggcgagaagccggagtgctcatggagctgccgcagcagcctggtgacagggcagggcctcgctgtcctgaccctccatccttggctgttggtttttatcctcctgttggtggccttgtgatcacagctgctgccacagctgcagacacgacgcttgcagaccagggacagagaagggctcagccagggagttcctttctcacctgtgtctcttatccaaaaaccaatgtttccagaagtccctgcagacttcacggctgtgaagggggctggggctgtgaggcttaccagggggagcgccctgccacagccccgatcccggtgagtcctcagggcccacagagccttctggagcagcctgtctgcgggaagccccctccgctggatctggtgaaacccaggggcgctttcttcattcccacccttccatctccttgtgttttctgtgtggcttttctgaagatcacaccagtgcttactgttttccagccgcacaatggttgtcttttcactgcagcgttcagcgcacccgtgttgagggggtttctgatgtggtgggtgtaagtccccgtggccgggtggggcgcttcgtccaccactgctccctctcgtgtgcgcttcctcgcacttccctgatcggctgatcagtctgcagcatttgtcgtctttctacaagtttgaaattagaaagtgatgcacttatctgagtccaaaattaacttccttgccctcctccccagatggcaggtcctggggatctgcacccctgtaactgctgccaccgccgttctgattcgcacatgctctgccccctgccctgactgccctgcgcagctggcgtttggacctgggctctgctaccctcccagcgctcccctccccagggcacatgtcctctcccgcggctcagcccagatccatgcctggtgggcgggtggtggaaagctcggtgctggttttttcctgcccccttctggagcactgtctccagctggcatggaactgggtgcctgtcgtttcttctcagtaccggaacctgctctcagcaccgggacctgcccagccctgtcttctggcttctgccccagctcacgaggctggtatctgtccgagtgccaggactcagggcgcagtgtccagcagccctttcctcgtgcctgtgcatcggccacactgtgtccagggtttccagggagcaggggatccggtccctacccaccttgtccccagaatcggaagcacggtgctctcacagtgctcttaacaaagcaccttttgtcactgtgttgccctgcgttgtgacagtctgacattttcctgtaatttatctgtgttatttcagccaaactgaaatcggtaaaggaggttttacacttttctggaccagacttgaagagactgaccaacctctccagccccgaggtctggcacttgctgagaacggcctccttacacttgcggggaagcagcatccttacaggtaggtgggccctggcatctctgccaggggtgacatgtggctccagcatcatggtcccagtggtgcagggcaggggctgtgcagacttcacccagggaccagcctcagggcgtgtggcagctgctccagccccagagttcccatcttgcttgtcctacacccatggggctgtggtcacagcatcgggtcagaagatgcgtgaggtggacacgggctgtgggacctcctggggaccttgctccatggaccagaggagggggtgcaggaagcaggggtggatttggcagtcagcacccagagcccttcaggctctggcagggtgggaacggtgtgagatggggccctggccacggtcccaccaccacgtgtgggaaaccaggtctcagcaggggaaggaggtacccagggaaccccatgcgcctggacggacaaggtttccatccctgcatctcagcaggccctagtaggcagcggggtcctggcatgagcagggccctctctcccctgcaggtggctcagtggcccaggccccgaggaacgtgctgaacttggggctgccgtggtgggcaggtgccacggccacacacacggtgctgtgggcagggctctgggcaggcctcacagtcagggtggcctgctccacctggacggggtgcccaaggcagtgtgcagactccaagggaggggctgctcctcccggcccaggccccaggccaagagcgcagcctgcaccgcatgtcccaccttgagccttgccctgaggggcttcggtgtcgtggaggaggctgtgtcaaatggctcatccaaggccctttagccaagaggctgagaccagcattgctccagaatggtatctgtcacagagaactgacggcatgtggtgtgcatgtgtgcgcgcctgcgggagcccattaaagccgcttgagaactgttcagcaccccagggcatcccagctggacagagctgtgcctttttcttcacatggaggctgttagggagcgcctcggggctctctggaagctttggctgaaggcgtctggtgctgcaattgccccatagggggatccctgcgggcatgtgatggtggccctggggctccccctgactctgcatctcaggtgcacccgcccttcccggctgggcccccctccctgccctcagcaccttgctcacccccatgaccgcaggcacctgtgctccagccacactgcacctggcacaggcaggctgaccatgcctcccgcagtccccagccctgcccgcaggcccaggagagtcaggcctgacactatccctgccctttagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggtgagtggccaccccttccgtggggtctgggcaggtgggcggcccctgctttgtgtgggacagctttccgttgaggtggggcagtggccgcctcttgcgctgttcctaccattgcgtctccctccttctcaccctgattgccctcgctccttccagaacagggagggggaagtgaggctgggctcagctgacagcaggaggggtgggagggtacgaaccccaccaccaggcagccggccctcagcagagctaggcccccaggggtcgctggctgagcacagcgatgccggcccacgttccgcacagctgccaagcccagagtccacagagccagcaacgcagggagggcagcacagcctttccccgggtgccccgccgccaggccaggtatgctcctggcgcggccccgtgagcctgtacgctctgtctgtgaaacgagggttccctgcattggactaaagcgttcagagcatgcctgcctgggtctctcaggtgttaaaagttcacgtagttttaaactgtgagctgtgaggaggagagatgtttctcagtagctccttaacttttaaactaattccctggtgtcaacatgcgattcccacgttgtcttaaactccacgtgaacagagtggcagtattttttcatcggtggcacctccgagcacatctgctaggctcacttcccacacagggccggaccccaggccctggacccacaggcccagccagccacctcctcacgggcctgacctgccagcagcggtgtggctgggaacctcacctctgccaccctcaggtcagcgtcatccccaggacccagggtgtgctgtgcctgcctgagcttcagtgctgggtggagggtgaggggtctcctgagcctccgtgtcgggtggagggtgaggggtctcctgagagcccagctggggtctgctcacgccacaggcatttttgtccctgcagcccaggggagggcaccctcttgtcaggtgcctgagtccctgcggctggtcttggggatgagcctggagacagccagaagccgggaggacaggagttggccttgaaaatgggagtctcccgcttaccgcacggaagagctgctgtgaggtggaggcgggactcgagcgtgctcaggaacgggacgggagccgccctcattctccagcgtcctccgtgccaggcttcgtgcaaatctgatttgtgcaatgactccccctcagcttccaccccgttggccttttcagtgaagcccacactccccgatacccagggacacagaagccttaggacaccctccctgaatcccccagctgtgcccagcccagtgactgctgcgggatgacagcacagtccagccttgcgggccaggggaagggagggggccccacggccaccgtgaccacatgcaaggttaggggtcagatgtgctttcctggggaaatgacttcctttcctggatccaatctaaaggcccgaattttgaaaagaaagcggcaggcgggctctgaagtgattccgactcccgtgcttaagccgcgtgaggctctcccaggcctgctggggccccgcccaccgctgggctgtccacagccaccctcctgccagcttcacgatgtccccatgactgtgcagcccctacataacgtcaccccaacaaaaacacgctgcttgaccggttccacctgcttccgagccttccagcccagcctctctccagccaacaggacggaggaagcccagggccccgaccttcctgtggctcctgactaggggcacagtcactgctggggacactggtggggaagggaaccagccacaaaagggatgtggcctcccaaggcagtatttatacgttcctggcctcaagcgggccagatgcttctcagaagcttagttctgacacagaatggggcggggggttcctgacccatttttgcaactcttctttacgtttgaaattctgtcaaagcaaaatcagctcagaattaaaggttacgcggacactcacaaacaggctgcatgacacggcgtgggggcactggctctcccacaactgcatgtgccactgcaggaacaggacgacgccccgtgggccacggggtcctggctgggcagccttcctggcatagtcagtgcttagagagctcgccggccttgtctttttgtttttgttttgcaggaaactggagttttattattactcaaatcagtccccctaagccttcctgttttttaaattgagatgtaatttacatgccataaaattccctctaaaagtgtacagttcggcctgataggcgcagtacctcatgcctgtaatcccagcactttgggaggccgaggctgaggcaggcggatcatgaagtcaggagttcgagagcagcctgaccaacatggtgaaacccagtctctactaaaaatacaaaaattagctgggcgtggtagcgcacgccttgtaatcccagctactcagaaggctgaggcaggagaatcacttgaacccgggaggcagaggttgcagtgagccgagatcgcaccactgcactccagcctgggcgacagagtgagtctcttgtctctcaaaaattaaaataaaataaataaattcagtggcttttaatagaagcacaaagttctgtgcccgtcaccactatccaattccagaacagttccctcaccccaaaaggaaaccctacccatgagcagtcagcccccacccccagcagcctgcctcccctttccctacctgtgactcttcctgtcctgggagctccatgcaagtgcagccggacagcacgtggtctcgtgacaggcttcctgcattggcattgtgttttcgaggttcatccgtgctggagcaggtgtcagaactgccttcccttttaagattcgatcatcccactgtaaggatgggccgcacttcattcgtccactcctcagttgatggcctttgggccgtctccccccgggctgtcatgaaacgtgctacggtggacgtgctttctcttgggtatctacctaggagtggggctgctgagtcatgtgatttgtttaactttttaaggaagtaccgattgttttccgagctgcaccattttacattcctagcggcagtgcacaggggtcaggggtctgcctcctacacatcctcaccaacacgtgtcttttcaagctggctttttgaatttcaccatggagcccagattgcaggagctttgaagagaggaaacgcttgctcagtgggggccttgagggtggccatgtgtcggggctcaggggccatttccagaaggcgttgccctgatgctgccacttgctccctgccctgcagtggggaacggaggttcacagggggaaggaggggcagggtggagcaggagaggcctcccatctgtggccattccagcccagggcccaggacaggggaagtccttgcctgggtgtcagaagtggagacccagcccatattcctcctgaggggtcacctggccccggaggtggctgccagtgggagggtgagaaaaagcaccagcctcctccctccccaggcgaggggcaaagaacctgtgaggggcagagagttagaaatggcgggagacatctgcacttgatttgtgtggcagtcacaggcccgtctggagtcccctgggcacatcaggcactcttgcttcccaggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggtgagtgtgggagaagccccatgacacccccaaggcaagctattcaggaccattggggcaggtgtagccaccacggcaatggggtctcacagcagggcagggagagttggggctcagctctgaacacagcatgggtcatgggggtttacgcccgaggagcaggtggggtcagaggatggagagtgactgagaggaactggcaggggagggaattctggctaaagcatcctgccaggacccttgctgaaggtgtgccttggggatcagacggcctctggggactgtggaggatggaccagtcagctactgagggcgactggatacggagagcaggggtcctgctacaatctcagcagggattgccaaaactggatttcatgaggacgtgcacagatgggcctaggaggaggctcaggagcctgacggcagtttggccaaacagaatcctggccaggagtggctgtgggccaggcaggcagggcggcaggctgcgacacccagttacatctgaatctcaggcagctttgaagcgtgttctagaatgaggatgcccatattcagatcaactttcttcatgatctgaaactcagatgtaactgggcgcctgtacaccatctgtcaaccttgcccatgaagacggagtggggaagagaagccccaggcgggtggcaaggacctcctctgggctgtgggcccctgaccagctgccccaggagaccaccgccctgagaaggatgcgacctgctctccaggctgctgccctggtgagatagctgtgttggtttccccttgcctctgaggggaagacggccctcactaggggcacaggggctccacctggccaaggcctgctgggcacccagctcagacaggtgacctcagatccttgaccactgcctggctgctggcttccctgcagacactggctgggcttggaggagggacctatggcagggccttgcagagagcaggggccactcaccgggggccagtggagtccgtcctgtagccaagaagcaggcaagagaggctgggacccatccctgcagctggggcagcagtgctgtgagctgtcagtgcttagtttatagacatcatcctgggagggagaagtgatgaagtagaaaagacgcagaagaaaagatgggacgtttgggagtaaacccctgaccaaaggcaagtaaggaaattccaccctgtgcagggggagcggctgccatgtccagcccaccctagacatggctgtggcctggcagagcagctcctgggtgggccttcccccacttctcttttttttttttaagacagtctcgctctgtcgcccaggctggagtacagtggtgcaatctcagctcactgcaagctccacctcccgggttcacgccattctcttgccttagcctccagagtaggtgggactacaggcgcccaccaacacgcccagctaattctttgtatctttaatagagacggggtttcaccatgttagccaggatggtctcgatctcctgacctggtgatccgcccacctcggcctcccaaagtgctgggattacaggcgtgagccaccgtgcccgccagccttcccccacttctaagaggtcttataaaaactttcaagtaaagcataaggcatataaacttttaatttaaaaaaatgtacaataaaatacgttatcgcacacaacgtgaggaagttacacatgggaagggagccgtgggcccagctcatgccccaggtctcctgggagagaccacgccgcaccagggcaccagcttaggcccagccccagccccaaggtcacgccagccgtgtggttattagtatcatgtcctatgcacacagacgcaggagaaatgagtgagcgctgcggctcccggccaggggccctccctgccgccctggctgtcccgggccagctccgggccacactcggcagtcccatcctggagcggggccaggtcggggtcactgcaagagaagatagaaggtcagggctgggccgccaaaacctgacagtgttactaagttctgttctggaaacagctctctggggaacccccaccccaagtctgcctagagaagagggtgttgctggttgtgagcctccctggggccgaggggtcatgggggactggtgcgtctttggtctctgctccctggagcaccaaaggcctgcgtctggcacgggggaagccaggggtgtggacacagagccttctcttgcataagcagagcctggtgccattcccacccccccactctgtggcccttgggcttgcatgaggatggggaccctgagccaagcccctcttggaggcccagcctggcagctagcagcagtcaccacttgcccatccccagctccccccagtccctgcatgtgcaaagtccctccctggcccagctgcctgcttcctggggctgcaggccatgggactcacgttagcggtggcgtcttccaggccactgctgctgctgtcgttttccacaaaaagaggctcggccagagacgccctggagatgaagcacagacgagtttcactcagggcgtgcaggcggccctcaggcgtcttcagagctccgggcgtgacaccagcgtgtggctgcagaccttggacttgagggacagcctaggggccccttagcagcctccatctggccagagctgctggcaaggcccgtggggcctgaactacactgcttggtgccaggagcagctgtgtcaccctcccccatcaccatggctcaccaagctgtgcggtcagaggccaggccagccatgccaatggctctggcacccacaggccacggcagcacccagagggaggccgaggacacctgccttcactgggggggtcctcccctggaagctctcctgggagctggtgggcacagggctgtttccaccccttggccaggccaggccagctcagagcacagggctaaggcctggatgcacgggaggcactggccttgagggtgtctcaacctacagccccatcctgacccccaggtggtctcccagagtgccccacgccttggcagaggcaggccaggcctgactcgcctgagtaacgcctgaagggcatcaggcccctgccttgctgagcgtctgaagaggtcatggccaccacgggctggctttggtggcactgtggccaggtttgggtggtctgagtacctggtgcggggccactgaaggagggggctggttgctgctgacctgtgagggggagagggtgaaaccatggcagaaggagagcagacccccgcaaggactcaggagcctgcgcaaaggacacctctacagaggacggtgttggcacagccaaggggtgactgcctgggggggccagaggaaggacatggggccaagggaaccagttgtgtgagcctgaagcttctatagttggggcctctttgagaaaaatacagaattgggctcagagtatggggactacagagtatgggcactgtgagccccaggtgggtaggaaggttttcagacggtcgagtgacagtccaaacggggtctggtcacctggggcggggacttgctgaccagcatagacaatgacagctgtccccacaggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgagcaccaaggcagggttgcacccctgagctcgtatttttagccaggatgcggaagcagagccggtctggaggtggggcgggtggcagtgaggtggcctccggctcctgcgggtagcagcctgtgcctaaccatcgagaagaccctcagccgttgcagctgacctggactgtgctcttccaggtgacagaggccatggaggagcagggcgcagcacacgggccgctggggtgagtgcagccatgtggtgtgtgcacctctgtgcaggtgccaggggcacagctgggccgaagtgggcggggccaccaagcctgagcgccagcttgcctgcttcctgtttctcaggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgcagttccaggacctgcttcttgctgtctgccaggcactgctctgagtaatttatgcacattgaagtatgttctcctcacaactcctagggataggtactgttacatctccacttgcaggtagggaaattcaggcccagaaccgttaagtagcttgactcctcccacaacccagaggcagaaattgtcaccccccaccttatgtgcccagggtgagcctgtgggtgctcctacagtgggaggaaggggggctggcactggttgggggaaaggtaagggctggggccatactgtgcagaatttttctgtttgccgttttccagggtgggacaatccgtttaaaccttcatcatgttatcaaggctctctatgaccctaaagttaagaatcactggcatgaacatgggaaaaagttattttggggttggatttttacaaaacagcctttctgcaaaagtgcaggaattctacaatggcaagtaagacattttatttctgtaattgaacataagcaattccaaatgcttttctaggcaagacatgccagcgattagaaaatgagacagcttaaagacagaggtacatttaacagagaaaacacgcctggaagctcggccggccccgcccatgctggctcagttcctgcccctggagggaaggggccgaggggcttcccgtcccagggaactcccaccacaggagtctgcagacgggctggcctggcagtcagtcccaggaacactgaccatccccttagggaggcaccacgccctggggagcacagttccaggccagggccatgggtcttgccctgaagaccctccctcagggaccacgcgccctgaccctcattgcctcaccatattataaaacactaaaaccgcttaagttcttccccacagagttggggaactaattgtaaacagaatacacgtctacatatcagccctgagacagctggccccgctgcacacgcagcctgctggccccagcaagacacggtcagagctggtaagtgctctacagcattcagaaatctgaccacagcgtacacacagctcacaagtcagtgcaaacagaagctaatgacatcctccaagaaaattccatacagttatgacaatggaaaacctgttatacattgtaaccatacatcattagcaatgtttaatacatcttactataaacactgaatttctaagtacatgatactcctagcagcttaatccagaaaataacgatgtgaatccctccaatactgtaaacacaagaccaagtgctgcccatgagagtgccccgtgccacccgcgggcaccaccggcctctgaggacccctgagccacacactgctgctgcttcagggaagcatccatgtcacaggacttccccaggggcctgatttctgccacagctgcaccaactacccagagatatgctgtccgcccacagatccagacgctcccatgccatggttgctggggacgggcgctgcacacacggctgctgtgggggggggcggggcgcagtgattattttgacagcaactctgaagaaacaggtgctgactctcgcgcggggttcctctcaccagaacgaccacacacaggaggagggatgcctgggcccaccacttctctcctctgaagggaaaaattcagaccgccagatgggaaatggctgaaatcactgcacttctattgggtggaagggttcaaacatcggggactcaggtactcagattcccttgccgcctccctctgaaacacgaaccttcctttatgagctggcttcagggaggccccctggcttctcttaccccaacacacagtgctcccacagccacagtgctgcagaggccacctcggccctaaagtcccatggctggaagccacagcaggctccacagaggccccacacaacctcgtctgcacccatcagtctgaagaggttaaaattcaactccatattcagccctatgtttattccttctaaatgccctttttc

SEQ ID NO: 14108 - DNA, 32327 bp, Human
  misc_feature (1)...(32327): n = A,T,C or G
aaagtattttgttaaatttgtatgtgtcattaagataggacctttatgattttgatgttaaacaaatgtaagataaacagcttacaaaaactgtggccatcttggattgtgctgtgagacttccaagcagagacaaaaagactttcacctgcctccagctggacttcagaacttcgtttccttagggttcttgacagtgtttgtatgaaacaaaccctgttctgtgctgtgtacgatgagtaagcttcccaagttaaaattattgctccacaccacagatttcagattccaagtggaacagaagtccaaagttgctgtttataaacttctaagggtcgattgtacctttcaatggtgtccaccctgtgttgacatacagcaaaaccgaagggctcttgaaacttctaaccactttctgaattacagcgaagaatattctttgcatggtatcaaagttctacaatgtctcagtaattttacatattgaaaaaagtcattgatttccatattcagtcctctgcgctgtcttctcatttcaagtagtctcatgttccatgtattattacgttatttgaggaattaaaaaaaaaaaaaaaagaactggggaatctccaagagctggcgggaatattggctttgagaaaggaaccttagaattcaaacgtaatgttttacctaaaaaggagtccagtttccaacacttgggctgggaacgacaggctatggttgcccaggatctgaagtacagaggaaattgcttgtccttctggtgggagagtttgtctctagaggatcaggaggatcaggagggtcaggagaagggcagggtgtggccgggaggaaggggcatggttagagatttcttttcttgatcattttcatcccagttcagcactgagttcagatttcccttccttccttccttccttccatctgtccttccttcctcctttcctccctctctccctccctcctccccctgtccctctccttcctccttcctccctctccctctctgtctctcccccctaccttccttccttccttcctccctcgctccctccctccttttttcttttcttttctttctctctgtctctctccctttctctttctctctccttctctctctctccctcctttcccttcccttcccttccctttcccttcccttcccttcctttccctttccctttccctttcctgacagagtcttgctcttgtcacccaggctggagtgcaatggcgcgatctcagctcactgcaacctccacctcccaggttcaagcgattctccctcctcagcctcccgagtagctgggattacctgccatcatgcctggctaatttttgtattgttgtaaagacaaggtttcaccgtgttggccaggctggtctcttaactcctgacctcacgtgatctgcccacctcggcctcccaaagtgctgggattataggcgtgagacaccactgccgatcctctctctttctttctctctctctttctctttctttgttttctctctctctcttctttccctcccctccccttcccttcccttctctgctgtgtttccattctagaagttctttccttcatcccctcgttgctcctgcagagcatttactctgacagtgccccccacccaaggctcgtggctgcctggctgttggatgacagtaatgcatgcactgcacgtctcccccagaggagtaatgccggggaccatttgtagatggatgggaaactgaagcaaagcgtgcttcaatttagattccccaaactgccagagccccaataaaactagacaactgttgttacctttaacagagggtttgcttctattttcatgtgtaacacacaagcccatggccttgactgggcttggaggaggattgttagtgtttaggtattgtagtctctgaggcagatgcacgtgcgtctgctcaagtttaacatcagcagccgctctctcatattctgtgtctgtctttgctgtcgtagaatcccagtgttccaatgcagaagttgcaggatatccagagagcaatggagctgctatccgcatgccagggcccagccaggaacattgatgaggctgcaaagcacagataccagttttgggacacacaaccggtaccaaaactaggtaagtttttctgcttttctctttttttccccacaaacaaagctggatgaacaacaacaacaacaacaacaacaacaacaaaacacaaagagtgttaacttcacatgtatcatttatttcataccacagattggaaatctatgcaagactaatatttttcttctgaaaatataaatattagatagtgacattggcttttgataaccattattttagtccaatttctatcccaataaaaacatccaatttccccacacttgaaacattactagtattattattatttttgagatagggtctcactctatcacccaggctggagtgcagtggcatgatcatagctcactgcagcctccacctcctgggctcaagtgatccatcctcccatgtcagcctcccatgtatctgggaccacaagtgcacaccaccacacctggctaatttttgtatttttttgtaaagacgctgtttcagtatgttgcttgggctggtctcgaactcctgggctcaagtgatccacctgccttggcctcccaaagtgctgggttacaggtgtgagccaccgcacctagcccattagagtattaaaaatgtatataaggttctgtgatggaaggaccaggccctgaaggtccctcatggagcaggtgtctgttgagtgtctgttattaaatgccaggcatagtccagggcacacacctggaaacagtggtggaaaagtaggacaaaaggtggccaggctggggaggagcggccacactgaggtagagaaaggctttagttaagcaacagatgctgggagaaagtgacgtgtgatgcgtaagcttctgtcgggaattccaaggggcccgtcccttgaggaccagagggcctcaagcctaaggaaggcaccaggaaggccctgagctgaggcctgccccggtcatcatggccagagcactgggagcagggggcagggagggtgtggagaggggccgaggcaggcagcagccatggggaagagcctgggttttagtcctaccatgttgggaagctctgcagagaaggacttggaaaactcttcttggtggaaatcactagaaattgtgatggcctgaactacgctgctagcagtttagatggggagaagtaaccagccttgaaattatttttaggttttgctgggaggggcagaggtcaccgcagccctttcctctcccagtttgtggaaatgcagtaaaaagaacacacctcccaaggctgttgaatgaaacctacattgcttatgacagtgtgtaagataaggctgcattgtaggccttgagactcggaatcactgttgttttgtaatgtcatctttgtcactggatgacaaaggatttctcctttcatttaattggcaaaataggccagctgtggtggctcacacctacaatcccagcactttgggaggctgaggtgggaggatcacttgaacccaggagtttgagatcagcttgggcaacataatgagactccgtctctacaaaaaaaatttacaattagccgggcactgtgttgtacaactctagtcccagctacctgggaggctgaggagagaggatcgcttgagcccaggagttgaaggcttcagtgagccatgattgcaccactgcactccagccttggcgacagagtgagaccccgtctcaaaagaaaaaagaaaagaaaaataattggtgaaacagcaatgatttcacaccactgcctagctttcctgtttcagtccagaggcgcttgatataacagcatctttttaaagattatctgaaacccgagggccctaagtcagattttgcttatgtcactgaccactttggatggttagaatactttgtcatttaatattctcgctttttgcctttcttttttctctttctctccctgttcagatgaagtcataacatctcatggtgcaattgaaccagataaagacaacgtacgccaagaaccgtattctttgccacagggttttatgtgggacactttagacttgagtgatgccgaagtggtgagtgagtaaaaacctcttaaattcaactcctgcattcacacattgcttctaagttgattctgagcaccatggataggacacttgttttatcttatagctcaaggagttatacacgttgttaaatgagaattacgtagaagatgatgacaatatgttccgatttgactattcacccgagttcctgttgtggtaagtctcatcgatcacagatgtcgtggataggcgctgctgacttggggactcctgcgtctgttcctgtgttcttggacaataactggtgcctgttttcttgtctaccgtgacctcagggctctgcgtccaccaggctggctcctgcagtggcactgtggggtcagagtgtcttcaaataaaaaactggtcgggttcataagtgccatcccagcaaacattcggatttatgacaggtacatgtttaagctcgtccatgcggtttttatatgtttattttctaagaattacaattagattaggcctttaaaagttactgaatgcaggccaagcgcagtggctcacacctctaatcccagcactttgggaggctgaggcagatagatcacctgagctcaggagtttaagaccagcctggtcaacatgggtgaaaccccatctctactaaaaatacaaaattagttgggcgtggtggtaggcacctgtaatcccacctactcaggaggctgaggcaggagaattgcttgaacccaggaggcggaggttgcagtgagccgagattgcgccactgcactccatcctgggcaacatgagcgaaactccatctcaaaaaaaataaaaataaaaataaaaatgactgaatgcaagctgtccggtgatcagggaggttgtgtatgtgtggaggcagaggctttatggaaactctctgattggttttgctgtgaacctaaaactgttttaaaatataaatttattaagtagtaaagaaaaaaaaacggactgtgaataaaaataaaggacaatggtttctttttctctttttctctctctgcctctcaatctcatacatgctcacacatatatgtatcagaaaaaacgaagccttggccaggcacagtggctcacacctgtaattccaggactttggtcggggccgaggctggcagatcacttgaggtcaggagttcgagaccagcctggccaacatggcgaaaccccatctctactaaaaatacaaaaattagccagcatagtggcacgtgcctgtaatcctagctatttgggaggctgaggcacgagaatcacttgaacccaggaggaagagattgcagtgagccaagattataccactgcactccagcatgggtgacagagcaagacttcatctcaaaaaaaaaaaattacttaaaaattttttaggagagataaagctttctctccataggatacattgcacttttagtttggatctccagcccggaaagtcaaagatccagctatgaaagtcaaagatgtcatatataattggtctctttacttgtcagtgtattaggttagcttatttactgtgaaaagcatttgatctcaaggaatattttgtgccaaatgaagtgtgtacctggaaacagaaccaggaacaggatttgaagatctaggaggtttactgtagttcagagcgcaccagctctggtctgctcaaagcccctctcaggggtcccaggggtttgtatcacactccaaagcaacatcttatcagattctgcaccaggatgactcagttattaccataatttaggaaaaacagatctagaaacttaaagacgggcaggtcgtagtgattcatgcttgtaatcctagcactgggaggctgagatgggaggattgcttgaggccaggaggtcgagaccagcctggtcaacatagcgagacctcatctcaaaaaaggaaaaaaaaaaaaaaggaaagaaacgtaaagagccatagctgatccattttctaaactgaaaacgtataatggaccaaagtcccaaaatgtatttagaacaagagggttggagcctccgtgcgttttacaatcattttggcagggagatatggggaatagtgtttccgtctgaatttgtgaaatgtctaagtgatagaatatttttgttaaatattgtgttaaagaatggctttcaggccaggtgcggtgggtggttcacgcctataatcccagcactttgggagatcgaggcaggtagatcatgaggtcaggaatgcgagaccagcgtagccaacatggtgaaaccctgtctttactaaaaatacaaaaatgagctgggcatggtggcgtgcacctgtaattccagctacttaggaggctgacgcaggagaatcgtttgaacccaggagtaagaggttacagtgagccaagattgcgccattgcactccagcctgggtgacagtgcgacaatctgtctcaaaaaaaaaaaaaaaaaaaaagaaagaaagaagaaaatagaatggcctttatgttcttttttttctttttctttcttttcttttttttttttttttttttttttgagacagggccttgctctgttgtccaggctggagggcagtgatgcaatcatggctcactgcaccctctgcctctcaggctcaagtgatccttccacctcagcctcccaagtagctgggaccacatgcatgcggcaacatgactggctggtgtttgttttttgtagagatgagagtctcagtgttgcccaggctggtctggaactcctggtctcaagcaatccacctgccttggcctcccaaagtgctgagattacaggcgacagccagtgttcccagcctgcattcttattcttggatatttcctgggtatcatcttattttttaaaatgtgttgactcttcattttgaatctcgttttgactcttaatcttcaccatctttatttcttagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcaggtaccagtaccatatttctacctcaggtcctccctttatcaaaaatgttgagcctcaccactgttctgctagatgtagtttttgctggtagcagagatggagactagaacctagaatcaccaagtccagtattctttctggtatatcatttgccacttggtgattaaaaaaaagtttttgacattttcctactaatgatgctggatctatacttttttttttttttttttttttgaggcagactcttactctgttgcccaggctggaatgcagtggcgtgatattggctcaccgcaaactcgcctcctgggttcaagtgattctcctgcctcagcttcccgagtagctgggattacaggcatgtgccaccacacacagctaatttttgtatttttagtagagacagggtttcaccatgttggtcaggctggtcttgaactcctgacctcgtgtggatctatacttctaagtctattccatgtgaaagatgaatgctgtctctacatgggaaaacctaggacatgatgatcttaaaattccaatgtcataccattttctttccaccccaaagatcagttttctgccatgctttgcagcaccaccaaagtgtcctgaaagtctaataagcatccattcaaaagcctcagatgtatttgtttgttcagagtaggaagacctaagctatgtttttacaacttcgtctgcactagtcaagctttcacaggttattccagtgagaaaatgatcagattcccacaagactaacctgtttctaaaacatcagagtttatctccccacccctcaccactgtttttattgactcaaataggatgaaacttaaaattactatatcctgttaaattattacattcgttaagtaaatggaatactagacttcaggggtatattttaatataaatcacttatcccagagcctggaatcactgaagaaatttaagctagttttcaaaaagttgttttctttggtgtgtaggctgtaaaagtgaaggtgactaatttaggggatttattttcatgtttttaaactttctgattggccttttgtagaatcagtgatggtccttacacacttggaaacctgggtatgattaatatttcttttttgtgtgtgtgtgagacggtcttgctctgttgcccatgctggagtgcagtggcatgatctcggcttactgctgcaacctctgcctcccaggttcaagtgattctcctgcctcagcctcccgagtagctgggattacaggtgcacaccaccgtgcctggctaatttttgtatttttagtagagatggggtttcaccatgttggccaggctggtcttgaactcctggcctcaagtgatctgcccacctcagcctcccaaagtgctgggattacaggcatgagccaccgtgcccagccaactaatatttcctttgcagttttaagattccactttagtgaaaaagatgaaaggtcacaaactcctgaggaacataactggagtataagatgtattttagagattaaaactggacggataaaatgatgacataggatgagggcctctgtctagtacaacgtaagtattcagtaaatgcttatgtaacagccaagctgagacaaagagtgaaaacttgtagagttagaaatcaatttgattttaaaacctttattgtattccagatactggcatcgatcactaaaccccagaaaattggtagaagtgaaattttctcacttgagtagaaatatgactttacagagaacaatgaagctatacagacttccagatgtaagtaagaatgatttgcagttttttgaagctgtaacaactgacgcttttaatgcagaaaagaattatttgcaggagtctaaaaactgactggtgtgtctgaggaagtgaatatggagcgaaagagatttcatggaactcgggagctagggaaggtagggagtttgtttggaaatgccaatctttccttttttcccaaggctcttaaagttgtttcattggtagttggataagactgaactcaaggcaagtaagttttgaaatttgggaaatttatggtctgttaagtaagaaggaagaaaagtccaggctgctgatctcttaatgcgttggaactcaggaatcaagtgtagaggagagacccagcgagtggaaataatgtctcattaaattatcatcttcttaaactatctcgttctcaatgtgaaaagttgtcattttttttttttttggagacagtcttgctctgttgccccttcagcgcaatggcacaatctcagctcactgcaacctctgcctcccgggttcaagcgattctcccacctcagcctcccaagtagctgggactacaggcacccgccaccacacccggctaatttttgcatttttaatagagatggggtttcaccatgttggccaggctggcctcagactcctgacctcaagtgaaccgcctgcttcagcctcccaaggtgctgggattacaggcatgagccactgcacccagcgaaaagttatttatttattttattttatttatttatttattttttatttgagatggaatctcgctgtgtcacccaggctggagtgcagtggcgggatctcggctcactgcaagctccacctcctgggttcacgccattctcctgcctcagcctcctgagtagctgggactataggcgcccgccagcatgcccggctaattttttgtatttttagtagagacggggtttcaccatgttagccaggatagtcttgatctcctgaccttgtgatccgcctgcctcggcctcccataatgctgggattacaggagtgagccaccacgcctggcgaaaagttattttttttatttttttattttttgagacagagtctcgctctgttacccaggctggagtgcagtggctggatgttggctcactgcaacctccgcctcccgggttcaaacagttctcctgcctcagcctcccaaatagctggaattacaggtgtgtgccaccacacccaactgatttttgtatttttagtagagatggcgggggtttcaccatgttggccaggctggtcttgaactcctgaccttgtgatccgcctgccttggcctcccaaagtcctgggattacaggtgtgagccaccacgcccagccaagttatcatttttaatagggaaaaatataaatgtgctttctagacttggctttatttggggcttggctatattagttatctatggccatgtaaaaaatgaccacaaactgagctgcttaaaacaacatttattatcacacagcttctgtgggccagaaatccagtcacagcttagctgagtcctgtgctttgttcagggtctctcctgaagttgccacccaggtgtcagccagggctgaggtctcatctgaaacttgactagggaaggatccatttccatgctcctgtagttgttggcaggattgagttcctcactggctgttggaccaagggcctcagttctttgccatgttggattctccatagggtagctcacagcatggcagcttattcatcaaagccagtgagagagagagtctatagagaggatctgctggcaagatggaagtcagaaccctatgcaggtgattcatgaaagtgacatccagtcgccattgccatttctttttttttttttttttaagatggaggctcgctctcttgtgccaggctggagtgcaatggcacaatctcagctcattgcaatctccgcctcctgagttcaagcaattctcctgcctcagcctcctgagtagctgggattacaggcgcctgccacaacgcccagctaattttttgtatttttggtagagacggggtttcaccatgttggccaggctggtctcgaactcctgacctcaggtgatctgcccaccttggcctcccaaagtgctgggattacaggcatgagccacctgtgtggtggtgactgaaacttggctgaaagcccaggttttctttttttttttttaattttatttatttatttatttatttatttattttacttttgagacagagtttcactcttgttgcccaggctagagtgcaatggcgcgatcttggctcaccgcaacctccacctcctgggttcaagcgattctcctgcctcagccctcctgagtagctgggattacaagcatgtgccaccatgctcggctaattttgtatttttagtagagacagggtttctccatgttggtcaggactggtctcgaactcccgacnnnnnnnnnnnnnnnnnnnntaactaaataaataactaaatacatacgtacatacatacatacatacatacaaacttcaaaaatgcctctttttttcactatgggcaaatgctgttccactttggtctctccaaatttcagtttcttgaacctcaagcagcctagcttatgtacaaggaaaagacacacttacatgtaggttgcctacaatggagtgaagaataaggagttttagcacataccattggtttactcacaatgattttcttaaagtgctaaagctatttttgacttgactccattcatcagccttaatatttttgtacaagagtcaatcttctcctgggtataggcgtgtattatgaaaccagactgtggcatcttacttccagtgaacctgggttcctggtagcagtcctgttccagtcgtgctgtgatagtgactgcctttcccccacccataaattgaaggttatgaagtgctttcaaatacattattcaatttattctcacagcaaccttttgaagttagtacttcttatccccattttacagatgaagaaactgaggtatgtgacagttggcacttaggcgaggatgtgttaatatcaccaagtggagggcttgggatgcaggccccagacctccatgtttccctgttagctccctctgcctctgccatcccctctaacattacccactatggggacaccatggctcagccccactgaatgtctcactgtgagtacagcataaatcaaggcagaaaaggacgattgtcaagatgcaaacagttctcattggcttgccccagtctcctttcccccttttaagtcataggaaaggaaaggaaaataaagagtaaattaatagaataaaagagagattaaagtacagatattatgaaattggaaggtgctggcagcagtcccttgggtgtctgcctcttgagttaaactggacagaactgcatacaccggatgccccttcctctcctatgggcccagatgggtgataccactgctagcagtcaagttatttaagaacatttttgtaccattcagcgtaaaagcaaacttatggaatacagcttttgctgtatagatcaatctcattttctgcttcattgttactctttttgcttgtaggagtgccagctttctgtctttttcatggacttttgaatataggagctaacatttattgtggccggcgttatgctcgacatttaacagccgtagtctcatttactaatcacaacagccacaggaggatgggtccttatccccatagcacagaaggggccatgagaacacagattgacttgctcagagtctgctggccagaagcagagctgtcgcagggcctgcgccattcacaactgttacctaaaatactaaggtttccccaagaaacacgccttacgatgcctccctaccctttcagtgtttggggagattttattttgttttgtttttttgatctggtgttgagtatttccaagttcgattttgcgcatctgtgtcaatgagctgaaaggtaatttgatgttgataaaaagcagaagtcagagaatgatccactaaggtcttagcactgtgctgcaaggagggtgtgcttgcttagacatgtcgaggcatataaggtgttctatatttagtggcattagatggtttttttagtggttagcattctgtttgctcctttttgaatcatataaataaccataatcattgcttacatctcttctctggaatcttggctctcaaacggtttgtaccacaacttgacagataacaacactactgttttttaatagagctctgagcttcatttccttatgtacttataagcagattttacacagatttcaatctacgtagaggcccatgaatcatgcatattagttgggccatgggaaaggatatctgattcagatacagagtttgcttatgaaactgagatttttcttatttactggaaatgattctctgcattttattgaactctcagaaaacatgaccgcttcactattccattatacggaagctagccattttaatgtaagcccaatagccttcctggttctttctgaggacaatagttataatttgagtgtttgttttgcttttcaaaagttatttcctttttttttttttttttttttttctgtgagacgaagtctcgctttgtcgccaggctggagtgcagtgatgcgatcttggctcactgcaacccccgcctcctggatgcaagcaattctcctgcctcagcctcctgagtagctgggactacagccacgtgccaccacacccagctaatttttgtattttagtccatgttggccaggatggtctcgatctcttgaccttgtgatccgcctgcctcagcctcccaaagtgctgagattacaggtgtgagccaccgtgcctggcagtatttcattcttacacagattattttagctattagtcagcaaatgtaaatattcttaccctgttttctaggactttctgttttttatagctggtacatcctggtgtgctcttatgctttaatgcttctataaaaatttgttcaaaatgcttataagttgccaaacttatgatactttttacctgaatttaggcaacatattgcttgtctaaattctgctacttatttttctaacctttagagacctaagatagcagttctcaaagtgtggcccagggacctctggaagtcccccaagatctttgaatctatgcagtcattttttttttttaactattttcataataacactagtatgtaattttttcactttcattctcgtctgagtatactgtgaagtcttccagaggccatgtggcatgtgtatttctgtagtcttttgtttaaaaatgttctcagttttgatttctaatgcgataagtgtggatatgcataacccacataagcaaagctctttggaggtactcaatcattattaacagcgtaggccaggtgcagtggcccatgcctgtaatcccagcactttgggagaccgaggtgggcagatcacaaggtcaggagatcgagaccatcctggctagtacgataaaactgcatctctactaaaaatacaaaaaattagctgggcgtggtggcacgtgcttgtaatcctagctacttgggaagctgaggcaggatcaaatcacttgaacccgggaagcagaggttgcagtgagctgagatcacaccactgcactccagcctgggcgacagagtaagactccatctcaaaaaaaaaaaagagtgtaaaagggtcccaagaccaaaatatttgagaactgctgctttaaggcgatctgctgggcagttcctttagtggtttcacagttggatattcaatgaatgagaattgtgctccagaagaatgttttgctctagaaggaagttggcaaatttttttttcatttctgaatgttctctattaacagatatcatatatcctgtggctttcattaattcatctaattgcttgatattgttgattgttactgaaccagtaacaaaagaaaaaaaattctgatattgagaaaggctatttgaaatttatcaagctaagtctgcctcatagcagaaactaattttttaaatgactatgatatatattttatatggttttggtcttcccactagcatttagaagtgcttatttatttccagtggagatctggacatttctgactcattggttttgagaggtactaaaagactaaaggtatgcattgcctgttaaatgtgaaggacttaaattctctaaatttagattattaaatggcattttagctgaagtgctttagacatgacatcatcataatagaatggcttatagtaaatattcagctgaggactgttggtgtataaatacagagcatgcacctcccattcccctttcccccagctaatcgataatcaatcagcactgtgtgtcactgaagcttagaaaccccagcacagctaatagttgatgacagctggcactcaagagaaaacctattttccttggcctagtgtggtggctcacacctgtaatcccagcactttgggaggccgaggtgggcagatcacctgaggtcaggcattcgagaccagcctggccaacgtggtgaaaccctgtctctactaaaaacacaaaattagccgggcgtggtggcaggtgcctgtaatcccagttactcgggagcctgaggcaagagaatcgattgaacccaggaggcagacgttgcagtgaaccgagatcgcaccattgcactccagcctgggtgacaagagtgagactccgtctcaaaaaaaacacctgttttcccccttgggcttccacctgggggcatgcaggaattgtgatgacctcattctacaggaagtttttcctttaacaatatttcttaagagtggaactgctagattatataaaatttttaaaaataatcatttagggcagaaaaagtagagtagcaatatttatatacagattattcatctcttaaaatgtatctagtgtttctccaagggggggaaaaatcaggtttacagaaaaaaataaactgtatttctcagtttaaaattgtctgtttgttgggcttcctgacttttagtctcaagtcccctggcccctgaacagttctagagagcaaagtgatgtcaggagcttttacaaggacaacagctgaacaaattcaaatggggacctgtcctgacttttaggtgttttattcctatggcttaattttttaaattctaaagctctggagtagtgataagacacctaccctgatcacctttacccagaagatgtggcaggagaggccaggccgcgtccctggcagccatttgccgttagacaagatggacactttcaggctggtatggctgtaaacccgtttgcctttagaaaatacttggctatgaacaatgcttgccttcccatccagcctgatatgattcactcctatatcatttttgttcaagagaacaaaatcaccacacgcttttaatgggctattgcataataaaacaagttgctcagttgtattttcaaaatgtcagacttggcagttttaaagcatccctcagaaaccatgaaggattggttctaggacccctcagataccagaatccttgggtgctcaagtcccttatataagatggcgtagcattgtgtatttgcatataatgtatgcacatcctcctgtatactttatttatttatttttgagacgaagtccctccctgtctcccaggcttgagtgcagtggcgtgatcatggttcactgcaaccttcgcctcccagtttcaaacgattctcctgcctcagcctcccgagtagctgggattacaggtgcatgtcaccacgcctggctaagttttacatttttcgtagagacagggtttcatcatgttggccaggctggtctcgaacttctgacctcaaatgatccaccggcatcagcctcccaaagtgctgggattacaggcatgagccaccatgccccctgtcctgtatactttaaatcatctctggattacttataaggtcaaatacaatctaaatgctatgtaagtagttgttacactgcatttttaagaaataatgacaagaaaaaaagtccgtacatgatcagcacagatgcaacgatccagttttttttccccgaatatttttcgtctaaggttggtcgaacccacagatgcacaaccagtggatacggagggctgcctgtactccagaagtcatgctaagttggctatgtcccatcatgtagactgttaacattcttggcattggtatatacattggtgtgttttgggtattggcgtacatcatgaacttgtactgttccctttgatgtttgtttgggtcatgggcagtagtgaccaaagacttgccgcacagataggaagatacaacacattgtctgtctcgcctatattttaacccagctcttctcaaaccttaatgtatgtacaaacccaaggaaatcttgttgagttgcagattcggattcattagatctggggcagggccaggctctgcagctctaactagctcccgcgtgctgctcattctgctggtctgcagaccacactttgagtgcaaagtcgtttcactcctcttctacctgaacttctggatttgttttgtttcccctccaacaaggttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggaggtaaagacaaggtgataaacataaagcttctccttgaagcaccctttgtgttcagcgtgcagcagaattatttacacacacttccttctatttcatcacagaacattacaaagatgtgtactaaagggtagagagttaataagattaataattctgaatactctatcaaggacatgcttaagtgaaactgccatttgttgaaccatgagggtgtggtgttgaggaatatggtaaccatgagtgtggtctggtgccattgtcttgttttgtgctaaggcaccagcagctttacccacagcactgctttgcaccgttgatgctgatggtaacttgtcaacaaggcaaacaacttcttagtgttatgaaaatcattttgacctcacagatttctgaaagggtctcaggtacccacagggttcacagaccacattttgggaactgctttccagggcatatcattagagctgctgagtctgtggttggacccatctttcacatttttagaaattgccaaatagctcaccacaataaggtcctgagcagtgtaagagagttcctgtttccttgcatcctcacaagacgtgggtatggtcagattttaaatttatttaggcccacctgatgagtatggaacagtatcttgttaatttatatcctcattgttgatgaatttgagtatctcatcaatctgttagccatgtttatttcttttataaacttgctatttacatcacttgcctgttttttttttttgaccgtagttgtcttactgatttatgaaaggttttttgtttgtttgttttgagatggaattttgctcttgttgcccaggctggagtgcagtggcacaatctcggctcactgcaaactccacctcccaggttcaagctattctcctgcctccgcctcccgagtagctgggattacaggcgtgcgccaccatgcccggctaatttttgtatttttagtagagtcggggtttcaccatgttggtcaggcttggtcttgaactcctgacctcaggtgattcacctgccttggcctcccaaagtgctggaattataggtgtgagccactgtgcccagcccgtgaaaggttttttatatgctgaatactaacactttgtattgcgttcctttctgggtcctctatattctatttcgttgatctccatgtctgtcttttcactaataccacactgacctcgttgctatagcgatataggaagccttagtatcaggtagagtaattcctcccactttattcttgtttgtcaagatcattttaattaacctatttcctttgccttttgcatatacattttagaataagcttatttttgcctacaaaataccttgctggtagtttgatagggattacattacactgatagattaatttgaggataattgaaaagtcttccagtccatgaacatggaatgtctctacatttatttcggtcttttaaaatctcttttatcagcattctctaagagcatccagatcctgtacatgttttcttaagtgtatagctagatatttcactttctttggggcgattataatggtgttgtgtttttaatttcagtttctgcatgttcattgttagcctgtagaaatgctttcttttgtgtgtttgtatcctaccacagtgctgaaatcacttactggttccaggagtttgtgtgtagattccttgtgatttctacatagacaatgtgtcatctgcaaatagggacagctttattgcttcctttccaatctcgatgcctttatttattggtcttgcattaatgcaggacctagatcttccagtgctttgttgagaaagagtggggaaggttgtcatcctcgtcgtgttcttgatggtgggagaaaagcatttactctttcaccatgaagtatgatgttagctgtaggtttttctgtgggtgctcctaatcaatttgaggtcattctcctctatttctaacttgctgagagttcttatgaatgggcattggattttttccagtgctgcttctgcttcaatagatgtaatcatatgatttttctcctttaatctgttgatatgttagattacattgattggttttcaaatgttgggtcactcttacattcctagaaaatatccacttggtcagggtgtataattatttttatacattgttgtattgattgctaatattttgctgagtatttgttgagttcatgagagatatctctctggagtgccttttttgtaatgtctgtctggtttagatatcaagataatactggtctcataataggagttgggaagtattatttcctcttctattttctagaagaaattgagaattggtgttaattctttaaatgtttgttagaattctccagttgaaatgatctgagcttagctgtttcttttttgggagtttttaaataatggactaaatgtctttaatggttatagcactattcagatgatctgtttcatcttggttgagttttaatagtttttgaggagttcatccatttcttctaaattgttgaatgtatgagtgtaattaatgttcattttattcccttgttatccttttagtggctgtgggatctgtactgatatctcttctttcataccagatattggtgattcgtgtcttctctttctttgtttttgtccatattggtagacttgtatcattttattgatttgtttcccagagaaccagacttttgttggatattccctgttgtcttcctgttttcagtgtcattgatttctaccctcgtgtttattgtttccttctgtctgcttgctttgggtttattttgctcttcttttctagttccttgagggaagaacttactgacttgagacctttccctgttactagtaagcatttagttctatcagtttccctctctgcactgctttagctatttctgacgtattttggtatgttgtatcttcgttgtcattcacgtctatgtattttttggtttcgtttgaggcttcctctttagcccacccctacttagaattgtgctgttcaattttgctgtgtttagagattttctgttgtctccctattacagatttctagtttgattcaattatggttaaagaacacacactgtatggttttgattattttaaggctcttgaggtttgttttattactcgggatatggactgtcttgatggatattccatgggtgcatgaaacgtgtataccactacggttgtgtggagtgttctttgtatggcaattgcatcatgttgattaattgagttattcagctcttctgtttccatgctgattttctgtctagcagttctatcacttgatgagaggggcatggaagtccccagctgtaattgtggatttgtctatttctccttccaacactgtcagtttttcttgatttcttctgggcctcttgtttgatactcacatgtatattagggtctttgtgtctccctagtggattgatctttttatcataatgtaatacctctctttctaataattttccttgctctggagtatactttattgtatattactgtgaccagacctgcttttaaaaattgtttggactttttccatccttttactttcaaactattgatgttattgaatttgaagtgagtttcttggaaacagcctatagctgggtcatgtttctttacccacactactgatgtttcttttgattggtgtatttagaccacttacataaaaggtgattattggtatggtagagcttaagtctaccatttgattatttggtttctttatgtttcttctggttcttgttcctctgtttcttttttcttgccttgctgtggattacttgaatatattttaggatactgttttatttatagtacctttgggtgtatttgtatagtttttatgatggttgatgtgagtattacaatatatatatgtgacttatagtcgattggtaacaacatttattactttgagtcaccttacttttatttaggtcactttacctttttcatttttaaatattgttgtcttaaatatcagacagtattatgatttttgttttaatcatcaagtatgatttgtaacactgattaataatgatgcttgaggagaagcataatttattatatgtagcccaaatttctactctattattcttccctccttcctgatgcttcaagattccttcttttattatttcctttctatttgaagaaattcctttagccagtctcagggtatgtctgctagtgacacattcttttggtttccatttgtgtgagactacctctgtttttagatttagtttcccaatttttttttttaattttttttggagacagtgtcttgctctgtcacccaggctggagtacaatggtgcaatctctgctcactgcaacctccgcctcttgggttcaagcaattcttgtgctcagcctcctgtgtagctggaactacaggcgcatgccaccacaccctgctaatgttttgtattttagtagagacggggtttcaccacgttggccaggctggtctcgaacttctgagctcagaaaatccacccactttggcctccccaagtgctgagattacaggcatgagccaccatgcccagccctagtttgctaatattttacttaggatcttctatactcactactgaggttggccattaatttccccttcttaccctgtccttgtcctgtcttgataccaaagttagaatgagctgaagagcttgtcctctcttttctctggaacagtgtatgtaataatagggattacttgttccttgaaagttgttagaagttgcttataagccatctagacatggtgccatggtgggttttgttgtgagcggggtttttttgttttgttttgttttgttttgttttttatcagtctttacaattgattgggtgtgagggacaatggaaagatcatcccactcttccccaacagttggtgattctctggtcattttaacagcaagagaggaaacagtaattttaccagcaatatgaatgtgaagaagtagttttctgaaagcagatgatgaaaatggggtggggaacctaatcaggttctgcaggtgcctgcagtaattcagcgtatgagatggatatgagaaattcttagaagaatctaaaatccttattaaacctgaaggttgaattcatctccaatactgagctgctaatatagagcagtagggaatcactgtagattaacccctttagtttcttgctggctgaagaaaggtctaatgactcggaagcctttgaaaaccaaagcatacatccttctggaatttccttttctgctgaaagaaatactagcagtggcatgtgtgtggtccagcctcttcagccgcacgattcaaacacatcatattctaaaagtcagcaaggccaccacagctaattacaacaacccgaacaatactggctaatttcttgtattggaagctttgccagtgatgatgaaatgaatgtcatccattgtatcccttatttttgatagctgcaaaattctccagttgttcacatgtgtatattttggtgcagtagtaagacctttcacaagcttgcgaactcttccaaacagcttccagactctacccaaccttacttaggcctgatataattctttctgtgtgctaagacagtgtgagatagtacacagtatcttttagttggagaaggcagccctctaatccttaaagcttttatttctgcaaaaacaatgaatctgcttttatcactgttcccttagtctaaagaattgactcatttgtcagcctgagggaagctttccttttaggacattctgcttctatctttctttcttttttttttttttttttttttttttgagtctcatcctgtcgcccaggctggagtgcagtgacacaatcttggctcactgcaacctccgcctctggggttcaagcgattctccagcctcagcctcccaagtagctgggattacaggtgtgcgccaccacacctggctaagttttcatatctttagtagagatggggtttcaccatgttggtcaggctggtctcgaactcctgacctcatgatccacacgcctcatcctcccaaagtgctgggattacaggcatgacattctgcttcctaagaactttgtgcaaatcaccaatgggcacttaggctgaagtcccaactccaggcccttcttggcctctacacagcacaatataaggggccccaaattggactgccgagaaagaagtgtgacttactgcttttcgttctctggggcaagggagagaacagagttagtggaaatgcacgtatgcagttggttcaaggagatctctgtctgacagcacctttgctcctagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcggtaagccactccttcctgttcacgccgtttggttctccaaatgtctgtgccaaactatagaagacatcttactgtgttttcttccacacaggtggaatttatgcgagactttaaaaaaactattgatcatcagtcaaaggaagaattttgataagagtttcttttgaaactttagaggctattttcatcattaattttatggcagtttaacaaaaaagacaaaatgtacaaattataaatgtttaatccttatataagaatatataaggctgggcatggtggctcaggcttgtaatcccaacactttgggaggccgagatgggtggatcacctgaggttaggagtttaagaccagcctggttaatatggtgaaacctcgtctctactaaaaatacaaaagttagccaggcttcgtggtgtgtgcctgtaatcccagctactcgggaggctgaggcaggagaattgcttgaacctgggaggcagaggttgcaatggagctgagattgcaccactgcactccagcctgggtgacagaaactgtctcaaaaaaaaaaaaaaaaaaaaaaaaaaaaaaaaaaatatatatatatatatatatatatatatatatatatatatataaagcccatatcttaggaagtaatataaggaaaatattaatacatgagtgaatatttttgttgagtgaataactagcagcaatttttttattcaaccaaatagtctctgaattttaaaattaaaggaatgaaattcaaaatttaattgtagccagtctacatggtgaaaccctgtctctactaaaaatacaaaaattagcagggtgtgatagcacacacctgtaatcccagctactcgggaggctgaggcaagaggattacttgaacctgggagttggcggttgcagtgagccgagattgcaccattgcattccagcctgggccacagagtgagaccctgtctcaaattaattaattaattaaaataaaataaaataaaaatctcttacctgtgcctttggatccccaagtcaacatcatcctcagattgtctgctttttttcaacacttcccaaatatggccagtaattagttatttaaggtaaaaaccctgagaaataaaaataaaaagtgcttcttctatatcacattttgcatagtattattgtctgacattttaaagaaatttaattttttaccattaaaattttacataaatatatttcccattatcagcccaaagcaaacatactatttttttatacttttttttttttttttttttttgaaatgagtcttgctgtgttacccaggctggagtgcagtggcacagtctcggctcactgcaacctctgctttctatgttcaagtgattctcttgtctcagcctcccaagtagctgggactataggcgtgtgccaccacacctggctaatttttgtatttttagtagagacaggattccattatgttggtcaggctgatctcgaactcctgacctcaagtgatccacccacctcagcctcccgaagtgctgggattacaggcatgagccactgtgcccagcctaaggctcttttctttataaattacccagcttcaggtatttctttatagcaacacaacaacagcctaacacagcatccattgacattggtgttaacccgctttgcctgcgtgtaggaaaggaaatcaaacagacctcacaaacctcacacactggcagaagcaaaaagggccatgaagaaagtggacaaatttcttacttgcatggccaggtcagagatatgggctgagtagttgggtttctgtgactttgtatgttttgttttgtttttaaataattgaatgttctggtttctagtttctgcatttgatagtaaaagaacattcagtgtattaattgaagtttctgcctgaaaaaaaagaaaatatttagcatgtcttcctttttttttttttttttttttgagatggagttttgctnnnnnnnnnnnnnnnnnnnnaaaatgaataaacagttagtgttgggtgagagattcacagaattagtgtatgatattaataccgcgttaaaatcatatacagacgcctatataaaaatcataaactccgtaaaatatagaaaacaaactcataataaatccccgttcaataaaaggtaaaatagtgcgtatgtcttctaataatcttttttcgcgttaatcttatattatacttaataactgttcgcgatataaaaaaaaaacaattgacaaaatgtcccactgaaaaaaaaccggattcgaccctatgcccgacatcagactaaaagaaatggcaataaacacccacgtaaccagccaccccaaaagtggagtcacctgccgaaacgacaagggacaaacgaactggggggaaacgaaaggccggctgataaccgagaattttagagaagcaggatttctcaatatttaccgaagggttcggactacatacctcaggggatccacatggtacggactccaaaggtaaggagttacaggcgtgagccaccacgcccggcaggcaacaattaaagtcttacaactttggtccctgggcaatagcttcagccaaggtaggacttagaaaggctaataattaataatcctggagatgaaaccatcttgacaactgttcccttctaaaacaagaacgaggctgggtgcagtggctcatgcctgtaatcccagcactttggaaggccaaggcaggtggatcacttgaggtcggagttcaagaccagcctggccaacacggtgaaacccggtctctactaaaaatacaaagaaattagctgggcatggaggtgcacacctgtaatgccagctactaggaagtttgaggcaggagaattgcttaaatctgggaggtggaggttgcagtgagccgacatcatgccactgtattccagcctggatgacagagtgagactccatctcaaaaaaatttaaaaataaataaataaaacataaataaaatattttctgaaatcttcataagtaattttatgccagtgacagccatcatactacatttttaacatttttgggattcagcgtttctgaattttcatgctgacttcattggattcactatagtttgtttgttttttgagacaggcgctcactctgttgctcaggtttaagtgcactggcacaatcacagctcactgcagcctcgacctcttcggcttatgcaatcctgcctcagcctcctgtgtagctgggtccacaggcacacaccaccatgccgagtcaatctttttatttttgtagagacaatgtcctgtacctacacctacacctatacctacagcctatgcccaggctggtttcaaattcctgggctccagtgagcctcccaccttggcctcccaaagtgctgggattacaggcgtgagccaccacatccagccacactgctagttttataagacaattttcaactgaattcttcctctttttaaagaaagaaaaaaaaaaagtctcactctgtcgctcaggctggagtgccgtggcacaatctcggctcactgccacctctacctcccaggctcaagcagttctcctgcctcagcctcctgagtagctgggactgcaggtgtgcgccaccacatctggcttatttttgttatttttagtagagatggggtttcgccatgttggtcaggctggtctcgaactcctgacctcaagtgatccacccacctcagcctaccaaagtgctgggattataggcatgagccacagcatccggccctgaattcttaacctatgctatatatcacggacgttaaatcctattagaaatgcatattcgagctattagtagaattgttaaactgagatatgtaatacagaaaacactagtcctttgttttaaattttaaatcttttttaaattggcagaaaggatttgatgtattcaatgcactggatttgatggaaaataagacattcttggaaaaactcaagtttggtataggagatggcaatttgcagtattacctgtacaattggaggtgtccaggtacagattctgaaaaggtaagtgaaatggatatagcccttgtaaactcaacaaatgtacctagacaatttcatacttgcttcacttagacttaagacagctttattttatttttgttcattttatttatttatttatttatttttttgagatgaagtctcgctctgtcccccaggctggagtgcaatggcatgatctcagctcactgcaacctccgcctcccaggttcaagtgattctcctgcctcagcctcccgagtagctgggattacatccaccaccatgcctggctaattttttcatttttagtagagatggggtttgaccatgttggccaggctggtctcaaactcctgacctcaggtgatccgcctgccttggcctcccaaagtgccgggattacaggtgtgagctgagccttaagacagcttttagaaagacagatctattgtactacattgcaatctaatttttcttactattccatttcttccctcccttcaggttggactagtactacaatagatggatatttttatttctagaactctgacatcatcatttgttaatatttaatgatttctggaactgccattccaaagaagaataaaagcacaactcaagtgaaattgaagtagtcgataatcagaaaagatgacaaaagtccacatgtgacatttgtacgtttctagctagaatgttaaacttcatcctttttttactgttgacctatttgtgggagggatgaaaggctacaaagagcacattcttgtaattttcaaatttttgcctgtctcttgaagaggtattttttcacccttagaaaagggactgtttttctatggactaagtagaagttacagagtcatgtaagaaaatctttgctattgtgtggagagaaattgctgcatttctgtttcttaagtgatggtacatttgtccatgtaacagaacaaaagatccatttggaaattttttttactggtatcaccttacatggtatcactgggaacatttatggaatcaacacttctgtagctcagtgacaggtggtggttgtttaagtgcagagcaatattaaaatgtactggtgactagtacatgtatttctccataagcagagttgccgaatcaataaacatgcaagtttgtactttgatctttaccaggtcagtggattgcttcaaaagcagagttttgtgcaagcactcactgtgctctctgaaagagcctgaggccgggcgtggtggctcacgcctgtaatcccagcactttgggaggccaaggtgggcagatcatgaggtcaggagatcgagaccattctggccaacatagtgaaaccccatctctactaaaaatacaaaaattagccgggcgtggtggcgtgtgcctgtagtcccagctgcttgggaggctgaggcaggagaatcgcttgaacctgagaggtgaggttgcagtgagccgagatcgagccactgcactccagcctgggtgacagagcgtgagactccgtctcaaaaaaaaaaaaaaagaaagagcctgtacccgcgactaactagacttttctgctgttgtgcaaagttcagtttcttctcagcaacatcaaggatatatgaagaaaaggaaataaaaaactgtaaagtcaaaagagatgcctggtggaacttattcgtgctatcagggcattgatagtttgaatgtttttattacttatgcaaaattgcacatactcctctatgctgattttatcatgaaaactgtcatgtgtcatgctaatggaaaatgtcttatttgtaaataagtattcataattttgttactgatggtgtttttaatctagaatttgaaaaactttcatggcttacagatgtgtgtttatattgccaataatctgcgggaaaaataagatgctaaccgaggccacgtagcctggcctcaactcagataccacaaagtagatgccttggctgggtgtggtggctcacgcctgtaatcccagcactttgggaggccaaggcgggcgaaacatttgaggtcaggggttcgagaccagcctggccaacatggtgaaaccccatctctactaaaaattcaaaaagaactagctgggtgtggtggcgggtgcctgtaatcccagctgctaggaggctgaggcaggagaatcacttgaacccaggaggcggaagttgcagtgagccaagatcgtgccactgcactccagcctgggtgacagtgcaagactccgtctcaaaaaacaaaagtagatacttttccctgcttttactgggccagtgcctaggaagttcagtgcagaagttaattgttttagacatgatggcatttccttcaagttatgagtccagtgaaaccaatcatatcttatcccaggcaggggccaccaaactatggcctgtgggctaaatccagcccattgcttatttttgtgtagcccacaggctaagaatgtttttattttctggaatggttgaggagaaaaagccaaaaaatgacatcattttgtgacatgtgcaaattacacaaaattcaaattccggtgtccctcaataaggttttattggaacatagccatacttttttttttttttttttaggacagggtctcactctattgtccaggctagaatacagtggcacagtcaacagctcactgcagccccaaactcctgggttaaaatgatcctcctgcttcagcgtctttttgaagaaaaagaactagctgggcgtgcataccaccacgcctggctaagtttttcattttttgtagagacaaggtcttgctatgtttcccgtgctggtctttaactcctggcctcaagtgatccttctgccttggcctcccaaagtactgggattatagacatgagccaccactcttggccacagccactttcatttacatattgcctatggctgcttcacactacaaagctgagttgagttgttgtgacagattgtgtggcctgcaaagcctaagatattcactctctggtcttttacagaaagtttgttgaccttggtcactacgaaggagttggaactctcctttctataggttgccgtgattctaaagaccaacccacagctgtgacatccctgagactaccaccagagggcgactgggccccacagtagtacataatataggacctctcttggagataatggaagacttggaatttcagatggttccaccctaattgcattagcgttctttcttaacaggagaaaggcttcaagaaacaaaacagtcctcattcactggaacagggtttgagataccagcattaagtaaatgagattttgacttaacctggagtcaaggctctaatttaggactttacttcccactcattttcatgccacaaagtctatacaaagtaggttttcaaataattgcagaatcagccaggcacggtggctcacacctgtaatccctgcactttgggaggccaaggtgagcagatcacttgaggtcaggagtcttgagaccagcctggccaacatggtgaagccctatctctactaaaattacaaaaactagccggacatgggggtgtgcacctgtaatcccagctattcaggaggctgaggcaggagaatcgcttgaacccaggaggcggggttgcagtgagccgggatcacaccactgcactccagcctgggcaacagagtgagactctatctcgaaagtaaaataaataactgcagcattgccagttggaaactttgtcatgagcttacctcacggtgacagttacactgctcctttaaagagtcatttacataatttgttat

SEQ ID NO: 14109 - DNA, 12440 bp, Human
taataaaacatattacctacgtgcatttaaaacataactgaagtcagattggcccagaagactcactccaaatgagacctaatccccaatagggtgcaagtgactgcacaaactctactcctcacagcccttcctaagactcagtgtgctcatcacactagggtctcagagtccttctgaccataaacccaagccccagccccagcccaacacacacttggacgcagcatgttcacgtccagcctaggaagaatttatggttgacctggattgggtaaaaaccgtaaacgtctgtacctcagaatgtaagatcatggtgtttaaaactacagaacattcagaggttgtcagaagtctctaattgctggtcccccaggttgaaaccagcccttaggttgaaattttgacctgcaaatttttttttaaatctgaaccaaattttttaaattaaacccctttaaggtagtacattttcaagatgcaaaattcaaaaaatataagagggcacgtgataatgagtgagtctcacttccaccccaccctccagcctcccagtttccctctccagaagccatgggtatggatgccaatctccaaaaatattttattcattacaagtatatacatatgcattattttaccgctcacaaatggtagcacactgcacggtttcccaataccttgttttttttccccttagcaagctgtctgggaaatacttctgtatctaaccacgggcaggggtgttcctccaagatttttagacaacagttctccagttcaccccgttccggtgaagggcagagcaccccccgcccttcccagccaccctgtacacgcccctactcgctctcggatgcctgcagttcccaggcttcccagcagagggagacaccattccactcccaagaccaccaaggggtcgtcccagacacaagcttcaagggtctagggaagagacgctatccgcccagacacaaagaccccccttagctatactgagttggcctccgggcctccccttcctgtttctatctcctcctggacctgttgcttagagccctaccccgaggtccccccgcccggcttccttatgggaactggccccgccttaagagtggtaggagggagccttaccctcgtctaggacctgggcttgacaacttgccccagggaaccacatagagaaggggtgtagcgctgggcgaacattgccctccccgatccctcagcgatgacaagtggggggtccttctctctgcccccagcaggccagtttccggaagagccttgacccaaacccccttttcctgtcctgtgctccacactcccagcagctgcttctccctggccaggccctgcagccctcctccccgcccccacggtggtgttggggtcgcctggagtccagctggtgtccagggcagagctacccctttcctggccctacccctccccgtgaccccaatcctccgccaaccgctcaaaggatccttgttctccatccagcccccagacaaaagtccctctgtctaagaaggcggaattgaggggagggggcacccccaactgggaccatgggggagcctgcacagaccccatccggaaggaatgcctggaggaggaggagcaggagacaggggaggaaagggggagggaggcttgtacagtgcagggggccttatgtggactaggaggcagccgcccccaccagcacccactctgtagacccaggcgtctggctcccagcacccacggaaagagcctggctaggaaactgcagcctggtgcctggcagacagttctcattctccccagggcagggagcaggttatgaccaggactaaggtcccagagtccccaccctgacccctccctgctgttccagccgctccctcatatccacccctgccccatctcctgactttggtcacgctagcatcttctgctgatcctgaaattgtaccagcggcaagatgtggcctggaaggggactttaagttctccacaactgccagcaatccttccaccaggcaaaacacatcatctaaggaaaagaagtgaggtcggaacaccaacgcatcatctcactgcatggccctggaggctctgccgtttaaagaccccagaaccttccccattcaaggtcctctcctgggcacaggagattggagaaagctcctcccttaattccagggaccgagttccagcccatccaattctccgtctcacctgaggctgctgtggtcctggtgaccccagggagcaacctgccgcccatggctggggagggggtgaagctgtctctttaagagcaggaatggagcccctgggcctcagggcatctgacttgttttctacctgcccaggtttgcttagggcgtggcagcttcggataaacgcaggactccgcctggcagcccgatttctcccggaacctctgctcagcctggtgaaccacacaggtgagcagctggggccccttcctccaagccctccttgtctctgcccctaaattaggaagtatctacctgccccctgaccctgccccatagaagcttttatgttaaagcgcctaaaatcttgtgaaatgcttttctggagccaggagataaacggaagtcccttcccctaatgtccctttccccaccattctcctctcagggacttgttgaaccagctgaggtgagggcaggactgataagtgtggttggggtgtcggaaagactagtgtctgcatggattagggatatctgggttggggatagctgggtggaggagagggggtgcctgggtaggtaggggtatctaagtggaccaggggtgcgtagatggactggggacatctgggtggatgaggaatgctgggtggactcggggtgtccagacattgagggatctgggtggataaggagtgctgggtggactcggggtgtccagacattgagggatctggattctggagacctccaggaaaaaaggatggagctgctgggggaagctttaaatggggagttgcttgggagatttcaggagcacacagcgggcaggatctttctacccacccctgaacatgagaccattctcccatggtatggaggaatagaggggatagcagagggcaggtgggggaaacagtcctcaggccggccttgggacctcatggccaggaaggatgagagcaggtagacagagcatcagctgcagggctgccttcctctctaacctgctcaccaaccacatcagttcgggagcagcccacagcctcttcagacaacagcctgaatggggaacgtgagggcagacccagctcccggctccctgcagcctccggaagcatgggactggacgttgttttgcagaggctggggcgaggaggataccatctgtcagtcttggctggatgacatcatgggaagggggtatagtggggccttgcaggccagaggtggcttggaggagcccctggaaagaggcttaagaggtgagactcaacagccatggcgacagagcatagggctttaagatgaatttgcaggggttacaggattacaactgcaatgtgggctaataatagtgccccctgcattaagctgcagagattgagcgagtaagtgggaagctgagaaaatgcccccatggggtagacactcaataagcatctgctgttattaccaggactcgtatggtcatgggtgacagcttcagaccacaggcagtccacctacaacctgtgcccctatccaccatgccatcctgcccacccacccacgccagctcccccaacccccaacacttttggggatcctaaacacttcctgggcctcagtaatgctccccaaagcctcaggctttcttcccgcaaaaaaaaaaaaaaaaaaaaaaaaggaaaagaaatggatgctccaactaaaattgtgagttcagcatgtggaattaactgggaagctgagaggattcccaggccctggggtgcgcaggcagagggaggagtctgtgccaacctgcaaggaccacccgcaccgttggttgcgggcaccaccctctctcagcatttttgctgttcgtgaaatgaggacatagtggatgacgtcggggattgctggggggttaagtgagtgagaacacggcaaggtcagtgtgcactccagggcaaggtggaggaagtgccagctctcgctatcaaaattataactaggccaggcgtggtggctcacacctgtaatcccagcactgagggaggccggggtgggtggatcacctgaggtcaggagttggagaccagcctggccaacacagtgaaaccctggctctaccaaaaatgcaaaaattagccgagactggtggcacatgcctgtagtctcagctactcaggaggctgaggcaggagaatcacttgaacccaggaggcagaggttgcagtgagctgagattatgccattgcactccagcctgggtgacagagtgaaactccgcctcaaaaaaaaaaaaaaaaacaattatgataactatgcactcagcatttgggcagggacagggcagggacagggcaggggagggcatgctcggaggccagggcttggtgcagccttgcaggctggtgagagggcaggactgatgccaggtcaggaaggagagagaaacgagttccttatgctgagcaggtctacctgggaaagagaaagtgtttgctgtcaccaggaactctgctgggcctagggtagggtcaggggctgggctggggaccccggctaggcagagccagggctgggaccgggaagggcatgggtgtgggatgaggggcaggaggttcgggggaacagagatggagctagggctgcagccaggaggtagagtccccctctacccccagtcccagcctcacgtcaattcctccacacaccaccccacccccaagcagcttgaagaacctgctcagtcctcagcctgaagtctgcaatgtcctggcagggccgggcaggctctgagcggtctacggagacactcctgggaagcgggcctcctgccgcctggctcccaatgccccgcttccccaaacaccccaaggccctgacagtccctagttaggagcagctgctggggagccaggcctggcttaaatcctacttcctggctagagcacctagtttcacctctcagagcctcagtctccccatctgtccagtgagaacagtgggcagtggcgcccttgtttggttgcggggcgattcccagaaagcctgaagtccatgtccagtgagttattatggctcctcccgcctcaggcccgagtttcacccagtccccactccacggtgcagctgcggcttatctctcagcccagcgagatgccagccttcctgtcccgggtgagctgcgcaccctgcctggggagcaggggaggagggttggggagccacaggcacagggccagcctcccggtggctctgctaaggccggacctcccgccacccctctaggccagcgctctgacatgcagaaggtgaccctgggcctgcttgtgttcctggcaggtgagtacccatcccccgtctgccttttcctctggatcccctggatgcggggatccaacctctgtctctctcctgtgcttttctacctccccgggaaggtggtaaatgttagaacagcatctccctgagggtaagaaaagtcagactagtgatagccagggatacacgagaagagctggctcacacagctggaaagtcaccgtcttccccattctctcgatctcttcttttttttgtctttttttgttttgttttgttttttgttttttgtttttgaaagggagtctctgttgctcaggctggagtgcaatggcgcaatcacagttcactacagccttgaactcctggggtcaagcgatcctactctcttagcctcctacacagctagaatgccaggcacacgccaccatgcccagtgcatttttgattttttgcagagacgaggtctcactgtgttgcccaagctggtctcaaactcctggctgagtttgatcctcccacctcagccttccaaagtgctgggattacaggcatgagccacactgcactggccttgattgactattaaacagaaataacggaagctagagaagatgatgaaatgacaccttcaaagcactgaaagaagataactgccctgccagttctctaaaaacttcaagtagaaggctcggctcagtgcgactgcatctttaacttccaaacacttttcccttttttcttttcttttttttttttcggagacagagtctcgctctgttgcccaggctggagtgcagtggcatgatctcggctcactgcaacctccacctcccaggttcaagcgactctcctgcctcagcctcccaagtagctggcattacaggcgtgtgctgccatgcctggctaacttttgtatttttagaagagacaaggtttcaccatattggccaggctggtctcgaactcctgacctcaagtgatcctcctgcctcggccttccaaagttttgggattacaggcctaagccactgtgcccagcccgctttttactttttcactgcagccttgacctcccaggctcaagagatccttccacgtcagcctcccaaagctctgggattacaggcacactttttgtccattacatagggcaagaccagtattccctgcagggtagtgatctaaaattacattttcaataaagtctatttaagtgtataatagtgagtcattttcaatgatgtgcaaacaccagaccaggtgggtgtggacatggtggaagcgggaggatgggctttgagcatgattggacttggggaaacaggaatctgggaactgaaaccatctgtcgtcttgaccagaaaagtcccccgctgctgcaggaggcatggattaaccacgtgtctggaaacatgagaccaaatagtggctaaaaacctcctagattagaacccatttcaggtggcagaatgctggcgtgactcggaggtgtggggctgagtgggcgagtccacatttcctcgttgggatatgaggggatgaggtggctgctcagtgacaggacccctgtcccgcaggagaccctttcccaaggcccctgaaactccccgggccctgcccaaaggcttggctgaggccggcatcaccatctcccctccttcccctcttctcccactaggctttcctgtcctggacgccaatgacctagaaggtgagtcagactggactctcacccgtcacacccccaaattctcccctgggtggggaaggcctgcatcctggctgtaatcctggattcatgatcttttttctttccttgcagataaaaacagtcctttctactatggtgagagcccgtgccccctttcccctccccacaaccccacatactgcttggtgccaagggttcccatacagggttggggcctgacgtgagcatcacaggacaaagatacgaagggactaggatggggttactgaatatgccacacagtggattaaaggaactagaggcagcaacctggcctttgggaaggttctattccagcaagatagacacacgcaggaggtgaggacagtttgcaagaagccattggttggttcagatcaactgctgggagaagtgttgacttgagaaaacttcctggaggtggtgagctattggatcaaaaccctcatctggcctccaggttccaatgacctgctccctactccccgctctgccctcacctctccacgctcctcattccttctgctccaagcctctcagacacagcagacatactgccagcctcagacctctgcacctgctggttcctctgcctggaacacttccttccacagaaccacatggctccctcccttccctctgctcaaatgcagccccctgagaggccttccctgacaactccctctaaaagagctgccatctgactttttttttgttttagagacagcgtctcacactgttgcccaagctggagtgctgtggtgtaatcatagctcactgcagcctcaaactcctggtctcaagcgatcctcctgcctcagcctcctgaatagctgggactgcaggcatacaccaccatgcctggctaatttttgtatactttgtagagatgggttctcactatgttgctcaagctggtctagaactcctgaactcctgaagtcccaaagcactgggattatattaggttggttcaaaagtaattgtggtttttgcaactgcttttaatggcaaaaatgcaattttttttttttgaggcagaattttgctctttcacccagagtgtgactggctggagtgcaatggtgcaatcttggctcactgcaacctctgcctcccgggttcaaatgattctccagcctcagcctgctgagtagctgggattacaggcgcctaccaccatgcctggctaatttttgtatttttagtaaagacggggtttcaccatgttggccaggctggtctggaactcctgacctcaggtgatccgcccaccttggcctcccaaagtgctgggatatcaggcgtgagccaccatgtctagccaaaaacgcaatcacttttgctccaacctaataggtgtcagccactatgcccagcccgccctctgactttccatctcccaccccacttatttttcttcaaaccacttatctctgcctgaccctgcatgacagatcgtgtttgctggtgtgtgaaccagaatgtgagcacctgggattttgtctgttttcttatggcggtgtccccagcaccctgtgcatcctaggtgctccatatatatttgtcaagagaatggggggacagatgaagaggacacaggctggcactgaggtcccctccactttcctcctagactggcacagcctccaggttggcgggctcatctgcgctggggttctgtgcgccatgggcatcatcatcgtcatgagtgagtggaggagctcgggggagcaggcgggccggggctggggctcccctcccctgaccactcagctctccccaacaggtgcaaaatgcaaatgcaagtttggccagaagtccgggtaagatactgttccggcatgcccgcctcaggctgactggacgcttttcagggtgaaagggctaactctcccagcaggagaggcctcggggctctgccctttagagttcctgccgctaagatttccaggtttattgtttctagctggtaatccccagggggccccaaatcctgaaatgctttggcccctgggattgcacaaccccccaaatggaaaggcagccaggaagacatgtctgggcaggctaagaaccctctatccggagggagagggcaaatgggggcggacaccaatctcaccacttttgtctccttagtcaccatccaggggagactccacctctcatcaccccaggtaagatggggcagcatggggctcaggggaacacggaagtggtgtgtgtgtgtgtgtgtgtatgtgtgtttgcacactggaaagaaaagaactcaatccaccctcacaaacggaccccatcacctcccgcaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaatttttttttatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgagacatgaacccaaaaagagacccacaataaactcgtgacttgtcccctcatcatgccgttttatccctcaaacatcccctgagtccctccataaccacgaacccacactcagagaccatgaactgcggaaacgcctccctgggacctgggccgctccgagcactgctccagggacaccatccccgccctgtgccgttcacaggacatcctctcccaaggatccacaacactgggcggggagggtgcacagcgcatttattgagctcggactcgtcttgtccttgcctccgtcgcccatctagaagggcaccaggctccccgcgacacctcccgctgtccctccctgtgccccggcgcacgcgcaagaggcgcaaaaggcacagcttgctgggcggccgcacgcatgcgcacaagcagcagaggggaacccgcccagtgctgagttgtcttcgaggttggcgctcctccaggaaagcgattggctgcgtggagtttagaatgggaaaggaatgccatcaacccctcggtgctttcagagggaccagcggggtaggagcgggttgagaggggggctccgggacctcatggagctctgcacgtgacctccacctcgactccatgcagtgcaccagcctgcaccccccaggttgcctttgatggggaatctgccccagccgagatgtccagatgttgctttagacctgaagggcagctcgggaggtccagtaggctgggaccctctatgtccccccatgggtgcagatcctttaagaagtgggcttaaggcctagacgtgtggctgatgaacgtggcccacggtcagcagctcacaggcgggccatcaccccaagtagggccaggagccagccaaggggccgtccaggggccccagccatgcccagagtcccattggtggtctcaggcactgaggtcgatctcgtgatgctggtagatctgtgtggggcccttaaagcaagcagcaaagaggaagcgtctgccggccatagtgatgtgggcaaaggcacggggggccaccagggccggaggccccagctcctgcagtggctccaggagccccttgtcaggctcaaggcggaggacctggctgaaggcgaagtcgctgcctaggatggccagctggtccctggcgatgagcagtggctggaagacgtgggcaccgcgcgagggaagttgctgcagcagacgaaacatggagccgtcccagcgcatgacctgtgggggtgtggccagtgagggcctggggtcccgggggtctctgggggccctggaacagcttggaagcagaagcctgtcggtcccaaaactcccatagctttcttatcttcataaaagtcaccacccacctgttcggccacacacatggagttgttctgagcccttcccttgccctcacgccccacacagaagcactcagccatggactctgtcagtttcaccttctacagttgtacatttctcccaccacctctggctgaactccatcccctcctgactggaccatcctggcagcctcttccctggcctctaggctcctctccctgctcccccagtctgttccccacccagagaccttgtgaacacctgagtcagatcagggcccttccagactcagaaccctcccctgcctgcacctcactccagaaacagtgggcagtgcttaaccctagcgtcagccttgggggctcagtgtcagggtggggacaggtgtggctgtggtgaagtctggaatgcatccgagtcacagagccagcatttgggggtagaatcaggatgttggggccagcatcagtgtcggggactggggagtggttcggagtcagccagccttgagggggtcagagtcttggcatcagtgtggggtggggtcctggttcaaaggtcggcatgtgagggtaggtcagagtttagaggcttagtgtgcaagattgggtcagtgctgaaaagccagccccccgcccccaggcccagcctcaccatggagtccccaatgtagcgtgtgaggcacaggaacacgtccccaccagcctg

SEQ ID NO: 14110 - DNA, 12440 bp, Human; identical to SEQ ID NO: 14109

SEQ ID NO: 14111 - DNA, 11174 bp, Human
  misc_feature (1)...(11174): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgcggggggcgcgcgcggccggggggcaccgcgggggcactggcggggcggcgggagtggcgctcgggacacggggcagccgcgcgagggccacccccggcccatccccgggccccgccaagtcagcttcagaagttgtgcgcgcgggagccgggcttggggagggcagtggaggtgagggtgggctccagcgggtgggggccgggctggcacagcctggcggctgcaggcgcccagccgggggcgaggaaacgcggagtcagctgctcccggagccccgcaggctgcaatgtgacacccacagccgcgggaggggggtggggggaaggcggcgcccggagactgggacgggaaagacggagggacagggagagatgaagacgggaggaagggggcgagagacagagaaggactcggagcgcaccggagtggtccgctgggatgctggggacatgggggtcaagggggagacggagacagagagaggggtattggagagagagagagagagagagagttaagagactgagcgcgatggagaaagggaaacttgagaaaggcagaaggagatggagagaagagagagggagatgcgggtgcccgtgaacaccgggagagaatcttgcatggagtttgaaaagggatagacgtagaaaggtggaaagagattaggagaggtctccttctgagcccagagagtggacaaaaagtggagggaccttcagagagacccctgagagggacaaagataggagggactgagacagaggccctcagggagtctgaaagggaccgcaggggaggcggatggatgagaagtcctgaggatcaggaaacaaggacagcacagggctgcagcagaagagacacagcgttagctacagagtgctgggaggcagaaaggaggtgccaggtaagagtgtgaaggaattctaagactggaattcagtgggctgcaaaagccctggggcaggagagagctcaggaaagctttgagtagtggatggggttggggtgggaagagctctagaggcgaggagcctggggaagaggggatgatggaggcaggagaggccggggaggggatggctcacacaggggcttgtgggctgtggagaggggctgagtgtgggtcagccccggtttcagtgcccacctccccacaatcccccacccccagaccttttctcccaacccatttctcctggagctagctggttttacaatttaatggtgaaaatgactgccaccttaaacttctaacttagctggaattctcattctaccacctagatgcttgggttcctccagcaagggactttctgaggaaggggcactcgggtagcataaagtctgagttaccggcaacgttgacagtcccacttatggggcctcccatgtacaaggccctacctaatgtatgaaaatgggcccagccattgctggaagcaaaggaccatttctttcaacaagagagagggaaactgagactcagggatgaatgacttgctgaggtcacgcagtgagtgacagggctcagcctagcatccagtcctgtctgctggtaatcattgaggggggaacagatggtttgtgaggggtctggcattgcttagggcaatgggtgcctctgcctgacctgagcctgctgtccccacagtgtcctcagcctgcgggggctgcgtggaggtggactcggagaccgaggccgtgtatgggatgaccttcaaaattctttgcatctcctgcaagcgccgcagcgagaccaacgctgagaccttcaccgagtggaccttccgccagaagggcactgaggagtttgtcaaggtgtgcgggtgccgggaacgggcatgggagggcaggggtccacgagtgggaggcggtggggctggatctcagggagggggcttatttgtttaataatatgctgtgattgctgacctggattcagattctggctccaccagtggccagctggtgaccttggccaagtcagtgagcctctctgaaagtcagtttcctcctcggtaaagacggggtggcggtggtctctagcccataggtttgtgtgaggactgaatgcattgacgcacctggcacacggttggcatgaaataaatgtcagtggacttatttggcaccagcaaacaatgtctctgatagtcattacggagggaagacagaactgttttttttaacctcctttaaactatgtgtgtattttgcattatatatcggtgagggaaccataaaattctgtgacgtgctggagagttggggtctccagctgctggaatcaggctgccctgtctctgctggaggagtgtgtctggtggctgggaaagaacggcagagaatgatagcctagaggccagatggggcttgggaggatgactgaggaacgtgtgtgtgctcgtgtgcatcttggctagaggcaaaagcggggtctggttgactccaggcgtgatcctagccccccacccctgtgccctccctgcctgaggtcaaggtgtctgagcccatctgtgtgccatctgtgtttgtgggtgtcagggcaggggacagaatcagggtcaggtaagggaagagaggcccaggcagtgacaccttcccctccctggctacccctagatcctgcgctatgagaatgaggtgttgcagctggaggaggatgagcgcttcgagggccgcgtggtgtggaatggcagccggggcaccaaagacctgcaggatctgtctatcttcatcaccaatgtcacctacaaccactcgggcgactacgagtgccacgtctaccgcctgctcttcttcgaaaactacgagcacaacaccagcgtcgtcaagaagatccacattgaggtagtggacaaaggtgagtcgggtgctgcctgcccctttaccgtcacccaccggagagccagatggagggacagatggcaggcagtggacaggacaggctggctctgtgcctggccagccaaccgcccacagcagcgggctgagggggaggggagcagcccctcctgcccactccagctctggcctctgtttctctccagcccacggagaggtcaaagcatgcctgtcccccacagacgctccgggtacagaacccagctctgtcacctgtgctgtatgacctctggcaggtgccttctgtctctgagccaaagggttgtcctgggcttgcccgggataataatccgatgtgtttctcggggtgtggtttgagccattcttccatcatggggttcatgaggattgagcagctgcaggcacacgcctggcttccagcagagccttgcaggtggtggcgagggtggcggttcttactgttcgagtagctcagccctgctgccctctgtggtgatgaggcaagagagcgtgccacctagagcagagttccgcacacccctctgcactcctgccccgggggagccgcgctggcctgcagtctcactcaacacctctggggcgggcctaggggtcctttctaaagctctcaggtgaggcagtgaagggccacaggtgcggggcccaccctctgagcagcaagggcctacagcgcttttgaacgtctcatcattttgcctcagccaccctggaccccttttctgagggaggtccgccccttctctgatccatcttctgctcagcatcaattgcaattgtccagcgccctgtggccactggcttagagttggggaaacagcccaggccttgaagcagctacaagccgtggcagaaaggtctctcagggccacggcacacacatcctcatgggcaacacgcactgcccatcttttctgtgagatgggtgccggcctcagtgccttacacggagtcccttagtgaatcctctccccaccctctggggtaggggctcttcctatccccattttacggatgagaaaaccaaggctcagggagggaaggttatgtggccaaggtcatgtgattgggagctggacttgaatccagaggagcttgggtgactgtgtttctgttcttggcatgattcactgtactctgtgatcagccagagcctgtgggtttctttttataattagcatttttacgtttattgtcaaattggtgtagcagaatgcaattcagcaggcatgtctgagccactctggtgtttgtcacgatgctggggggtgggggtcacccgcagacatggatgatggagccccgcctgcggagttgctgtgacaaagatgcctgcggtactgggactttacaaaacctgtgttattgctcttgcaaatctgcagaggtgagatggggagagggtgggaggctccagggcactgttcagccacccaggttctttccatcttgttgtttggcagttggccagggtgttgtgtcctctgtacgccgtgacccaatagagcctctttttttttttttttaaatttagatttttattttttgagacggagttttgctattattgcccaggctggagtgcaatggcgtgatctcggcccactgcaacctctgcctcccaggttcaagtgattctcctgcttcagcctcccgagtagctgggattacaggcatgtgccaccaagcccagctaatttttgtatttttagtagatatggagtttccccacattggccaggctggtctcgaactcctgaccttaggtaatgatccacctgccttggcctcccaaggtgctgggattacaggtgtgagccactgcgcctggcctgagcctctcttttttaggattgcccactgtatgacactacatcccacagcctgtgctattaccagcatttaccatcatatgcagttccttatgttggccctgcagagtttgtgttttctgcactatccacccagttctagtgttttttacccaccatatgtagtattgccttttaaacattacccactatattatagtattttatattacccactataggatattttatattacacaatatattttactatcataatattgccaaacacaacagttttttgttttttgttaaagagaccaagtcttgctctgttgcccaggctgggatactgtggcgtgatcatagcccactgcagcctcgaactcccgaaatccagcgatccttctgcttgagcctcccacgtagctgggactacaggtgtgagccactacgcccggcaattttttttttttttgtagagactggatcttgctatgttgcccaggatggtcttgaactcctggcctcaaataatcttccctccttagccgccgtaagtgccgagattacaggagagagcctccgcgcctggcctacagtatttttattataatccatcatactagcgtatttttaacgttccccaccatggcgggtatttttattacccaccatgctatgctatagtatttcaaaaattaatcctattgtagcatgtaaaaatattccattctataccatactatattcatcattacctctgatactacagtatttttaacatgactcattgtgctattgtattttttcattacccacaataccacaatattactgtatttgttagcactgcctgccattccttattattattatttttgcaatggagtctcgctctgtcacccaggcaggctggagtgcagcagtacaatgtcggctcactgcacctcccgggctcaagcgattcttctgcctcagcctcccaagtaggtgggattacaggtgcacgccaccatgcccaactaatttttgtacttgtagtacagacggggttttaccatgttggccaggctggtctcgaactcctgacctcaggtgatccacccacctcagcctcccaaagtgctgtgattacaggcgtaagttaccatgcccggcctattattattattattattattattattattatttcaagttagagtctcactctgtcacccaggctggagtgcagtggcacgatcttggctcactgcagcctccatccacctcccgggttcaagcgattctcctgcctcagcctccgaagtagctgggattacaggcacgcgccaccacgcccggctaattcttttgtatttttagtagagacagggtttcgctatgtagaccaggctggtctcgcactcctggcctccagtgattcacccaccttggcctcccagagtgctggaatgacacgtatgagccaccacactgacctttttattatttttatccaccatctcgctgcaatttcagtattgcccatcgacctatattgcctcctggtaatgacccctgaggaatgagccatgccatttccataggtggaggcgacgggtcatggtggtgagaacttcactgacctggaagaggtggagaagatgctgggaagctgctgagggctgcccacctgtgttaggagaaggcagatggggacccatggggacagtaatactattttggatccacacaacgggagtggaaaatgccttgaggcacagcagcgtctgaggcgggtgagaaatccggcctgcagagtcgcggctggccttcagatctgcgggctgcctgtgagatgccgtgttacctaaatccatttgggcactgagttccaggagtgggggcaagaattccgatgacggggctttatccggtgcgcatccagctcagagtggttcctgagaccagccaccatgggcagccaggatgtgctcatccttgaggctttccgaggcatcaaggagatggttggataaagaatttagcacagagcttgactgatggcaggcgcccacaacatgagacacattaataatgtgtgtggaggccaggtgtagtggttcatgcctgtcaccccagcactttgggaggcagaggtgggaagatttcttgaggccaggaattcaagaccagcctgggcaacacagcgagacctcatctctaccaaaaaaaaaaaaaaaaaaggaaaaaattcacctggcctagtggtgcacacttgtagtctccgctactcaggaggctgaggcaggaggattgcttgagctcaggagttccaggctgcagtgggctatgattgcatcactgcactccagtctgggcaatagagcaagaccctgtctcttaaaaaaataaagtctgttgaaaagaatgaatgaaggaaggaaggaatgagagggaaaccctgtctcagctcctcccgcagggaagctggggcagggcaggcagggggggcatccggccccgctccctcccttactctggcccagaaagcactggtgccatctgcacagggtggagccaaagaaagtgccccactcacagcagagggaggccatttgaggacagcagggaaaatgggatctcagccatctaggagggggccagagatgtgggatggacacctaggaaatccagccgaggacaccagagtggcttttgactctggtcccctggctgaacgcgttccctttacagtttaaatttaggctcaaggagaagaagctggcaatcggcagggccagtgctgtagagaggatgtagggtttccggaaaatagccaacacttcagcagtgctggctgcgagctcatccaagcatgttacgggtgttaactcatttcctctccagcaaccctgtgagagggtctgagtgttcccatctccattttacagaggctcagagaggtgcagtcctttgcctgaggtcacacagctagtaagaggcagagccgggatttgaaccctggcagtctggccctagagccccagctgttaaccattaggctttatagccccagttataacaacaataataatactaatacaagtgaaccttcactgagtgccatttatagatcaagcactattctaaggattttaaagcatatttaattctcacagcactctgatgaaggaggtattcattttacaattgaagaaacagaggcctagagacattgagtcacttgcgcaaggtcacacagctggccagtggcagagccagcctttgaacctgagccttctggttgcagagctacggcttttaggcaccgtgctgagggcctccagaatgacacagatgtggcctcgagttacacagggaggcaggttgagggtgacccccaccaggcctacccaaggctgggtattaataatcacagtgcatacaccaggcccagggaggttgagccactcatccaagctcacacagcaagctcacagcacactcaggctgtcatgcagcctgggctacccccttaaccctgcctggcccctgcagccaacagagacatggcatccatcgtgtctgagatcatgatgtatgtgctcattgtggtgttgaccatatggctcgtggcagagatgatttactgctacaagaagatcgctgccgccacggagactgctgcacaggagaatgcgtgagtagggtggctgggaggtgggagggcacccagggcaccgtcacacttgccagagaggaactccggagcccgggcagggaggaggcagcggagcggcccagggcgccatctctcagtactacccagaggggagtgctccctgtcagacacaggataggggtcgtcagacccagccccttcctccctccaactcaggagcccaggctcccagccagattcctcaaagaccctgaggagtccacccatagactccttctctctctaactaaggagccctgtgtacctggggtggagaccgctaccttcccccatcccccgggggttgggtcggtctgatgatggggtcactgtatacctggcctttcccccacagctcggaatacctggccatcacctctgaaagcaaagagaactgcacgggcgtccaggtggccgaatagccctggtaaggcggatgggctggcagaggggaaggggattgggaggggccgaagtcccccaggtccctaattccccctctcttgctccccttcaggccctgggccccgcctcaaggaagagccagccgtaatggggactctccaggcaccgcctgcccccagcgtgggggtggccactcctgggccccagaaagcctcagagtcctgccgacggagccactggggtgggagggggcagggggcttggctcgcacccccactttcgcctcctccagctcctgccccgccggccgcgcaccgccatgcatgatgggtaaagcaatactgccgctgcccccaccctgcttctgctgcctgtttggggaggggggcggtgaggtgggggcagcggccccgcacccctcctccttgctgatttgcacacattggccgcttcagacacgcacttctggggccagcccctccccgcctcctccctgcctggcggcaggggtcgcgatgatgggctggagcagtttggggcagggggttctgggacccactccgactccccctccccggcatcatttcccctcccgcttcctccggctggacctggggtcccccctccctgtaatgcactcctgccccggcccaacctcgccctctctcaccagccttgaactgtggccacctagaaaggggcccattcagcctcgtctctttacagaagtagttttgttcatgaaataaagactcttggacttgatgcatagtttcgattgtgagccccgtcaccttccccccattcccgtccccgaatcttcgagcccgctttccagggaccctacctgagggcccacaggtgaagccacttagtgcctgatctgtgtcggggttgggggagccatgggctcaggggtgagggagagtggaacggagccaggaagggagggggtgccgtggagggaagagaatcgaggctgatgctggggtgcaggggtggcatggggtgtgtggtgtgcccagcagtgtgagtctctggagaggtgggcgctggggagaaggagagggaaggagagacgggtatggatggaaaggcagaggaagccaggctaaaccagcgtgtcccaatgaggggccctgggctgagtggaggaaatgggtgcggtggaggtgggtttggctgggcacagcgggcacgtgtgggtaagcgggtggggccggttgtgcgggtggcctatctggggcaagcagccgaggccgactgtgtccggcgtgtggttgagcacgggcaggtgtctggcggtgaccctgcacgtctggtgtttacctggccctgggtctgacgtgggccgcgcctggctgctggcgggacagtgtgttatctgcctgcggacgcttccggccacttggcctgggcctctgcccttagcgctgtgttttcccggccaagccccccatcccccctatctagtgctaggactttctggctccagaggtcaccgcggccgggcggaggctgccaaagcaaaccagccccgtgacttgtaggaagccagcgggggaggggccggggcaggatgagcagggcaggcgggagaggctggggctggggttggggcccaggaattgggcagggaattaggcagaggtgcagcaagtggcgggcacagccaggacctggggctggaggacgcagaaagggcggggggaagggttcgctgggtgagggtggagtgggcttagggcagctggggccctccatctgatctcttctggtcagacccccacccttcagcctgcactttctccctaaacccccagcctccggccaggcctgtccctgttcccacatccccgcagacaggcacacctgggtccccctggaggtccaaggcaagccccgtagctgggcccgcctggtccagcccccacaagcccggccccatcagccaggtggcctccagtgctgccaatcgaatggtccggcccctccccgccccttcacccgcccctcg

SEQ ID NO: 14112 - DNA, 50109 bp, Human
  misc_feature (1)...(50109): n = A,T,C or G
ctgcactccaacctgggtgtgacagagtgagaccctgtctcaaaaaaaaaaaaagaaggaggagtcagagggagtcagtggttactattgggctagagtcatctgaggaatcacagggtaagtgataatggggcagtggctactgagactcgccttcccattggttgaggttttgttctgaaacagaggatttggggtgggaattctcttctgtgtagatgagtaactggcttagaaaaccctgattggagtgtttctcagaacccccgtagaggccaggcgcagtggctcatgcctgtaatcccagcactttgggaggctgaggcaggcggataatgaggtcaagagattgagaccatcctggccaacatggtgaaactccatctctactaaaaatacaaaaattagttgggtgtggtggcgtgcgcctgtagtcccagctactcaggaggctgaggcaggagaatcgcttgaaccagggaggtggaggttgcagtgagctgagatcacgccactgcactccagcctggtgacagagcgagactccatctcaaacaaacaaacaaacaaaaaaagaactccagtagaacagatactgttcagcactaccagggttgtgctaggtgtggaagctcagtgaaatcttaagagttgacagttcttagaaaagggccatgtggacagggctgttccctggaaagtcctgtgacccctcagtgaccacttatttcttttgttgtcagcctttccctattttcttttcttttcttttcttttttttaagacaaggtgttgctgtgtcacccaagctggagtacagtggtggtaatcacggcagcctctaactcctggactcaagtgatcctcctgccttggcctcccgagtagctgggactctgcagatatgcaccaccacatgccccgctaatttatttttagtattttagaagcagtgttttgctgtcttgcccaggctcggcttgaactcctggcgtcaagctatcccacctcccaaagtgctgggattataggcaggagtgcccagccccagagttcttacaatgacttacaaggtcttacgtgatcttgttgcctcccttttgctctctgacctcatctttttttttttttttgagatggagtctcactctgccacccaggctggagtacagtggctcactgcagtcttcacctcccaggttcaagtgattatcctgcctcagcctcccgagttagctgggaatacaggcacgtgtcaccaggcccggctaatttttgcattttttttttcagtagagatgaggtttcaccaggttggccagtctggtctggaactcctggcctcacatgatccgcctgcctcggcctcccaaagtgatgagattacaggcgtgagccaccgcgcccggcctagtcacttttttcttaattgcaaccccgattctcagcacccttttcatcttggttttcctcaatagcccttaccaccagcagacacacatcatctgttgtacttgcttatttggcacatatgtatccacagcgcctagaacactgcctgtaacgtggaaggtgttcgatctatagagttttgtcgaatgaatgaatgaagccgactagtgcacagggagtgcagcggcgcgatggtagctctctgcagcctccaacacctgggctccagtgatccccgggctctgcccaccctccccactgccacttccgggcagaggccagcaaagcggcggcgcaagaggtagggagagaggagctgaggccccagatcagcggccgcgggcaaggtcgctcagcgggcacccggcctgggtatcggggcgcgggtcgggggcggggccggggctcaggggtggggccgggccgggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcaggtgcgggcgggccggaggcgggggctgccacgcgcggcgcccggaaccgggcacgcgggcctggggtctggaggcgggggcagcggtgcccggggaccccagtccccgacctccaggccacggactggggcccaggccgagtccgcacttcgtccttggagtctccttggagtgcgttcctgggggcttgcagcctcgccgggagtctcggccccgggtctgcttcgttacgaggaaaaacgggcccctccgtggggacatttcccctcctcctccccgtgcagctctggccatttgagcaggggctcctttcgcagttgtgaagagaggccttggctgacgcagcaagcgggaaagggctgtccctttccatccgctcctggccacatgagcttgggagcgtctgcagggcgggcagcccgggcgggggtgtttgagggagctgggtggaaggatggagacgtcgggcgtgattcctgcagaagacacctgtgcacgaccgggaagtgggaaggagtgtttgagcaaatcatgggcgggagtgcggccaagggagctctgatcactgatactggtggaggcgggggaggggagcgactgtggctccgggctagacgtcccgatggccatccctgtcatctggatgggtgcctgagtaacttacggcagaaagtggaagccctgggaaggggtggtcccccacttcagtccgggctcctcatccagggtctgcctgcatctacggtctgtgaggatggcttctttctctgggctgctgttgcagatcatcctggtgggccagcaggtgacagacaccaccactgtgctgggtggccgcggcccttgtggggcgtgggtcagggaggatgtttcttctgggaacagctcctgcttagggcatggctccccgctagggagaccagggtgtggtcagcagcatctccatctttctgcagcttgaccctcaacaccaaccatgggcatatcctggtggattactccaagaacctggtgacggaggacgtgatgcggatgctggtggacttggtaatgttctgcttggggaggcataactggtaaccgacagagtggtgggtgagctgggctcctgggagtccccaggaccttgagtatcttgagttcttcctctcattagacctcagtcacctcctctgtgctggtgaggcacctgtccctggcttaggttctaagcagcatcccagggaccccagtgtctgatgtctgagtagacccttcccagacagcaggggagggaaccagacagcagccgtctgtctgtctcattggggacagcaccaagccttgtgtttgggggctgacacttggggtggccagtgtgggtgggaccaggcctcagtatcgtctcttcctaggccaagtccaggggcgtggaggccgcccgggagcggatgttcaatggtgagaagatcaactacaccgaggtgagcaggccccacataccctctggggcctccttccttccctttggggtttatctgactgttagccgcatcaccctgtgtcttcaccccttctcttgggcaatgcttttgcttaatgaggggcctgaaggcctttttcctcctgcttgtagcagggctttggggtgtgccttccacaagattggtttggtgagctccttggaatggttcccagtgtctgcctgggaggagcatatctcatacccacagggagagtttctcaaggctgacattttcttggagaagttaactctaatatatcctcaatgcaagttttagtagcgacaagaagaatcttagatcaccaaagacttcagcctactcaagcagtaggagtcaataggaagcagtggtgaggccaggcctgggggcccctgttcctgactcagtatgggagcccagcctggaggtataatggacactgagcacccagactctgtcctcatgatgtcattatcctcctcttacatgtgaggagtctgaggttcagaggtcacatcacttatctaagatgtcatagctgtaagaggcagaatggagattcacactcaacctgtcttgcattgtgggtctaagctgagagaggatgcaatcaaggaaggctttctggaggagtgcatttgccaataaaatgtggcgcaggagtggggtctggcagggtgagggtggggtggcatgaagccctccaccttagcaagcctctcactgggtcggaatcccaagatgatccttttcctgcccacctggggtcgttagaccttccctcaaggactcctctgctgacttcaggccatttcactcacgtggctgggccagccgcctggcacccgtcacagacttcaagtctggtttggttcctggcagttggtagttatcgggctgcttggtgagggaagcttgagttgcatgccttgctgcaaatccaaggagctgaggacactgcctaaaacgtgccagcaaacaccatggacacacattgggaggatgaggttacttcaggcttcatgagcactcatcttcggaaagcgtttatttatttatttattttgagatggagtcttgctctgtcgcccaggctggagtgcagtggtgcgatcttggctcactgcaacctctgtctaatgggttcaggcgattctctgcctcagattcctgagtagctggaactacaggtgtgtgccacccccacctggctgatttttgtatttttagtagagacaggatgtcaccatgttggccaggctggtctcgaattcatgacctcaagttatccacctgccatggcctcccagagttccgggattacaggcgtgagccatggcgcccggcctctgaaagcatttattgcttgtttctgacatgtattgttgccattctctgcctttgctcactgttcctcttttctctcactgttcatgccctgagcatctctggcaggccttcggggcctgtcctaggcatatatgggtcccctcctctcctcctgactgtctgcagcacataagtccttggggagctcctactcctctaagcatacagtgggttcttggaacaaggttatggtgctaacagagacctcagggcctgcctgtctagtggatagagggccgagctatggcaccatgcccagctgggagcatggctgcctggggttgggggggacagtctttatatcctgaccgtaatccccagggtcgagccgtgctgcacgtggctctgcggaaccggtcaaacacacccatcctggtagacggcaaggatgtgatgccagaggtcaacaaggttctggacaagatgaagtctttctgccaggtaagtggctactgggccggactcacccttggccgtgtgtgtgagttatttgggaatctgggagccctaaggggcagctcttccctcttcttgtaggcaggactcaggttctcactgcagcttaagggaggggttgcctgtgtgatcgctgaccctggagtctctgctgaggcctgaatttctcctggctctgctctgaaggaatctgctgctggcagaagtggggccagtttctttcctgaattgtagacacctatggactcatggtgacaaaccacagaggcttcaaatgaaaagtggggcccctgagagacaggacagtcaggaaaggaaggagctttttcttttttctttttttttttttgagatggagtctcactctctcgcccagagtggactgcagtcgtgctatctcagctcactgcaacttccgcctcctggattcaagctattctcctacctcagcctcccgagtagctggaattacaattatgcgccaccctgctcagctaatttttgtatttttagtagagacgggatttcaccatgttggccaggctggtctcaaacccctgacctcaggtgatctgcctgcctcacctgggattacaggcatgagccactgcgcctggccggaaggagctttttctaatctcttttgtcatacgcccttatcacccagtctagaaacagataaaacattgtaaaatttcctcaaccctggctgggcgcgatggctcatgcctgtgattcctgaactttgagaggccggggtgggtggatcacttgaggtaaggagttcgagaccagcctggccatcatggtgaaaccccatctccactaaaaatacaaaaattagccagttttggtgacatacgcctgcaatcccagctacttgggagactgaggcaggagaatcgcttgaacccgtgcggcagaggttgcagtgagctgcgattgcgccactgcactccagcctgggcgacagagggagactctgtcaaaaaaaaaaaaaaatttcctcatccccattcccagctaaccctccagaagcagcctttgtaaagtttcctgtagccaggcgcagcagctcatacctctattcccaactattcaggaggctgaggtgggaggatggcttgagcctgggaagttgaggctgcagtgagccatggtgacaccactgcactgcagcctgggcgacagcaagatcgtgtctctaaataaatttaaaaaatagaaaagttttcctgtgaagtcttccagaaagttcctgtgcacatacacatctgtcatctcctctttgaaacacgtacacatgtgcacatgcacacaggttggttttctccctgctcctctgaagcttatttccacctggaagtatgtaagcagtgtccgtgtgtcagtgacagtgcatgtaacatgccttcttttccttgtgtgtagggtggtaggggttgcctcagagaccagctaagtttccccacatcaagcacttgcctcagtgtctaccctagcggtgattctgcaggggtgggttggcagacatcctcacgtctggagaacgagggtgatgccggtgtgcctgtgtgggctgtgcatgctacgagggtgatcgtccaaactcttgtcagctgtgatcatttgctgcttgtcctaggagcagtggcctccatgtgtggctggtcagagtccagttactttggccaagagccactttcagacctgaaaatgggctgggtgcagtggctcacgcctgtaatcccagcactctgggaggctgaggcaggtggatcatgtgaggtcgggagtttgagatcagcctgatcaacatggtgaaacgccgtctgtactaaaaatacaaaaaaattacctgggcgggcatggtggcgagcacctgtaatatcagctactggggaggctgaggcaggagaatctcttgaacccgggaggcagaggttgcagtgagccaagatcacgctactgcactccagcctgggtgacagagtgaggctctgtctcaaaaaaaaaaaaccaacaaaaaaaccaacccatctctggaaaaaataaataaatcagctaggtgtggtggtgtatcccagctacttgggaggctggggtgggaggattgcttgagcccgggaggttgagtctgtactgagctgagattgtgccactgtcctccagctcaggtgacagagtgagacgcctccagggcaaggaagttgtggggtcctgatgggaatctggatttcctgaatgtcacttagggtgatcagtccatgtgatggtctttgggtgtgtggcggggcctttccagccatctgctgtgagtggcagagctgaagtgcattaaaagcctagtgctgtgtgatcagtctgggtgtgctcagccatgccacatggcgaggatggcactgcaccgtctggggtgctgtttccaggaaagccttcccttaaagctggccactggagtacctgactcaggctgataaggtatttatagttcaaaaaaagttgctgaatggcagtaatcccctggtgaggaacattccccatggctgtgctctccaaagtttgccaagattgggtgaagacgttcactgtgaccttgattgtagtggcaaaacctgaaaccaagctgtactcatttgtcaggggacttacaaagtagagtcagcacatattcatatactgtcatcctgggcaccaatagggattagggagctatagttggattgatctgccatgctgttcaggatggactgggaagttgaaaaaggaagttgcagaattggtgggtatggtaaagactcatttggtcaaatgaaggctgggtgtaattgtaataaagatagacacatttggcttggtgcagtggctcacacctgtaatcccagcaccttgggaggccgaggtgggtggatcacgaggtcaggagttcaagacaagcctggccaacataatgaaaccccatctctactaaaaaaaaatacaaaaaagttagcctggcatggtggtgcatgcctgtagtcccagctactcgggaggctgaggcaggagaatcacttgaaccccagaggtggaggttgcagtgagccaagatcacgccactgcactccagcttgggcaacagagtgagactttgtctcaaaaagaaaaaaaaaaagacacatttttcctctgggatgcttcattataacaaacctttgacagtcgggaaaggagacttgcttttttttttttgagacagagtcttactctgttgcccaggctggagtgcaatggcgagttctcggctcactgcaacctccgcctcccaggttcaagcaattctcctgcctcagcctcctgagtagctgggattacaggcatccgccaccacacccagctaatttttgtatttttagtagagatgaggtttcaccatgttggtcaggctggtctcgaactcctgacctcaggtgatccacccaccttggcctcccagagtcctgggattacaggcatgagccaccacacccagccaagacttgctttttctaacctcttttgtcacacgcctgtgagggagggttgagaagttgaacaacttattttatttctttctgtattgatggaaattttcccatggcagtttatttaaagaaaaagtagggccaggcacagttgctcacatctgtaatcccagcactttgggaggcagaggcaagaggattgcttgaggccaggagtataataccagcctgggcaacataacaagaccctgcctttaacaaaaatttaaaaattagccagctgtggtggtgtgtacctatagtcctggctgcttaggaggctgaggcgggagaattgcttgagcccaggaatttgaagctgcagtgagctatgatcatactcctacattccaggtcgagcaacagagcgagaccctgtcgttaaaacaaaactaaaaaatacccagcaaggtgcagtggctcttgtataatcccagcattttggaagggtgaatcggatcactgcaggccaggagttcaagactagcttgggcaacctagaccctgtctcttttttgtttgtttgttttttgagacagagtctctctctttcacccaggctggagtgcaatggcctgatctcggttcactgcaacctccgcctcccaggttcaagcgattctcctgcctcagcctcccgagtagctgggattacaggtacctgccaccacacccagctaatttttgtgtttttagtagagatggagtttcaccatgttggctaggctggtctcgaactcctgacttcataatctgaccacctcagcctcccaaagtgctgggattataggcgtgagccaccgtgcccagcctattttttttttttaattaaaaaataatttatagtctgggtgctgtggctcacacctgtagtcctagcactttgggaggccgaggtgggcggatcacttcaggtcaggagtttgagaccagcctggcctacatggcaaaacccgtctctactaaaaatacaaacaaaattagccaggagtagtggcaggcgcccataattccagctactcaggagactgaggcagcagtatcatttgaacccatgaggtggaggttactgagagctgagatggcgccactgcactccagcctgggtgacagagcgagactctgtctcaaaaaaaaaaaaaaaatttataactgggcatggtggtgcatgccggtagtcccagttacttgggaggctgaggcaggagaatcgcttgaacccgggaggtggaggtttcagtaagctgagatagcaccactgcatgccagcctgggtgacagagcaagattccatctccaaaaaaaaaaaaaaaaaaattaaaagaaaattgctggatcttattagtgtatagtaattttttattgatgtgtgggaaattattccaaaatttagcaactagaagcaacaatcaccgtctctttatgtggggaatttgcagtggctgtgtttggtgtagtggctctgatattctaaggttgcagtcaagatgttggctaaggatgtggtcatttgaaggcttcatgggggttggagggtctgctttgaagatggctcactagcagtgctgcctttgggaggcacagacagttcgagtgtcctcatgacaaggcagcttatttctcccagagtgagtgatccaatagagagtaaggcagatgcctggaggtcttttgtgacctaatatcaggattcacattctttcttttttttatttttatttttttgagacagagtttcactcttgtcacccaggccagagtacaatggcgtgatcttggctcactgcaacctccggtccccggctcaagcgattctcctgccttagcctcctgagtagctgggattacaggtgcccgccaccatgcccgcctttttttttttttttttttttttaaatttttttagtagagatggggtttcaccattttggccaggctggtcttgaactcctgatctcaagtgatccgcctgccttgccctcccaaaatgctgggattacagggtgaaccaccacgcccggctacactctttgatttctataataccccgttggtgttacagatcagctctggtcatcatgggaagggactgcatcagtgggttaatgccaggagacaaggaccactggtcaccatcttagaaggtgggggactatcatagtcccgcttctggcgcctagtgattgattttgttccttccacacacagataccccactcactttctcctaagtccatattctgttacagtattagaagtctgttagaagtctagaacctcattttgtcaagtacaggtgtagtagtacctgcatttcctttagtacagttcctttcaatctgaagacatgagaatttaaagagacaaattacccctcacacacccaacatacaatggtgaggtgggcatgggatgactggtatgtatgggataattatttcttttcttttctttcttttttctttttttctttgttttttttttttttgaggtagggtctcacactgtcgcccaggctggagtgcagtggtgcagtcactgctcactgcagcctcgaactcctgggctcaagcaattccccacctcaaccttctaagttgctgggactacaggcacatgtcaccatgcctggctacttttttattttttgtagagatgacgtcttgctatgttgcccaggctagttttaaactcttggcctcaagtgatcctcctgcctcagtttcccagtaagtgctgggattataggcatgagccactgagtccggcctgcatatttaggtttttattatgaccacactgtacttctgataccaaaatctgtattagttatctatcattgtataacaaatgacatcaaaacttgggttaaaacagcaatacactttttttttttttttttaagacggagtcttgctctgtcgcccaggctagagtgcaatggcgtgatctccactcactgcaacctctgcctcctggatttaagcaattctcctgcctcagcctcccgagtagctgagattacaggcacacgccaccatgcctggataatttttgtattttttttttttagcagagacggggtttcaccatgttgactaggctggtctcgaactcctgaccttgtgatctgcctgccttggtctcccaaagtgccaggattacaggtgtgagccaccatgcccggcctagcagtaaacttttattacctctcacagtgtctgtgggtcagaagtttgggagcggcttagctggttggtcttggtttggggatctctcataaggctgtagtcaacatgttggccagcgccccagttatcggaagttttgatgggtttggaggacccccctctaaagtgtcccatacacaggaagcgagttggctgtgacttttggaaaaaggccttagttcgctgccgcgtgggcttctttatgaaactgtttgaatgtcttcacaacatgatagacagcttccccaaagcgagtcatccaagagagcaaagcagaaactgcacgttctctgaactcacttctgaagtcacatttcacccctttttgcagtctctggatgggtgcataggtcacccctcccagcacaggcggaagctatgcagaggcatgaattccaggaagcaaggatcactggtgtctgattggagactggctgcgggtctgatactcctttccccagcatagcccagtcacagttttcaacatttcacatctcttggtctctggcatagcagattctgccgagttatccctggttttgcaaattctgacagtgtcgctgtaaggtagggatgtctcactgttgtaaccaggaaagagtctagttggtggtgagtgtggcagggaccactgtggtctccagagactcctatgccttgtgtagtggctcacgcctgtaatcccaacactttgggaggtcaagatgggaggattatttgaggccaggagttagagaccaggctgggcaacgtagcaagacgctgtctctacaaaaaataaaataggctttgcgtggtggctcatgcctgtaatccaagcgctttgggaggccgaggcaggtggatcacctgaggtcaggagtttgagaccagcgtggccaacacggcgaaaccccatctctactggaaatactaaaaattagctgggcagggtggcaggtgcctgtaatcccagctacttgggaggctgaggcaggagaattgcttgaaccctggagcctggaggcggaggctgcagtgagctgagatcgtgccgttgtactccagcctgggcgacggagtgagaccctgtctcaaaaaaaaaaaaaaaaaaggctaaagcagagcattttgttctgtttttggagtcagggtcttcctctgtcacctaggctggaggtgcagtgttgcgatcttggcttgctgcagcctcaacttcctgaactcaagcaatcctcctgtctcagccttgagccaccctgcctggcccctaaggcacagttttaaaaataagtaaatagcgaggcgcggtggctcacacctgtaattccagcactttgggaggccgagctgggcagatcacttgaggccagtaattcgagaccagcctggccaacatggcaaaacctcgtccctactaaaaatacaaaaaaattagctaggcatgctggtggcgcaggcttgtagtcccagctactcaggagactgaggcatgagaattgttagaacccagaaagtggagactctgtctcaaaaaaaaaattaaaaataaatagctgggtgcggtggctcaagccagtaatcccagcactttgggaggctgaggcgggcagatcacagggtcaggagatcgagaccatcctggctaacacggtgaaaccctgtctctactaaaaatacaaaaaactagctgggtgtggtggcgggcgcctgtagtcccagctactcaggaggctgaggcaggagaatgacgtgaacctgggaggcagagattgcagggagccgagatcatgccactgcactccagcctgggcaacagagcaaggcttcatctcaaaaaaaaaaaaaaaaaaaaaaaaaaaaaaaaaaaatatatatatatatatatatatggtaaattaaaaacaaaaaaatagaggcacctgcgagggcctgaaagctgggactgaggtaccaggacacggcagtaatgatgtttttgagcagcggattatgcctgggggtttgggctgatggcatcttcgcccctgtgccagcgtgtccggagcggtgactggaaggggtacacaggcaagaccatcacggacgtcatcaacattggcattggcggctccgacctggtgaggagaaaactgccttggggtagggtgggagtctgggcactgttggtcccactcaggtctttactttctccagggatgggacctggctgtctccacttttcgtgggccctgaattcttattctctgatgctatgtctccccgcaggggcccctcatggtgactgaagcccttaagccatactcttcaggaggtccccgcgtctggtatgtctccaacattgatggaactcacattgccaaaaccctggcccagctgaaccccgagtcctccctgttcatcattgcctccaaggtatgagtgccgaaaactgcccggcccctggccctgtgtgtgttggggtggggagggacagctgtcttgccatccccctggccattggtcccttttggtgggttccgagtgaaccatggtttgtggatcaggtcagtacagctgccctagactgtttccatgcctagcagcaaataaggttgactgatgaaatcctgaacacatcagtttgaacctttgtgtcctgaccacacccgctcgccttgcggcatctctgctcagcctgggactgctcgccactttcttacaaacctgtcctttatgcctgctccttttcttgttgttgtttttgagacagagtctggctctgtcacccaggctggagtgtagtggcgtgatctcggctcactgcaatctccgtctcccaggtttcaagcgattctcctgcctcagcctcccaagtagctgggactaggcacacaccaccacgcctggctaattttattatttatttatttattattattattttttagtagagatgggcttttgccatgttggccatgctggtcttgaactcctgacctcaggtgatgcacccccccttggcctcccaaagtgctgggattacagtcttgagccgccatgcccagccatgcttgctcctttctgatcccagagccatgccctgataatagaggggttttgtttgtttttatttatgttctatttactcacatgaatgtacataaaatatgaagaattccatctgaattctgagataccttccagcctgggccgaagagagcctcaggttgactgcagcccctcaggggagaagctgcggcctttgacctgcaggcttagggttggggggtgtgtttaccgtcccccctcctctggttttaaagagctggaatctcaggaggttatgtggcgtcactgtcactgacctgcaaatactgctccatgggacagctgggcattgccttggcctctactgctgaaccctggctcaaggcctgcacccacccctaagctcgggcgcccactgctgttctctttggttgcagacctttactacccaggagaccatcacgaatgcagagacggcgaaggagtggtttctccaggcggccaaggatgtgagtgggctatagggccttcctcgtggttagcctctgggctgggaagagcagggtgggcccctgagtgaccaagtctggccgtgtttctcctgaagttggaagtgaaggcggccttgccggtgcctgcctttgctagatgagatgattgttcatcttggctttgtcagacccagccttgcagatgtgacagaacctgctctcgctggctgacagcccttgcatggccctttctctgcaggcccttggcgctgcaggaactcttggccacacctattttataggggagggacgtccctgagccccgtatgcttgtaagatgggatgagcaggcggcctgtgacccgtctgctttcttgaccttgacctcgatgtgggccttctccaacagtctcagaaccaaggactgggaatctcagtcccatgcagggccttggttcctctagtgatgggaagtgactaccctttgtctccctgggctggctgtggtaacttggctctgtctcttgtagccttctgcagtggcgaagcactttgttgccctgtctactaacacagtaagtgcccccgtggtcccctgtactgccttcctgggagtgcccagcatgtccaggtcatggcctctcagagacgcggttcgtaggtctggtggatcttggcttggctgatggtatggaaggtttggttgcctgtgggctgcaagccttccttgccttttccgcatttacccattcaacctctgcagctttgaggagggaggcttggagtcagtgggatcacgataaccccttcttccgtctcccaggcctgactgatacacagaacccttcatacacatgaccttcctaggcctttgtgcccagcatctccccaaatgtgacatgctaggtaggggtagaggatgcattccatttttcacttaaggacataaagccccaatgaagggaggtgacattttgccccctacttagtgtgtgtggttttgttttttttttttttttttttttttttaagacagtctcactctgttgcccaggctggagtgcagtggcgtgatcttggctcactgcaacctctgccttccaggttcaagcgattctcctgccttagcctcccgagtagctgggattacaggtgcacgccaccatgcccagctattttcgtatttttagtagagacggggtttcaccacgttggccaggctggtctctgactcctgaccttaagtgatctgcccacctcagcctcccaaagtgctgggattacaggtgtgtgccaccatgtccagcttattttttgagacaaggtcactctgtcactcaggctagagtgcagtggtacgatcttggctcactgcaacctctgccttctgggttcaagtaatttttatgcctcagcctgctgattctgggattacaggcgcccactaccacgtccaggtaatttttgtatttttggtagagacaggttttctccatggtggccaggctggtctcgaattcttgacctcaagtgatctgcccacctcggcctaccaaagtgttgggattataggcatgagccactgtacccggcccacttagtgactgtatgagtaggtgatgccaggattagaacctgggtctcctgtctccaagttctcacagtctgcctggcctcgaggttgtgcaggctcagcagggcatgacagagtgagggatgctccaggagtgacagcagcagtcagccagtgggcactgtgctgtgtcagagctggggactacacccacatctccctcccaccccctccaccatcatccccacatctctgcctccagtgcctacccagctgcagcaggacgccataaggctggctaaccatagcactgttgcctgcctgcaactgactggtcagtagggcttctcctcctatgtggaataggtaaggaattgctggccctgtctgccctggggaccagaatacctgatggctcctcagagcttcctggtgcagtcaccctcccacacatgggaagggctgggtggctgttcagcctgtgtttgtttgcctggcctggtaggtggcccctgcccacacttgggtcccagtcctaggttcggttcccagatgtccaggggtatcatgctctggtgtcccaggcaggcctgggtgagagctgttgcagagcagtgtgtgggccaggtcctcacacggggttacagctgccctcagcagggggctttgcaggcacaacgtcactggcgtgctggtcatggactgatctggtgtccagcttggggtgggcagatcctgggccctgccctcgactcacaggctgctccagccctgccccatccctggctctggggaaggtgaggctcagctcacggagcacagctccctgcctcccggagctcctgttcccatcccgctagcaaatgcttctttgcatttctctccctttgtttttttttttgtagaccaaagtgaaggagtttggaattgaccctcaaaacatgttcgagttctgggatgtaagtacaagcacttctgcactgggtgaattaagtgtcctttgccaagtcatggctgttgagaggcccatgaggtcaggtcagtgtttattgagtacctgctgcatacctagcttggggaaaggtagagaggccctcagagaggcttggagggcaagagcaacccaggcaggatgagggctccacttccacctgagggcgggctgagcttgcagggccacatgacactcccttgggtgcctgcctgcaacacccactgtggggtaacccgagtcccccttgccacgctcacagagttgaggttgtgagttattctcagtgatgacctttctctgaactgcagccaccatctgtaaaggccaagggcagggtgaggcatgaggtatgaccgggtaggcctggaaaggagcaacaggagctgcaggaggagctgggggggtggcgtagaggaggcgccaggctggggcagcttgcagagcaaaccctgccttgagtgacagggctgccgacccctctgtagcaacaggtggtccatgggaccacctctgctggagccgagcagtgagccacagctttccttgtgcacttgcctgagctcagcagtggtgtgaggagggctctgactgtgaagcccagggtgcaggggtgcagtgcagggtgtgatgcaggcactgtgaatgctgtgggcatggccgggcttacgtgcagggctctaacgctgtggcaggcgcagcagagagggcattgcccatttggtggttttcccacctggggctgtctccaggcatttggaccagaggccctttgcttggtgatggcatccacagacataacctcattcctttgaaagctctaaaggccttttactaccagggtctgggagagaatgaagccctaatcccttaagccatccactgtgtataatgagttaacttctttctagaatgagactagttacataccatccttggaagaattgacgagaatcactcaagtcattttctgcatcctgtggctcagatgcggaacactggtcaagagagactgtgcggcttctaataaatgttgcatggctgataatggagggcaggcaccttccacctcctccttgggatctggagcctgagcaggtggtgggcagggatgtgtgggtgctgctgccagccaaggagccaagcagatcggggtgtccttgcttgtcaccacccagcatgtagagatgagttagggtgtggcttaaggagaggatgggtctggcctcccaggtaaggcctaggaatgatagctggacacaggaacatggggccagggctggctggtgagacctaagtggaggcctcctgggccaggctagacagcccacaacggctggaggagggacctgcctgagttactagagtgtatcctgctgaatcaagaaggtgatatctgaagaacccagggataggagcaggcgaagttcctgcaggtggggtctcgggtgagctacagccatcagctcaggcctagggatgcagtgccggccctcaggtgagatcagaagagtcccgtctggtaggggtatgtagaagaggtaattcttggtccgccagggccagttttgcggcagccatgggtgtcgggatcaggcaggggtgtggtgggaaaccatggggtctctcagggctcggccagggtcagcgcacgccacagggccagttttggctggagaggcctgaagcagagccagagcaggtccaggtgagttctgaagaggagccaggacaggagagggacccataggtctgtgaattccagaggagaggcaggtatttagaggtggttctgtcaggtgaagtctgaggagccaaagctatgtatgtgcatatgtcagccgggctctgtgggaggtggtgtagacctatggcatgggacaggtgtgcacgctgggatctctggccggttccgaaaagtgaggatcaggtagtgggtggctgattgcacaagtttagaacccaggattagggacacacaggtcagcacctgcttctcagcatcctgactgggtgtgatgggcagagctcagggcgtcagaggcctctgagaatttgtgactgaagtccaagtctgtggcatcagggtctgcagagcccagatgcgggagaggtaggaatgtacctggtgatatgaggcaaggacaggggagctggggcaggtgaggcaggcaggtggcatgaggagctgtgctgggtgggtgcggtctgagtggctcaggttgggtaaagggccagagacctgggtctacagggcagacatcaaggctgagccagtcagacagtgtttgtcaacactgggctctcaccaggctccctcaggccgaggtcagcagccagggatctgtcatgtgtgaggaaagtgtctgttcaggttaggtgtgtataatgcagcctttcagagccgcgtctgtctgaggtcctaggagctggaatcagacaggtttgtatggctgggtttctaggggaggcctgaggagccaagactgtactcaggtaggcagaactggaccagtctggtaaggacgttggagctaaagataggcagacaggtcgagctgggtctgacaagtgagggctgaaaatctgtgattgggtccaggttggagctgtgtccttgggcgatgtctgagcagctctggtgggtgagcctgggtcccctgggaagagaccagacaaagggatggggtcagacaaagggatgacgaaccgcatccatcagaaaggtggatgaagcctgggtctggtcgaggtacgtagagcagatctagcaggcgaggtttcaggggttaaggtgagacacaggtatgtatttttgggtctcacaggttaaggtctgagccactgaggtcaggctctggtttgtatcccaagaccgagaagctgtgttaagcatggtgggtagagtttgtcaggtgacatctatgaaaccaggagcatgcaaagataggttgaccggaacagccatggtcaaaccaattaaactgtcctgcagttgaggtcaggcacaggtagaacggatctatcaggtgaggcccaaggagtccggattaggctcatctagaaagacctggatgtggtagatgacctctgaggatatgaagtgaaggcaggtggatagagccaggtctctcaggaggtctgaggagctgggatctggcacagtgagcaggtctggatttcccaggtggtgtcaagacagatgggtaggccaggcacagtggctcacacctataatcccagcaatttggaaggccaaggcaggcagatcagttgaagtcaagagctcgagaccagcctggccagcatagcgaaaccccgtctctactaaaactacaaaaattagccaggcatggtggtgcatgcctacagtcctagctacttgggaggctgaggcaccagaattgcttgaactggggaggcagagtgagccaagatggtgctactgcactccagcctgggtgacagtgagactatctccaaaaaaaaaaaaaaaaaaaagcgggggttgggtgtggtggctcatgcctgtaatcccagcactttgggaggccaaggtgggtggatcatctgaggtcaggagttcaagaccagcctggccaacatggtgacggggtgaaaccccatttctactaaaaaatacaaaaattagctgggtgtggtggcacacgcctgtaatcccagctactcaggaggctgaggcaggagaattgcttgaacccgggaggtggggtttgcagtgagccgagatcatgccactgcactccaacttgggcaacaagagtgaaactttgtctcaaacaaaaaccaaaaaaaaaaaaaaagaaaaaagatgggtgggtagaagttcttctcctgggtgaggttgaggagctgtggccaggtacaggtatgtaggtatgtggaattgagtttcttgggtgaggtctttggagcctggcccaggtacatcttcgggtctatcaggtctgaagaacgggagttaaacacaggtgtgtagaacagggtttggcaggtaaggtctttggagccaggatcagggcagcttcacaaagctgagtgtgttcatgagacctaaaaagtcatagtcaagcccaggtaagaagaaccaagtgtgttggatgaggtgtaagcagctgaggtgtgaagtagaggtaggcagagctggcccacaaggtacaagctcaggaaccctcatcacatgcaggtagggggtgctggtccaccaggcacaagcccaggagccagcattgagcacaggtaggcagacttggcccaccaagtatgatctgaagagccaacatcaggctcaggtaggtagatctggcatgccaggtgtactccaaagagccagagtcaaacacaggtaggtagagatagtctttcaggtgtggtttaaggagccaaggtcaactacaggtaggtagagctggcccactgggtgtggtttgaggagccagggtaagcacaggtaggcaaagctggcccaccaggtatggtctgaggagccagggtcagactcaggtaggtagagctgcctgccaggtatggtctgaagagccaggatcaagtacaggtaggtagtctgggtcactaggtgtggtctgagaacccagcgaaaagctcaggtaggtagagatagcctttcaggtgtggtctgagaacccagggtcaagcacaggtatgtagagatagcctttcaggtgtggtctgagaacccaggttcaagcacaggtaggtagagatagcctttcacgtgtggtctgagaacccaggttcaagcacaggtaggtagagatagcctttcaggtgtggtctgagaacccagggtcaagcacaggtaggcagagctggcccaccatgtgtggtctgaggagccagggtcaggcaggtagacaaaactggtctgccaggagtagtctcttgaaggagagctgaggagttaggttgaatgcaggtagatagagttggctctttcaggagttggattcaggcacaggaatgtgcccctgggtgtttgaggtgaagcctgaagaaccagagttgagcctaggtgtatagagcggcctcccaggtcaaccccatagcatgggggtctctacaggcaggcagaacattgtgggtttcctaggaggtctgtggcccctaagttagacgtgggtaggtagatgtatctctctcaagcaaggactttgtagctagagagacatacagctggggtcttgcaggtgaggtcattggtgcgtggttctggcttagttgtgctgactcagtcttaggcctggggacagtgggttagtcacaagttggtagaactacgcatctcagctggggagcacaggtaggcagagatgttccatttgatgaggtctgaggctcctcagtgagctcattggtgctgacgttaagcagagattggcagcattggatctgtctgtgagacatgaaaagccaagccagacacaggatgtggactgccgaggccaggctcacataaataaagctggaccctgggaggctgtaaggaatctgagttgggcttaggcaagggaaccgggtctgtcagtcaaggtgtgaggggtcaggttatgtgaagcctggtctatcagctgagatgtctggaacccatctttgacaggtatataactctgtagcctgaggcactggagttggacacaaataggcagaactaggtctcccaggtgaaaccattgcatcgatgctcagtgctggtatgtttatctggtgttgtcagtgagtctgccgatgcaggctcagtgctggtatgtttacctgattatgtcagtgagtctgtggatccaggctcagtgctggtatatttacttggttgtgtcagtgagtctacggatccaggctcaatggtggtatgtttacctggtgttgtcgtgagtctgtggatccaggctcagtgctggcatgttgacctggtgttgtcagtgagtctgtggatccagggtcagtgctggtatgtttagctgacattggcagtgagtccatggatccaggctcagtgctggtatgttgacctggtgttgtcagtgagtctgtggatccaggctcagtgctggtatgttgacctagcattggcactgagtctgtggattcaggctcagtgctggtatgttgacctgacattagcagtgagtctgtggatccaggctcagttccacagaggttgtataaacatggtctcaggtgggttcttgacacctgggttcaagcacaaaagtactgctgggcttgttaggtgaagtgggtggggtctagcacaggaatgcataatggtgaggctggccaggcctggggaaggtgggtcagacacaggtgagaccttcggtggtagggtcagacacaattaggtgagtagtgtgggctcttatatcaagggaaagccgtagtcattgtaggtgtttgtacctgggtctgcctggtgatgtctagggaaccctaaagatcagctgggacaggtatctgttctcagcaccctggtcaggtatgatagacagagctcagggtaatacagagggctgaggatctgtaaccagtccatggtgttggtctgcatccaagatggcattgtgctccagttgacacagggtctgagttaaaagtgaggaaagttgccaggcgcagtggctcacgcctgtcatcccagcactttgggaggccgaggtgggtggatcacttgaggtcaggagtttgagaccagtctggtcaacacggtgaaaccccatctcctaaaaatacaaaaattagccatgcatggtggcacatgtctgtaatcccagttactcaggaggctgaggcaggagaattgcttgaacctggcaggcagaggttgcagtgagctgagatcatgccactacactcaggcctgggcgacagagtgagagaccctgtctcaaaaaaaaagaaagtgagtaaagtgaggaaaaaggtagatgatggttagataaggtgagatctggggcactggggcaggttaggcccaggacattgaactgactgaggagctgcatctataatgtatggtctcagaggccactgcacttaaaggtgaggtctagagacccatgtctgcagattgagggttcggaggctcaggtcagacactgcttggcattgctgggctgtcacaaaactgggatctgaggacctgttctcggccaaggtgagcagcctggactctgtcagccagagggctggctgtgtgctgaagtttagtttctagagctgagtctgggctgggtgtggtggctcatggctgtaatccctgagcttcgggaggctgagatgggaggctgaggccaggtgttcaaaacctgcctggacaacagagcaagaccccatctctacaaaaaatttaaaaaatagtcaagcatggtggtgtgtgcctgtagtcccagctactggggaggctgagatgggaggatcacttgagcccaggagtttgaggctgcggtgagctgtgatcatgccactgcactccacctgggcaacagagcaagaccctgtctcttaaaaaaaaaagaaaaaaatagaactgcatctgttagatgagatgtgagagcctatgtcaagcatgatgtagtctgtaggactgcgtctgtcaggtaaggttcccggaaacccagagcctttccaagtgagtggccccaccggtcatctcattgcccaagccagaaacctctcggccacactggagagctcccagaatgagtcctctgcactccccagtccatctccggggcttcaaagtggcttgtttgcttctgtccttgtcttagccgcagactgttctcagtcctcccaccgtgcctctcagcttccaccctgcggtccccaccccttcctttatcctctggaaggtgctatgcttccccctgcctcagtgggcttccaggagagaattaagccctcacagcccaaggcatctactggatgtaataagtgggcacctctccttcgtgtctagaaggttactagtcttggaccatccttgggagaactgagaagtcactcagatcattttctgtgggccttaattctgtcacgcttgagaaagactgctttggccacgggacctttgcatgtgctgttatggctgctggaatgctccctcagtgcttctctgggtcatgcctgctcgttcttgagatcaagggtcaagtacccctcaggttccttttataagtggcctcagcaccatgttccaatttctcctcagcacttgtttctcagtttcacatttattggcatgattatttgatgtacgtctctctcccacactctgtgtccgttgcctgtgctagaaatgtgggaggtgctccataaacagctgttaggaagacatccgtgaagttctgaggactctgatggcaccaagtggagcttgcaggtgtggcttgagaaggtgcagtgtgaatgataggcctaggtgataggccgagaagatcggtcaagcccagatatgacccactgggcctgtcagtgtccaggaggtggggtgaggcacaggtctaaggttctggatctgtcagtaccacctgaggagttgggaatgggcacaggtacaaagtgatgagtcttcattgttcaacaaagaatggcacaggtgtgaggatctgggtttgtcagtatctgaggatgtggggcctggcacaagtatgaggcactgggccactgttcaagcaggtgggctggggaacagaaatgtagctgtgggtttttaatatctgaggagacctagccaagtgtagcagagagctgctgggtctttcattgtccaaggaagcatacctgggcacaagtatgagactgagaaggtgggtcctggcaccggtaaggggctctgggtctgcaagtgtctatggaagtagggcctggtacaggtatgtggtgctggaagaggtatccaaggaggtgggctaagtacaggtatgacatctgggtcttccagtgtgtgaggaggtaggatctggtacaagtatgaggccctgggtctgctggtgtctgaggagataacagcaggttacaggtatgaggccctgggtctgctggtgtctgaggaggtaacatctagtacaggtatgaaatctgggtcttcctgtgtctgagaaggtagcacctggcacaggtatgaggatctgggtcttcccaatgtttgaggaggtagcatctggcacaggtatgaggatatgggtcttccatgtctgaggaggtagcacctggcacaggtatgagaatctgggtcttccagtgtctgaggaggtagcacctggcacaggtatgagtatctgggtcttcccgtgtctgaggaggtagcacctggcacaggtatgaggatctgggtcttcctgtgtctgaggaggtagcacctggcacaggtatgaggatctgggtcttcccgtgtctgagtaggtagcacctggcacaggtatgaggatatgggtcttccatgtctgaggaggtagcacctggcacagatatgaggatctgcgtcttccagtgtttgaggaggtgagtttggactcaggtttgaggcccttgggcttccagtgcctgaggagatagcatctggcacaggtatgaagccctgagtcttctagtgtctggggaagtgaggctgggtacaagtatgaggatctgtgtccatcagtatctgaggaggtgggatcgggtcctggtatgaggatctgggtctgtccatgtctaaggaggtaagatctggccctggtatgaggatctaggactgtccatgtctgaggagttaccatctggtacaggaatgaggatctgggtctgtcaatatcagaggaggtaggaatctggtacaggtatgaggatctgcgtctgtcaaagtctgaggagttaccatctggtacaggaatgaggagatgtgtcttccagtgacttaggaggtacgatctcttataggtatgaggatctgggtctgtcaatgtctgaggaggtaggatctggccctggtatgagaatccgggtctgtccatgtctgagcaggtaggatgtgtccctggtatgaggatccgggtctgtcaatttctgaagaggtgggaatttggtacatgtatgaggatctgggtctgtcagtatctgaggaggtaggatctggtacagttgtgaggatctgggtcttcgggtgtctgaggaggtggcatttggcacaggtatgagaatctggatcttctagtgtctgaggaggtgggatctggtattaattatgagaatctggttctgtcagtgactgaggaggtaggatctggcataagcatgaggatctgggtctgtcaatgtctgaggaggcagtatctggtacaggtatgaggatctgggtctgtcatgtctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggcatctggtacaggtatgaggatctgggtctctccatgtgtgagcaaggtagaaatctggtacagatacaaggatctgggtctgttcatgtaggatcatgtctgaggaggtaggatttgatgcaggtattaggatctgggtctgtccatgtctgaggaggtgggatctggcacaaatagaaggatctggatctgtcaatgtctgagaaggtagtatctggccctggtatgatgatctgggtctttcagtatctgaggaggtaggaatctagtagaggtacgaggatcagggtctctctatgtctgtggaggtaggaatctgttacaggcatgaggatctgtgtctgtcagggttggaggcggtaggaatctggtacacatatgatatatctgcatctttcaatgtctgaggaggtaggacctggctctggtatgaggatgtggatctctccatatctgaggaggtaggatctgagtctgtccgtgtctgaggaggtaggatctggcatgagtatgaggatctgggtctgttcatgtctgcggaggtagggtctggagcaggtataaggatctgggtctgttcatgtctgagaaggcaggatctggcccattaggattatgaggatctgggtctgtcagtagctgaagaggtagtatctgagcatgggtataaggatctggatctgtcaatatctgaggaagtaggatctggccctggtatgaggatctgagtctgtcaatgtcttaggaggtaggctctggtacaggtgagaggctctgggtctgtccatgtctgaggaggtaggatctggcatagatacaaggatctaggtttttcaatgtctgagaaggtaggatctggccctggtttgaggatctgggtctttcaatatctgagcaggtaggaatctggtacaagcatgaggatctgggttgtcagtgtctgagaaggtaggacctggccctgttatgaggatctgggtctctccatgtctgaggaggtaggttctgggtctgtccatatctcaggagggaggatctggcatgagtatgaggatcttggtctgttcatgtcttaggagggaggatctggtgcacttataaggatctgggtctgtcagtgtcagagaaggtaggatctggccctggtatgaggatctggatctgtcagtatctgaggaggtagggtctggccctggaggatctgggtctgttcatgtctgaggaggtaggatctcgtaccagtatgaggagctggttctgtcaatatctgaggacgtaggaatctggtacaggtttgaggatttgggtctgtctgtatccaggaggtatgacctcgtacaggcatgagtatttggtattgcagtgtctgaggaggtaggatctggtgtaggtgtgaggatctgggtttgctccctgcccccgtggctgaagaggtaggatctggtacaggtgtgaggatctgcgtctgttcatgtctgaggaggttggatctggcccccttatgaggatctgagtctgtcaatatctgaagaggtaggaatctggtacaggtatgaggatctgtgtgtgtgtcagtgtctgaggaattaggaatctggtacaggtgtgaggatcttcatgtctctgtatctgaggaagtaggatctgatacaggtattaggatctgggtctatgtctgaggaggtagcatctgatacaggtatgaagacctgagtctgtcagtgtctgaagtggttggatctggccctggtatgaggatctgggtttgtcagtatttgaggaggtaggatctgtccctggtaggagggtctgtgtcttctagtgtctgaaaaagtaggatctggccctggtatgaggatctgggtctgtcagtatctgaggaggtaggatctcatacaggtatgaggatctgggtttttcaatgtctgaggaggtaggatctggcacaggcatgagcatctgggtctgaccatgtctaaagagttgaagctgtgtgcaggtatgaggccttgggtctgccagtgtctggggaggtgaggctgggcatgggtgtgagaccctgggtctgtccatatctgaggaggtaggatctggtatgagtatgaggatctgggtgtgtccgtgtctgaggaggtgggccctggcacaggtatgaggcctggggtctgtccgtgtctgaggaggtgggccctggcgcaggtatgaggccctgggtgtgtccgtgtctgaggaggtgggccctggcacaggtatgaggtcctgggtctgctggtgtctgcagagacagggcccgacatctcagggaagaccacggtaagctcttcagtttgtcttgtggctgtggtcagtcatctgtagtctgccctgttggtcttcccatgtgttgccagcacctgcctgctgccttgcttcctggaggtgggttgggccagggccctccgagacgcccctgtgcaagaccagggacagggtttccggcaggaggtggggggcggggtgtgccggccctccctcagcaccttgtcctgtctctcctagtgggtgggaggacgctactcgctgtggtcggccatcggactctccattgccctgcacgtgggtgagtgtgtttctgtgtcttgcagcccctgtgggagacagtgttgcagtctaaggtcggggtagggggcttgtgtccctgaacatcatgctgtcctcacaggctgctggcctctctgcagctggctgggatatttatttcatgtccagaaggaaggtctgggtttttttgcgtgtgcaagttggcccccgtctttgcccctcacaactgcagtcctgtttctctcctatcctaggcagagtcagatccctgcactcagggccacctctcactggaggggctttgtctaggtccgagtcctcccatgtcgtatcttctggctctccatgcagccttccttcgttgcagaaggagctgtgcccactgcccacaggacgcagggtgtggccacttctgttgactctgcttttgtgtcacaggttttgacaacttcgagcagctgctctcgggggctcactggatggtgagtgctgaggctggttctctgccaagtgctggccagaggcgcgtgtgttggtcctggtcccccgctttctcccccactgtcctgtccctcccctccccgtgcagctgctcagctcccactcatcctgctcctgtttcaggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcaggtaccagctgccaagccaggccttggagtcagcaggatttgtggggggtctgggaggtctaggaacctgggtttcagctcctccaggagctctttgccccattgcccttgggcctggccaaggtccatctgtgctccttgtctcaggatgaatctttgtaactgaggttggttccatttgagtgtcatctgagtttgatcaccatgggaggggcatgactggtgatcatggtgccctggctagggaggtcctggcttgactcaggggatgtttctcagctggggtcacttctttcttgcacatcactatgcatgcctaccatagtgtctgaggacgtaggatctagccctggtatgaggccctaggtctgttagtatctggggaggaaggatctggtacaggtatgaggacctgggtctgtccatgtctgaggaggtgggatttggccatagggtggggctgcaagctggaatcccttatagcctgtactgcctttatccctccagaaaagcaagtgtgtatctagtctgtggtggcctctttggactacatggccctcttctcccttgggatctccagagccccccgagaggcttagcaggccctctcctagtcacattatgtcccagaaagcttttccacacctgtccctgcttttttttttttgaacagattctcactctgtttcccaggcaggagtgcagtggcgcgatctcggctcattgcaacctccgcttcctgagttcaagcaattcctgtgcctcagcctcccgagtagctgggattgcaggcatgcaccaccttgcctggctaatttttgtatttttagtggaaacggggtttcactatgttgcccaggctggtttcgaactcctggcctcaagcgatccacctgccttggcctcccaaagtgctgggattacaggcatgagccaccatgcccaaccctatccttgcttttgtttagtacaaagccagtccctgtccagcagctcttgagttgctctgggcaggtacagaaggcttcaccaacacctggaagcaaatcctgtgactgaaggagaggccaaggttccccaaatcccagctgccttggtgagggttgccatgaccagggcccaggtgggtacccaaagcctagcatttagttgtggtgacagccctcaaaggctgtactcttagccaggcatggtggctgatgcctgcaatcccagcaccttgggaggcagaggctggggggaattgcttgagcccaggagttcaagaccagcctgggcaacgtagtgaggcccggtctctacaaaaaaaacccacaaaaactaacagtagccaggcatggtggtgcggcacctatagtcccagctacttgggaggctgaggcaagaggcttgcttgagcccaagaggtcgaggcttcagtgagcaatgattctaccactgtactccagcctgagtgacagagtgagactctgtctctttgggaaaaaaagaagctgtgcactctggaccccagcctgctctcccttaagaaatgagctgattttgtgaccgattttgtctttagggaggtccttgcctgacctccagacccaccttttcctgggcatgagtccttcctgcacagtggcttaagcaggaaaggttgggaggctgtgtcctcactggtgtggggaggaaggggatcgtgcctgtggacacgtgtgcaggtccacctcacggtgtcagggcagggtgggtctgcctggagcatctgggcaggactttggcatggtgcaggaaggagcaggatttgcgtacagtgtgtgaaggatcaagacttgcaggaagagggttgggttttttttctttcttttcctttcttttcctttttttttttttttctttttttttgagttggagttttgctcttgttgcccagtctggagtgcagtggcatgatctcggctcaccacaacctccgcctcccgggttcaagcgattctcctgcctcagcctcccaagcagctgggattacaggcatgcgccatcacacctggctaattttgtatttttagtagagacagggtttctccatgttaatcaggctggtctcaaacttccaacctcaggtgatccgcctgccttggcctcccaaagtgctggaattacaggcttgagccactgcgctcagcctctttctttctttttaaatgttctttcattttgccaagaactgggtttctgttccttttccagggcgacatggagtccaatgggaaatacatcaccaaatctggaacccgtgtggaccaccagacaggccccattgtgtggggggagccagggaccaatggccagcatgctttttaccagctcatccaccaaggtaggcccctgtggcctgggaagggtgatgttgggggagggaaaggatcttccagaagagatatctcacttaggtcagtgccctcctctaggccatatggctagctcccatgggctggggtcatgtgggtgaccacagtgcccttcacaggcaccaagatgataccctgtgacttcctcatcccggtccagacccagcaccccatacggaagggtctgcatcacaaggtaagagcccccatctggccccatctggggggtctggctcacattgcacccagacctctgaaaacctggtgcattggttggcaatcacgttagttttctattcctgccgtaacaaatgataacaaacatggaggcttaaaacaacactcttcttttgtggggtggggaggggggacagagtcttgctctgtcgcccaggctggagtgcagtggcacgatcttggctcactgcaaccttcccctcccggcctcaagtgattcttatgcctcagcctcccaagtagctgggactactggcactcaccaccatggccagctaatttttgtagttttggtaaagggggggtttcactatgttggccaggctggtcttgaactcatgacctcaagtaatctacctgcctcggcctccctaagtgctgggattataggcatgagccaccttcctgggctatctgaagagtttctgaagctcaaatatccagcaggccctgatgtgtctctgcttagagtcttgcaggctgaaatcaaggtgtcatcaggactgtgtttctttctggagaccttaggggaaaagcctttgacctgcttgtcaggtggttggcagaattcatttctctatggttgtggaactgaagtccagcttccttgctgtgggctgaaggtcgttctcagattctcagaggtcacctgcatcctctagcttgtgggcctcttcactgcagaaccagcaatggcaggttaaatccttctctgaagctttgattctgtcttgccacttctgttgcatctctctgacttgtttaccttcctcttctacattttgcttttgttccctaagtgacagtgtcatgctgtgttgtctaggctggacttacagtggcatgatcacagttcactgtattctcaacgtcccaggctcaagcagtcttcctgcctcggcccctcaaatagctgagacttacaggcactaacaggcacttacaggcacttacaggcactaacagcctggctaactgttaaactttttgtagaggccagatttcactatgttgcctaggctggtctccaactcctgggctcaagtgattctcctgcctcggcctcccaaagttttgggattacaggcatgagctaccgtgcctggccctcttttacttttaagggccagtgtgattagattggggctactagataatccaggaaaatctccccttttgtttattttatttatttattttattttagagatagcatgtcactctgttgctgaggctggagtgcactggcccaatcatagctcactacagccttgaactcctgggctcaagcaatccttttatctcagcctcctgagtagctgggaccacagatgtacaacatgcctggctaagtttttttttttttttaaagagacagagtcttgctctgttgcccaggctggggtgcagtggcacaatcaggctctctgcagcctcaccctcctgggctcaagcaatcctcctacctcagcctcctgagtagctgggaacaggcacacgccaccacacccagctgatttttttatttttattttttgtagagatggagtctcagtatgttgcccaagctgccctcgaactccttcagagaatttactgtgctttgtctcaggtgtgcagagcagcacagggttacggtagcacaatcttgggagtcagtgagctggattgaattctgattgttcctgtctatagttctgtgatccagcactgtggacttgtggaacccaaggctctactagaacagggcgatgatgcctttcctccttaggatcttagtattatttttttttcgagacaccgtttcactttgttgccccggctggagtgcagtagtgcgaccttgactcactgcaacctcagcctcctgggttcaagtgattctcgtgcttaagcctccggagtagctggaattacagttgcacaccaccacgcccagctaccttcttaggatcttaaaagatagatgttggtaaaattgtgagcaggacccctagcaagtggtgtgtagttctttttttttttttgagatggagtctaggtctgtcgcccaggctggagtgcagtggcgtgatcttggctcactgcaccctctgcctcccaggttcaggtgattctcctgcctcagcctcctgcctgatgacaggcatgcgccaccatgcccagctaaatttttttttggtatttttagtagagacgggtttcaccatgttggtcaggctggtctcgagctcctgacctcgtggtccatccgcctcggcctcccaaagtgtcgggattacaggcgtgagccaccgcgcctggccactggtgtgtagttcttaaagagcagttatcactgttccctgccttgtggtgtcatcggatgtgtccccctcgctccaactgagctgtacagcgagtgacccaggctgggactgacccctgctgagaagtaccaggcggtcttgtccctctgcctgaagcccagacagtgctctcaagcataactgatgtctcgctcatcagatcctcctggccaacttcttggcccagacagaggccctgatgaggggaaaatcgacggaggaggcccgaaaggagctccaggctgcgggcaagagtccagaggaccttgagaggctgctgccacataaggtcagcacttctgcatttggctttggggtgcatgctggagttggaggtgtgaagctatggcaccaggcaggggcttggggcgtgcctggcttgtcctacagaatgggagggcctgtcctcacagacctgcacgtctcagcctctggggcagggtgtgcttcccttcaaggggtttagggatcaggactctcttggagacattccttggtgttttctgcaggtctttgaaggaaatcgcccaaccaactctattgtgttcaccaagctcacaccattcatgcttggagccttggtcggtgagtgagtaggggaaaggtcctggcttggggtaggttggaatgggcttgtggagccctgatgtgccctgtctgtcacttctgcagccatgtatgagcacaagatcttcgttcagggcatcatctgggacatcaacagctttgaccagtgggggtgagttgctcacttaggggagggccgggaatacctttgtgtcggctcagggatttcagtagcaacgttagagccttcctcataccactcttcccttcccttcccttcttggcagagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactggagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaatttttgtatttttagtagtgaaggggttttaccatgttgggcaggctggtcttgaactcctgacctcaggtgatctgcccgcctcagcctcccacagtgctgggattacaggtatgagccaccacgcccggcccattttttttttttttttgacaacttttttttttttttgagacagggtcttgttccattgcccagactggagtgcagtggcatgatcacagctcactgcagccagtaatcctcttgcctcagcctcccaagtagttgagactacaggttgtaccactatgccctgctagttttttcattttttgtagagagacgggtcttttttttttttgagacggagtctcgctctgtcgcccaagctggagtgcagtagcacggtctcagctcattgcaagctccgcctcccaggttcacgccattctcctgcctcagactcctgtgtagctgggagtacaggcacctgccaccatgcccggctaattttttatatatttttttagcagagacagtgtctcactgtgttagtcaggatggtctcgatctcctgacctcgtgatccgcccgcctcagcctcccaaagtgctgggattacaggcgtgagccaccgcgcccagcaaggcgggtcttgctgtgtttcccagactagactggtcttgaattccagggctcaagagatctcccacctcagcctcccacagtgctgggattacaggcgtgagccgccacacccagcctattcaaaatttttttttcttagagacagggtctttgttgcccaggctggactgcagtgatacaatcatagctgactgaagcctcaaattcccaggctaaggtgatcttctcacctcagccttccaagtagctgggtccgcagatgcatgccagtacacccagctcatttaaaaaaaaatttttttcttttttgagagtcttgctttgttgcccaggctggagtgcagtggtgtgatctcggctcactgcaagctccacctcccggcttcacgccattctcctgcctcagcctcccgagtagctgggactacaggtgcccgccaccacacccggctaattttttgtatttttagtagagacggggtttcaccgtgttagccaggatggtcttgatctc

SEQ ID NO: 14113 - DNA, 7044 bp, Human
ctagaagcttcacaagaccgaagtggagccactggagtgttttaggtgaagaaacgacacactttgactcacagtagcaggaccactgtggagagaacactcaggtggcaggtaatggaacagtgctagagccactattcaggagtgacagagtggtggggactaagggaagaggagggcctgagggatgagagggacggagggaagggctggagaagcaggaggtgaggagaaggagcagagggacagaatttgaaagcagcagaattcttagctttaaacacattgttttataaatttttaatacatccatctacagagcctagcagggtgttccttgcatttggcctttaacaccttatgtgggactgcctaaaaattaattgctttttctgctttttttcaggtttaaaaaaatactaagtgttccaataaaacatgcacaccacttagatgcggatacttcctaaaaacaggaagtgcatgagcactggtgaggggcattgtgactgcgttgaacacttgcaactttgaggtgaatgaatgtattggctcctggttgcaatatacaatcacacgttgtgctactttgtattgtcaggagatgtcctggactcccacagaaactcagggctatggaatgaaggtaattttagaatacaacaagagtcacagatacatagtctgggaaagcaaaacttaggagctctgagagttgtacaactgtaatgcatttagacacatttatatatcaaggggccaaagtaacagtttttacacataagattcctgattggtcgggcgcggtggctcatgcctgtaatcgcagcactttgggaggccgaggcgggaggatcacgaggtcaggagatcgagaccatcctggctaacacggtgaaacccgtctctacaaaaaaattagccgggcgtggtggcgggcatctgtagtctcagctactcgggaggctgaagcagaagaatggcgtgaacccgggacgcagagcttgcagtgagccgagatcgcgccactgcactccagcctgggcggcagagagagactccgtctcaaaaaaaaaaaaaaaaaaaaaaaaaaaaaaaaaaaaaaaaaggttcctgataattcaggggttaccaagattctactactcactgcagctaataaaaaaaaaaaagaaagaaagaaactggtctctgtcctatttcatatgctcaggtacaacttttccagagaagaagaggaggggggcggggaggagcaggaggaggaggaaagaaggaggagaaggagaaggagaaggagaaggagaggaagaggaagaggaagaggaagaggaagaagaagaagaagaagaagaagaagaagaagaagaagaagaagaagaagaagaagaagaagaagaagaagaagaagaagaagaagaagaagaaaaggaagaagaagaaactgtctctacaccttcattctcaggacaagttcattgtctggcaccaagctccttggggtgaattttcttccaaaagagtccggggagtccaggtatggaatgggaggcagaaagttcaatcaagggactgggatttcggaatgaataatgaagggagatggactgggtccatgccgaaggtttctccctggtttctcagcccccgggcgaagactcagggagacattgagacacaccctgcacaggagggggagggggagggggagggcaaagtcccagggccccaggagtggctctcaagggctcaggccccgaggcggtgtctggggttgggaggctcagtattgagaattccccatctccccagagtttctctttctctcccaacccgtgtcaggtccttcttcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggtgagtgcggggtccagagagaaacggcctctgtggggaggagtgaggggcccgcccggtgggggcgcaggactcagggagccgcctccggaggagggtctggcgggtctcagcccctcctcgcccccaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctggtgagtgaacccggccgggggcgcaggtcacgaccaccccccatccgccacggaccgcccgggtccctcagagtctccggatccgaaatctaccccgaggcagcgggacccgcccagaccctccacccgggagagtcccaggcgcctttacccaggttcattttcagtttaggccaaaatccccgcgggttgggcggggagggggcggggctagctgggcggggctgactgcggggaccggctagggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcaggtaccaggggccatgggcgccttccctatctcctgtagatctcttgggatggcctcgcacaaggttgggaggaaagtgggcccaatgctaggatatcgccctccctctagtcctgagtaggaagaatcttcctggctttcgagatccggtaccagagagtgactgtgagagtccgccctgctctctgggacaattaagggatgaaatctctgagggaatggagggaagacagtccctggaataccgatccgcggtcccctttgagccctccaacagccttgggccccgtgacttttctctcaagttttgttctctgcctcacactcaatgtgtttggggctctgattccagtccctcggcctccacttaggtcagggccagaagtccctgctcccccctcagagactcgaactttccaaggaataggagattttcccaggtgtctgtgtccaggctggtgtctgggttctgtgctcccttccccaccccaggtgtcctgtccattctcaggttggtcacatgggtgctgctggggtttcccatgaggagtgcaaagtgcctgaattttctgactcttctcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatggggtaaggagggagatgggtaaagaggggaacgaggggtcatgtcttttctcagggaaagcaggagcccttctggagctcttcagcagggtcagggctgaggcctggagatcagggcccctcaccttcccttcctttcccagagcagtctccccagcccaccatccccatcgtgggcatcgttgctggccttgttgtccttggagctgtggtcactggagctgtggtcgctgctgtgatgtggaggaagaagagctcaggtaggaaggggtgaggagtggagtctgagttttcttgtcccactgggggttgcaagccccaagtagaagtgtgccctgcctcattactgggaagcaccatccacactcatgggtctacccagcctgggccctgtgtgccagcacctactcatttgtaaagctcctgtgaaaatgaaggacagattcttcacttcgatgattatggtggtgatgggacctgatcccagcagtcacaaatcacaggggaaggtccctgctgatgacagacctcaggagggcagttggtccaggacccacatctgctttcttcatatttcttgatcctgccctggatctacagttacacttttctggaaacttctctgggatcaaagactaggggtttgctctaggaccttatggccctgcctcctttctggcctctcacaggacattttcttcccatagatagaaacagagggagctactctcaggctgcaggtaagatgaaggaggctgatccctgagattgttgggatattgtggtcaggagcctatgagggagctcacccaccccacagttcctctagccacatctgtgggctctgaccaggtcctgtttttgttctaccccaatcactgacagtgcccagggctctggggtgtctctcacagctaataaaggtgacactccagggcaggggccctgatgtgagtggggtgttgggggggaacagaggggactcagctgtgctattgggtttctttgacttggatgtcttgagcatgaaatgggctatttagagtgttacctctcactgtgactgatacgaatttgttcatgaatattttctctatagtgtgagacagcttccttgtgtgggactgagaagcaagatatcaatgtagcagaattgcacttgtgcctcacgaacatacataaattttaaaaataaagaataaaaatatatctttttatagatacaggtagatatgtttttatagcatgcacgtaaatgtgtgtgtgtgtgtgtgtgtgtgaagagaaagagtgaatagagagattaagattcttttaatggtgaaaagatatacatatatttggaattagccagcttgactcagtttaggtgatcccaattttggtggcaacaaccaaagcatcgtagtcaggagccagtcgaacatatgccttcctctctccatcagactgaatcagagtgttgactttggccacatcaatgtcacaaacttcttcacagcctgtttgatctggtgcttgttggctttaacatccacagtgaacacaagtaggctgttgttttctatcttcttcacagcctactcagtggtcagcggaaacttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttatgaaaagggtccagattaagatttttgactgagtcattctaaagtaagttgcaagacccatgatactagaccactaaatacttcatcacacacctcctaagaataagaaccaacattatcacaccaaagaaaataaataattccataatattatttaaagtccttttatgttcaaatatctccacttctttcagtacatttttgtacctattttttatagcttgttttcttaaaatgtccactcgttgcctttggttatgtttctttaattacctacaatctataacaatcaacccatcttttttcttttagaatggcattacctgtttcagagatgaggccaaatacctgtggaatcttctccacactgaatttatcatattatttcccctgatgcctttaacttttttcctctaactgctatgcctcctaaggacctatgtagctctgggttaaacatttggcagcaatgtttacaggaggagctgtgaccgcacattcatcacatcaggaggcacacaaagcctagggttaccaggactctttctgaccccatacagccaaatttatcctgacttcccagagatgcagaaccatgggctgggtgtttagtgggtatgagtgtgatattctggcaataggaggttctgccactctccccattcctcacgagctttagttccccataccctgaggttctgagctccagaccttcaaccatcaggccaggcccctccagacctagactcccttcctgtcttctccagccccactctgctttgtatctacttccggatcactttccctctacaggcccagctcctgagtgtctctacctctcaaacaagtattctcatccaggagcaattttcccaccagaggacattagctatgtctggaaaaatgttttgttgccatgactggagtgaggaggaggtgctaccagcatcttgtggggaatgaccagggatgctgaacatcctgcagtgcacaagtcagcccaatcacccacataacagataattatccagccccaataccaagattgccaagggtaaggaggcctgccaggactttctctcccttgagtacaagcttccttgaactgagggacaccctgaaggaaaagtgtggtcccaccccagtcatctctcccttccctggagctccatctgtatgcctgtagtgcttaggcctgtaacctggggtccaggaacccaccttcccatgagactgcatgcagaagtgatgatatgtgcacacatgacttcattacagggcattggatattgatattcatcaggtcagctggggcccaagacactactcttctgccaacaggccgcaatcctctgcattagaga

SEQ ID NO: 14114 - DNA, 19567 bp, Human
gcaatctccgcctcctgggttcaagggattaccctgcctcagcctcccgagtagctgggattacaggcgcacgccaccatgcccagctaatttttgtatttttagtagaggcagggtttctccatgttggtcaggctggtcttgaactcccaacctcaggtaatctgcccgcttcggcctcccaaagtgctgggattacaggcgtgagcgggcccagcccctataccccagatttctgcaagtggcaacaccactggcttcattttgctggtggcccctctggccttcccttgtatatatcacctttgcccaaagaccatgtcagccaagggactgctctcacagctccaggaatcctcccctttcaggaaatttgaggcagttgagggcatgaaagtaaataagctgagctcatcagaggccttgtattgtggtggttaaaagagccagttctaggactagaaagcctggcttgaaatcccagctctgccactccctagtggtgtgactttagcaagttcctttacctcttttgtacctcccttttctcacctgtaagatatgggtgataatagtttaatatttgttttgttgttgtgaggattaaaggtgttaatgcaagtaaaccacttagaaccacagcacatagaatatctcagtaaggtggttagttttttttattgttgttttcagagatgctgtgatttctccaaagtggctgtgatggctcggcaggctcctgaccctctctgctcccacatgcctccaccctcatcctgatctcccatccagcttttgacagcttgcttggtgctggacaattgcacacatcttaccacccccaaatcctgcccagaagcatcttgtgcataactctcctacctgaatatgcaacagggagaaagagcgtcccaggacattttaggtttttgaagaaaaaaaaacccctttggtaaaaagccagagatccacagcggccactttttccatgggattgacccctgcaatcttgactttcaaccacacagcaccagagtagccaaacattgcttgtgtccaaacgctggctgccttgaagggtgaaagaataagcagttcccaaactcagctgaccttaatgtccttctagctccttacgcccatctcggacaaaagcagaaatgtatgtctcagttgtgtttctaccccttgctgcccaatataaatttttgtgttgcccaatataattttttgtgacgatggaaatgttctgtatttgtgttgtctgatgagataaccactaactgtagtgctattgagcatttgaaacatggctagtgtaatcaatgaaccaaatttttaattttatttaattgtaattaattttaagtggccacatgcagggagtgactgctgcattggacagcacggctctaaattgagccttttttccttatttggtgaggcatacttgccttaagattgggaagtctatttttggaacctgctaccaatgctggtctcacacttgcaattctcagctgagccaagaggtgagagaaaggtcattttccattccagatctcactctcccctgtgacactgaggaaactggcaagtgatgtgaaggctggagagcgtgtcctgtatgctggctctgtcccttctgcctgtgttgactgacatagttagttgctgcccttgctggtctcccttcctccaaccttgcctctctgagcacacctgacattcatctcatgacttccctaaaaacattctttgggaacaagaaactaacaaatcccaagtgacctatcacatatacaaacatacagggcagagtttggattcgcggtagaagaaagggaggttagacattaagaagaatggtctggtgatgacagttgtgagataatagaaacaggaaaaagaaatctaagttttctttctttttttaagaaccaataataatttctctcttttgactagtcagtagggctggggtggattggaggaagcttacatattccatgaacaagcctcttcctaaggtcctgtaagtgatcctgccccactgattagcccctagaagacccttcaaaggttggatctccaggagggagtgggggaggaaagccctgtaccaggcagcctctgctccattgctctgggggggtggggaaggcaaaccctggtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcaggtaagacatgttttttttcctgccctggggagaccctgaaaacagaaaggctagtttcctggggcttagctccttcaaacatcctcaagttgctatattatctttctaaaacatagacctactgacatgcctcccttcctcagaaaccttccgtgggtggttcttacagccttcaagatggagtccagactcttttttttttttgagacagagtctccctctgttgctcaggctggagtgcagtggcatgatctcggctcactgcaacctcagcctccctggttcaagcgattctcctgacttggcctcccaagtagcggagactacaggcgcctgccaccacacccagctaaattttttcttttcttttttttttttttttttttgtattttagtacagacggggtttcacatgttggccaggatggtctcgatctcttgacctgctgatccgcccgcctcggcttcccaaagtactgggattatgggcgtgagccactgcactaggcctaatttttttatttttagtagagatggggtttcaccatgttggccaggctggtctggaacccctgacctcaagtggtctgccctcctcagcctcccaaagtgctgagattacaggcatgagccattgcgtctgacccagactccttaatgtgactaactcaaggctttccttgaactacttcttacttgtctttccagctttgtcttttcacctctcaaattgagataaaataataacaacctcttggagttctcatcaggattacatgaaatgagatatgtaacatgcttagcagtgcctgtccatagtaaatctcaataaatgtttgtggaattataatatcttgtcatgtttgagactttgctctgcataatcaggcaccagtaggtttttataaaggaacccggctgtcacgtgcagaggagaaataaacagaaagtttcccatcctcagggagccacctgactgacagaggcacagtgcatccactctccaggtctaggggagaaagcagccttatttcttagtagctcagaatctgacttgagaaacacatccacatagaaaaaaacaaggaactttttcgggtcagggtccgggagccacagtgaggtggaagatacaggggaaggaagagggaaatagagccatccccagggtggaagatctcagaagagaatttgggaaacaaggtatgaacaaggactgaatagtgagaagtgatggagagacagttaaagtagatggagtgacaaaagcaaaacctctaagggtagaataggcagcaatttggccaagtcctaacagggaggcccataggaggattcaacctcaagatgctgtgccacattccaagagggaacctaaaggctgggctgaagagtcagagatggctacagctggcaaaaagatgggcagatgctgagaggagatgattgctaaaatgttctgtccaggacattcacagtatctctataaccagagtcttttttgtcgttgttgttctcaagaaggaaacttgaggccgggtgtggtggtttatgcccataatcccagcgctttggggccaaggcaggcggatcacctgaggtcaggagttcgagaccagcctggccaacagtgtgaaacctcatctttactaaaaatacaaaaattagctggatgcggcggtaggtgcctgtaatgccagctactcgggaggctgaggcaggagaatcacttgaacctgggaggcggaggttgcagggaggcggaggttgcagtgagccaagattgcaccactgcactccagcctgggcgacagagagtaagactgtctcaaaaaataaatgaataaataaaaaggaagaagaagaagaagaacaattgcaatcctccctggctctagaatgtcatttaaaagtcgagtgtcttcttccttccctgttttgaagcagcccttctcatgacaggcttgcttgccaaggttccctctgaccttaaatctcttccttttggtgtcttggacagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaaggtgagtagtgccatataatattaggtattaactgttgggtggccaagaacaattattctctcaactgagatgagatccctcaacccaaacatctcagtcctgggaatgatttccataaaaatgtacacatcaataaacagaaactcatgcttagggatgtctgttgcatcattattcagagtagcaaggaaattgggatcaaaatcaatgcctttgagtaggtaagtgacagaatgaacaatggtagccatactgtgaatattatgcaggcattaaaaagattattttagcactaggccagatggtttggaggccttctataaggtattattgagtgataagagcaagctgctgtaggatacaaaaacaaaaacaaaaccctagggcatggtggtttgcctcgcagctactcaggaggctgagacgggaggctggcttgagcccaggggtttgcagttacagtgagctatgattgcaccactgcactccaacccgggtgacagagcaaagaccttcacccccactccctacccgtctctaaaaaaaacaaaaacaaaaacaaaaaaacccttgggcccagcgccgtggctcacgcctgtaatcccagcactgtgggaggccgaggtgggcagatcacaaggtcaggagatcgagaccatcctggctaaaacggtgaaaccccgtctctactaaaaatacaaaaaaaaaaaaaaaattagccaggcatggtagcaggcgcctgtagtcccagctactcgggaggctgaggcaggagaatggcgtgaacccggaagcggaggttgcagtgagccaaaatccttccactgcactccagcatgggggacacagcgagactccgtctcaaaaaaaaaaaaaaaaccctgtatttgtgagcgcacacacacacacacacacacacacacctgtgcttggtcctagtgaataagcaagtaaatcaaatgtctaaatataattatagaaaggagatgtcaccttttggctgtacctccactatttcattctgcagaattgcagaatttcttttttttttcctttctttcttttctttttttttttgacacagagtctcgctctgtcacccaggctggagtgcaatggcgccctccgcctcctgggttcaagtgattctcctgcctcagcctcccgagtagctgggattacaggtgcccaccaccacacccagctaatttttgtatttttagtagagacagggtttcaccaggttgtcaaggttggtctcaaactcctgacctcaggtgatccactcgcctcagcctcccaaagtgctgggattacaggcatgagccatggtgcccggcctcagaatttcattttcaacatgttttgcatgatgggtgattttggagaatattttttgctctatcgcaggatgattaagatgtggacaaggtgaagccgatggagggggagctttgaaagttacttgctatttaattgaggaactaaactgctttgagagcctgggggtcagatcctctgccttttcctcctccccacctgcagtgcaaacatcagacaattgatcactattgtatcttggaggtgggagtgaccattgcagtgctgggaccagaagatggcattgtatgtggaacaacaaagcactatttctagagactgcctgcagggatatggaaatagctttatgtgtctcagaatgttcttcatacagctgtttttattggggaaattctacttgccgaaaagtttgatagtgagaccctctccagtttgcagatttttctccttcctgctcaacaacttcctagctcagtaactgcctctcccaacaaactccctcagtttcaccacaccaaaaaaggaagacaagccggttgcggtggctcacacctataatcccaaaactttgggaggccgaggcgggtggatcacctgaggtcgggagttcgagactagcctgaccaacatggagaaaccctgtctctactaaaaacacaaaattagcctggcgtggtggcgcattcctgtaatcccagctgggaggctgaggcaggagaatcgcttgaaccccggaggcggaggttgcagtgagccaagatcgtgccattacactccagtctgggcaagaaaagtggaactccatctcaaaaaaaaaaaaaaaaaaaaaacaaggaagacaaaaagaaaagcagctaaagactttgcctcaggggagaaagttctcttttgggttgctatccacattccaacctcctgttcccacctcttcgtctgcatgcctaagaaactgttttacaagtaaataagggacgctttgtctaggctttggagccaggaagttgagacaaatttaggaatgagatgaagtaatggtattattgcaagtctcaggtgtaactacctctgctctttctctgaagagtttctaatttctcttgtttacttatttttttcttgtcatttttgtgattttattactagttgtctctaatcctttctttaaattcttcattatgaaacataaaaacaaatgccaggcgcggcagctcacgcctgtaatcccagcactttgggaggccgaagcgggcagatcacccgaggtcaggagttcgagaccagcctgatcaacatggagaaaccccgtctctactaaaaaatacaaaattagctaggcgtggtggcacatgccagtaatcccagctacttgagagactgaggcaggagaatcgcttgaaccgggaggcagaggttgcggtgagccaagatcgcgccattgcactccagcctgggcaacaagagcaaaactctgtctcaaaaaaaaaaaaccacatacaaaccagagataatattataatgagcctccaagtgcctaccaccttgctgcagcacttgtcaatccagggaccacccacctcaccggctccccactcattaccaccctcccctactcaattactgaggtaaatcctaggcagcatgatcatttcttttttttctttttatttattttgagacaggatctgtctctgtcacccaggctggagtgtagtggcatatctctgctcactgcagcctctgcctcccgggcagaagccatcctcccacctcagcctacatagtagctgggaccacaggcacacaccaccacacactgctaatgttttgtattttttgtagagactgggttttaccatgttgatcaggctggtctcaaactcctaggctcaagcaatcctcccacctcggcctcccaaagtgctagaattacaggcgcgagccactgcacccagcgaagaacactttttaaaaaataaataggccgggcgcggtggctcacacctgtaatcccagtactttgggagcccaaggagggcgaatcatgaggtcaagagattgagaccatcctagctaacatggtgaaaccccatttctactacaaatacaaaaacaaaattagcctggcgtggtggcaggcgcctgtagtcccagctacttgggagctgaggcaggagaatggagtgaacccgggaggcggagcttgcagtgagctgagatcatgccactgcactccagcctggggcaacagagtgagactcaaaaaaaaaaaaaaaaaagccccccctccccacacacaataatataaataaataaataaccacaatactattatcacatcttacaaactcaacaaaaatttcttaatatcatcaaatacccagtttgtgttcaaattttcctgattgtttcataaatatactcttacagttggtttcttttagcgagattcaaatgagacccacctgttgacctttgcccttagggtttcccagggtctgaattttgttgacgacattcccatgttgctatgtaatacggtcctccatgccctgtgtttttctgtaaactgatagatgtggaggtgcaatgacatttgtgtttgatttactttggcaaatatagttcatcagtgatactctatacttcttgttgctttacatccggaggctgataatgtctgcttttctctcttttctaattatttgtgaaaggaaaaatgtggggggttgggagaaaaaaacccttaagtacatactcgctaaatcacattgctacaggtaacttccattaagaacttgaaagtaaaggtagctgcattttcccctagggaacacaatgatagacaggagccttagtctacagcttgaaggattgtaattatacctaagcaaccctcctggaccagtttaatgttattagctgtgatgtatccctacctttgatgtcattatccttacttagctcccttaaagcagagatcaagatgaaaagggcttcagctgcagcatggcacatggagattagagtggggcttttggatgctgaggagcagacctagaatgggaaatagatgggagccacagaagtgaaggtccccctccctcattgctcaacctactccacatctccaggtctgcacatctgttcagttactgaatcctgtgtaagctaccttctttttcttttttcttttatttatttatttattttttttttgagatggagttttgctcttgttacccaggctggagtgcaatggtgcaatctcggctcactgcaccctccaactcccaggttcatgcaattctcctccctcagccttccaagtagctgggattacaggctgcaccaccatgtctggctaatttttgtattatcagtagagagagggtttcaccatgttggccaagccggtctcgaactcctgacctcaagtgatccacccaccttggcctcccaaaatgctgggattacaggtgtgagccaccatgcccgctgtaaactaccttcttaaaagctctagaagagggctcttaaccttttgttgtgtgtcatgcaccttccgcaagctgatgaagttgatagacccatctcagaattttttttttttttttgagacagtgtctcactctgtcacccaggattggttgcagtggcacgatcatggctcattgcagcctccacctcccaggctcaagtgatcctcctgactcagcctcttgaatagctgagaccacaggcttgtgtcaccatgcccaggtaatttttaattttttttcgtagaggcagggtctcacattatgttgcccagtctggcctcgagaactcctgggctcaagcaatcttcctgccttggcctcccaaagtggtgggattacaggggagagccaccacacctagccagaagaatgttttaaatacaccaaataaaacatttataccaaaatacagttatcaaaatattaaattaacaagagttagggtgaccctattaattagtgtaatttcaaaatagtaatgaacataagtgatagtttgagatttctgtgacttttctaatgtgacgtgaaaatatttgtgatttttctttttcttttttttttttgagatggagtttcgctcttgttgcccaggctggagtgcaatggcaagatctcggctcacctcaacctccgcctcctgggttcaagcgattctcctgcctcagcctcttgagtagctgggattacaggactgtgccaccacgtccagctaattttgtatttttagtagaaacagggtttctccatgttggtcaggctggtcttgaactcccaacctcaggcgatccgcccgcctcggcctcccaaagtgctgggattacaggtgtgagccaccgcacctggccaatatttgtgatttttattgacgacaaagtcaaaggttctcttcatattattgtggtgtatcgcctacaagcataattaaaataaacactaaatttcagtttaaagtttactgaaaataaatatgtattttttattccctatttaagctttgaatcccctgacttcctataccattaccactgtcctagttcaggttcatgttgttttttactttaattgttatcacagtctcttaacatttctccctatgttctccagtcctgtaggtgctaaatctgacgtggtcacttctcagcttggaatccttcagtgcaccaccacagccttgaactacatatttgaaatacatatttattttcagtaaactttaaactgaaatttagtgtttattttaattatgcttgtaggcgatacaccacaataatatgaagagaacctttgactttgtcgtcaataaaaagtcccttgagggacttcagatgtaagtcccttagctgctcgttaaaactcccccagcctgacccaatacacaatcttgactttaaaccacttgtcattctaaatcactagcatttcctggaaaaaaaagccatttttccttcagggctaagctcagggaccaattctgtgtcaccttctttgaatcctgatgatattcacttctttatttgacctgatttattgggccccagacaccatgctgagtgttggggattcagctctggacaatgtcaaatgtcagtcctgcctttcagatcctttctactgggtgagccctggagtgctggttctcctcgcggtgctgcctgtgctcctcctgcagatcactgttggcctcgtcttcctctgcctgcagtacagactgagaggtacagggcagagggtgggtggatcaggatcctttctttaaatgagctggcttcttggagctacaccacttaacatgtatttgtgagtgacttctgggttcagaagttcttctcactattgagtgataaagaaaaaaaataactccatgatgaaagagttttacatcttacggaatgctttcatatgaataatcggacctagcatttccctatgagctaactatgccatatagtaaccccattttacagaggatacaactgaggccaggagtagttcagtgacttactcaaaccgatataacttataagtggtagagctgaggcctctgtatcatacctagcagctccatgcaacttgggagagtgtgagcttcgaagtcagacaggtctaggctattaggagttttgaataaagatactgaagtgaaagtctctaccacacagtaggcgttcgaaaattgtttcctctttctccattcaacactgaggactcaggttcagctgctgatgaagctcctcttttttgcctagagctttcattctgagccttctcctcctaccaagtgtctccccaatgccagagcaggaagagtcttcactcctccccatgccccacctcccatttgttactaagaggagaggagaaagtagcaaggagggtatggggaatgttctgggggaatgggtgttggtgcgatcaacaacaaagtcctttctctcaccttgaattcatcccagatgcctgcttgtttacttcttccacacaaaaaaaggccttcagccctcatggctgagcagaaagaatctgaatgttagagtcaggcagcctgggtttgaattccatctcaggtactgaactctatagcaaaattcttagattctccaagcttcagttgccttgtctgtcaaatagagaaaacatccttcgtcctaaattgtagggaggattaaagtcatgcaaagtgcctactacaaatccagtcacaaagtagctagctactcactaaatgttcagctcctccctcctcattcagatgggaagtggctttagataaacaaagtggcaacgcagtgggctggagcagctctgtgaactgagaatccaagaaaaggggcgaagagcagctgggatgtattggatgcttgtgctggcttggagcattgctcacattctttattcgctattgtatctagactatagctagagaaagagccgcaaccattggctttaaatccagtgctcttcctactctcctgaggttgtttccaggctgcagagaaatagcctgcacaaggggcccaggcgctgggtgtgggagggtccccaccgagagccagaacatgcaggaactaaaatgttgcctttttctattttaggaaaacttcgagcagagataggtgagttccagtcatcgtttctcccaattcttgccttttggttttttggcataacggaaatggtcccgttcttggaccgtctctccctctcaataccctgttttcccctcagtttccctttctctacagtgggtgtgtcgtgcctagaacaagttttaagtaattaaataacaaagactcaggataaaagatcctttttgagtgccctactaaatccatttccatttgtttctctttcagagaatctccaccggacttttggtaagttccggcatgtctaggccctcccaggtcaacttggtatttcactctagttccagtcacctgggggaacaaggacccctggctcctggttgagtcccttcctctcttctcttttctttctttaaataagaagtcatttgcatttaggattggtaaaatcataataaaaatactcatgtactgtttttatgtgccaggcactattctaactactttacaaaaacgttatcttattctgtttaactccttatgcacatgatctctcttttcaggaatggcaaaacagaggtaaatagatcgtttacacgtaaacctgatgtctggttggggaggtgaaacaaacagaaacaagacacaactgtatcacctgtacttatatttctgctttacaaactcaggatgtttccatgagtacagaacatgactaatcagagaagacctcatagaggaatagaaaagccaccaagccccactaggaattgacccctcaaggacatggtttctagcctttttgttcactgcagattgcccaatgcctaaagataatggcaacagaagagcacccaaatatttgttagataaatgttgcagacactagaaggtgtcattagggcacagatggtaccttctctgagcaaacttccttcacagctcctcctcccgaggctgtaggtgactctactcttgtcacctggcacacagagttctatcgtacgatttaggaaattagaccagtgtgtggaccacacacacacacatctttacacacccaaagaggaggaatagtatctttgttttggaggacttgactatgaaaggtcttaactcctttttgtaccatgaatctctctggcactccagtgaagtctaaaggacccctttgcagaatgtttttaaatatacacataaaatagaacacataggattgcaaaaacaatcattgtactaaaatacagttatcaaccgataatcacatttgtgatatagtaacataaatgtttctttttttttttttttgaggcagagttttgctcttgtcacccaggctggagtgcaatggcgcgatctaggctcactgaaacctctgcctcccgggttcaagcgattctcagcctcctgagtagctgggattacaggtgcccgccaccacacccagctaatttttgtatttttagtagagactaggtttcaccaggttggccaggctggcctcgaactcctgacctcaggtgatccacctgccttggcctcccaaagtgctgggattacgggcatgagccaccgtgcccggccataaatatttctttagccaaagtaatacattaagtaatgtagcagcaagtctaataacctgtaatttctttctttctttctttctttctttttttttgagatgaagtttttttgagatggagtgcaatggcacaatctcggctcactgcaacctccacctcctgggttcaagcgattctcctgcctcagcctcccaagttgctggaactacaggcgcatgccaccatgcccagctaatttttgtatttttagtagagacggggtttcaccatgttggccaggctggtcttgaacccctgacctcaggtgatctgcctgccttggccttccaaagtgctgggattacaggcatgagccaccaggcccagcccaataacctttaatttcaacatactaataaacataaacagtatttcaagatttctgcaataactctaatgggaatgaaaacatctgtggcttccattggtaattaagtcacaggtactgctcatattgtggttagttgtaaaatgttttggtttgttttgttttttccaagacttgggggaatgggtgttggtgggatcaacaagagtcttgctctgtggcccaggctggagtgcaggggcaggatcttggctcactgcaacctccgcctcccaggttcaagcgattctcctgcctcagcctcctgagtagctggcattacaggcatgtgccaccacgcccagctaatttttacatttttagtagagatggggtttcaccatgttggcctggctggtcttgaactcttggcctcatgatccacccgtctcggactcccagagtgttgggattacaggcatgagccaccacacctggcagttgttacatttttaatgaaagaaaatgttaaatccagttattgaaaataaggaggcagtacttttctcatccaagttcatggactttctgaattttgtccccagagtcctttggtgttctaggaccccaggttaaggaaccaaaaaagacaggtgggtggggcatgagggggaacacatgttaaccctgtttgttctggtgaacaattcagatccccactttctgagggtgccctgctggaagataaccctgtttgtaattgtgccggttcttggacccttggttgccttgatcatctgctacaactggctacatcgaagactagcaggtgcagtggctgggcagcaggcaagaccaccaaatagtgggggaccaagtcagctctgaatgggaagccaaaagagaatagaaccaggactcaagattaggggagctgggatttccttattcctctgtccccatgcccaaccccaggctcttctgagaaactgtgaagagaaccacttactggatctgtgggatcccccagtggaaagggcagtgtgggtcactccaaatgtccatagggaggatgtggggaaggtgctattcatcttccactaatcacatatttgtttctttttgttttcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaaaaataataatacaagttttcataagcacacttctaaccccttgtcttttatgtatttccttccttatccacgcacctgtctccctctactccagcctcattaccccagaggtcagtcctcaggaaaactaaacacaaagaaagagctcagtcagaaaggccatttatttatgtttcaagatgctcactgcctcctttgttttgtctcctttgcaggccttctctcttaggcctcttctcctgggggtatggatcctggggggagattgatcacctccatgcttccattcctccccagccatagtggggacatcatgagagaagccaagccactggcccaggatcacccggcatttatggtggctgctctggcacaggtccttgcctttatagcccctccagtgatccataaggccctctttctccccaaaggagaggtcacagatagggcaaaggtagctcttctgcttccagtgggtctgctggtgtctgaccagcctggaaaatgagctgaaagacttgctgcaatggaagcagtagttgggcggctctgtgaggtgggccttctggtgtctggagagataggatttcttgctaaaagtcaaagaacaatgggggcaacagaagacattgagtcttgagggcttcactggatgagagttggatctggcatcctgacagagggttccagtgatgggtgcctgggtcctggtcacaggtgcttggttcttaagtacagatgcctggttctgggccataggaccctcagttctaaatatgggttcctgggacctggccactggtgcatggttcacatccaaaagcccctggatggacctctggcttctggcgatgggtgtctggaattcagcctgggtgcctggaatcctcaaagtacactcctggtttccatccactggctcctggttttggtgtatcttctggtggcgtttgagctcagactggtcccggaagctcttcccacacacagagcatgaatggggccggtaacccagatggacgcggcggtgacgacttagtccagaagcatcacagtaggtcttgtcacagagcgtgcaacagaagggcctctccccaagatgcatgcgtctgtgatagctgagggacttggggctccgaaacaacttcccacactgactgcagctgttagtcagcttgggattgtgaacaaactggtggctatagaggtaggagcgcctgctgaaacatttgccacaggtgtagcaaaaaaagggtggcccagcctgggatgcttgaagcacccgggtcctgtccatagtcccagctggggcagatagggggcactggccggcccctctgcatgcaaggaagaccttgtcatcactagtcccctcatctctcagactgggatgttgttctcgaagctctttcttcttgccttctacagtgaatgaggaagaataacacaaaattcactgtaagaactccaacagaggcttggcatggtggctcacacctgtaatcccagcactttgggaggccgaggccagcggatcacctgaggttaggagttcgaaaccagcctgaccaacatggtgaaaccctgtctctactacaaatacaaaaattagctgggcgtcatggcatctgcctgtaatctcagctactagggagactgaggcaggacaatcactcgaacccgggaggcggaggttgcagtgagccaagatggtgccactgcactcctgcctgggcaactagagtgaaactctgtctcaaaaaaaaaaaaagaaagaaagaaaaagaagaagaagaaggagaaggagaagaaggagaaggagaagagaaggagaagaagaagaagaaggaagaagaagaagaagaaaagaaaagaagaagaagaagaagacgaagacgaagaagaagaagaagaggaagaagaagaactccaacacagcactccattcagcctaacacacttcttgtctctgcccttgctctcccacccaacacattcatccttacccttgggcctcataggctagaaataagaag

SEQ ID NO: 14115 - DNA, 20840 bp, Human
gagcagctatgcactagttccagagaagccactaacaggctgccatgtgtagatgtaggttcttaagagatcacaggctgggtcatctgatcactggatggatagctcagcctggggcatttagtgttttccctggtgataaatccccaaggcagctggatttggagctggtggcaagttgaaattattaaaaattgatttgtgtgggactgtctttagtgttgctttttttttccttaatctctgttgcccagactcattcctcaaagatagaggtaaggtaatctcctaggtgctgctgccatctggctaggggacccctacctgcccttgtgaactctcctccttcctctgagtctcctggccctagtagaggtcagttgggttcggagagctgtaacctctcttgtcctctgggtagaaggagggagaagagagttagttcccttatctccaaacttagtggtattgaggaggcaagccaacccatttggccacttacggattcctgccagcctttcctccaagtgaatgaggacaggtctagggcatggggcactaagcagagggctccttgccctccattgtaaaggcccttctcttgaccagtttattcacatatacctatcccagaactccaaacgagagtgcccattctctcctggaaatcaaccttaacaggagctgcccaagcactttctatgcccagcctctataccaggtctgtggagcctcctccagagccaagggagatccaagcgcagggcattgctcctaaagacaatcttaccctcagccacttgtccccctcttaggcctgaactcccgccacaattcctgctgggttgattaaatcaagtggttggaaattaaagccaattgaagagattaagtgtgcttgagtcactttaaagtttttggtcttaacaggtcactcctttggacccaccagacaaggtcccctcatcctcatagcaacgggttggggggcttttgggtgtggagcccaggaagcatcctgaggaaggtcagacctgtgacgctcaaaacactcaggatccattcctgggagatgaggcagcccagcttccgtgctagccctgcctttggaaaggagctaatcttaaggaaggggtttcataacaagggcatttctttcctactctgtatcctgacttggatccccaaacctgtcagttgctccccatatctgctggaaaacaaggaatctaggacaggacaggtgacaaaagagaagggcagaaaagttgctgcaggggaggaacaaaagagcaaggatgtcttgagaaactgacctggttcactagtttttttatcttcctagtcggcctatggggttcattagatcagtgaaggaggcaccctgagagtgaataggttccagagacggggtcctggagtgggtgagagttggggtccttctggaacttgagagaagatgaaacagtagtccattggcccacgatgagcctgctaatattagaggctgggttgactcttcctttgcatccctaacctgctttaagcacggtggggactgtctgggaccacgagagacgcatacacgggaggaggaacaacagagaaaatacaggctgacatggagacaaacggagcggggactcagatatgataccccaggctctgcctcagccagaactgtgttgacgaagggggacggggtgcctgagaattgggggcggggtttcctcctctcagtggggctcttctgtcccgcgctctcctcctcccccaccccccccccccgccaagccccgtgacttctgctttaggggcagattgctggggagctagtctccttccccgcactttgcagttcaccctttcaccgggtgcctcccccgggctgcaaagggtggggggcgggggtagggggagccaatcccggcagcgccaaagaggggaggaggcggtgacagccgcggggagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggtgagtcagtgacgtgggggtcgcgggagggagggtggattccattcctccagacccttccgcctctccgaccccggcctggcccgcacccacactctgccccattcccaggcactcttatggccggtctgggcggcaggacactgggggttcaaagccttgggtcccgcaggggttggggaggaacagaagaggcaggtgtggagaggcagcaggtgtgggcgtatgtgacacagggctgagagggtgtctggagtgggaggtgttacgtgcgtgagcacctgtcattctgtgtgtgtgtgtgtgtgtgcgcgcgcacctcccacagctggttgccatgtgccctgggcttggtgacagctagggtgagtgtgattgtatgtggcagtgcaattgtatggtctcgtcagatgtttgagtttgcgtaggaccctggttgtactgatgaagttgttttgaccatgtgtctctatgtgcaacgatgtgttgtgagtgtgtaattctgtatgaagtggtgtgtaactaccagaatgtgtcagggctctactttagggtggcttgtctctttgtaagccttcatgaccataagccctctgggcaagaatttgttaaagtaggttgtgttgtgttttgtggttgtgagattagtgttcagtgctagttgtgtactttcatgtggtgatgtctgcagcggggctctgtgagtgtctatgacgtgtctcatccctgctgcctctctggcttcctggtacagataggggtctttagtacaccccactccttcaccaatttttccacaaatagcccaggtggacccaaggagggactttagtgttcagctgcccagtctggtttccaagagaccttatggctccagcacctggcccctgtagggaggctttagttagtgctgggtcagccctctctccccacaccaaatcatgtactgagattattcttacaactgaatccttcaacccccaacaaacctttcagaacttcactcaaaccccaggaaaacacatcctcttccttcccctccagagacagagctagaagctctaggcctgggaagtgccatgtggtgtcctgcatgtccaccaaaccacttggctgcccgggcatcctctctttcccacatggggaggtatgtgaggccagtacatctgtgcatgtgcatgttcctgggtttggtaggaagagccatgtgtttgtgtaggtgactgtgtcaccctgggtacatttccatgtatgtgtttgtgtctctcattgtgcagcctgctctagaaagccagcagagtgggaggagggaggctgtctccctgaggccaaaacaaagctggggaggtggagggaggccatgatccttgtccttcctgaggggagtgagattgagacctgggaagggggaggggactaggatgaggtgccttgagcatgtgtcttcccccatcccccatcactgtccctagggaggccctagtcaggatcaggggagccactcaggctggccccagatgagagaccatgccagatgtgcctcagagctggatggaatccaaaggacccactgtccagctcttccatgaattctgttcccatcaccagcttaggattcttgagagtagtaagggcctaggggccttcaatagtatcacattagtcagtgtttgcttccagctttaatgggttctcacccttagtgaaaccatcccttccccacttggctatttgaatgagattgggtgggggaagcatttgtatttggagatgccctgccccagttcagtcaggaatggaagtgtaccagctatgtgacttttgttctcttggcctcacctttctcatctgtaaaagggaatgttacttcctgcctgcctgcctacctcccaaggaaaatggaaaggtcaaatgttgacaagtatcaagaattgtggtccgggtctacagcagcctagctgtagatagctccacacacgacttggaaagtagaaataggactaccaggagctctcctctcgaagggcggcttattttatagcgggagacaaatcgggttgggacgccagtgtcaacgaagactcccgggcgggcgggcggcgctgagctctgagcgctgagagatgcctaagctgaagcatgaaggggagtcgttgtccgcggtgctgaagcgcgcgccaggcttcgcctccccttccctgcagttgggattcctgggatcggatttagggtagtctgcagctcccgtcttcccggcccatcaggcttgcagggaagcagctggaaagttacacctcagggcatcctgggtacctccgaacattttacttccccactcccaccccaagctcaaaagggagctgggagagactctttaggaaaacaaaacaaaacaaaaaacagtccgagccccgcccggacccctgtctaatccctcaggtcttcccagcccggcggggccgctgggcagtgcggttccgaggggaaaggccgcgtttagcagcggccctgtctgagcggaagagagaaaggccaagagaagatgcggagagggttggagcctggctggctagccctgagctcggtcccccgactgggatctcagtggagtccctccggccctgagtattgttgccggggcgggggcgcccccgtgtggctgcgaggagccatgcgcacggagctgctttgcggtggggatagtcgccgtcaagtggacaagatttgcccagagttaggaggtcattctcaccacttaaatgtagggttttcaaccaatcatgcgggatcccagtcgaaagagcgggactatatctctcccgtaggctttcccaggaattttaaggcgttagagagtcctggaagtgtttacttggggtctaacctgatagagatgagtccggagtccaggaaaggggcgcagcgggaccgaagtggggggggggtgcggggggggctcttctcgaagcattcggctgtagccagcgtatggtggtagtctgtgaacctgccgcaccgagacaaacacaaatagaaacagttatgagagcaaggaatttggagccaggagacagaaggcagtggggcacaactctgctgcctcttctttgccaccccaatacactggcctctttctccttcctcctggctttcttccattggcccaggaagtgtggggagttgccatgacaactctgtcctcttaccccttcggctctttatgccaaaatggtgggggcggggtgcagggtgcggggaggagtgcgacaggcggagaaaggggggctgaaagggggcaataaaagatacggttcattccccatccagctcttttctcaaaacccacatgtgcctgcctggcctccccgccagaacccagaaaaatgctccctgagaaggctgagtccgcgccgcccctccccgccaccccccccccccgtccaggaactttgggggcggctgcttcacatgatggggccagggtgagctcctctcgtgcggccaggagaacatgggaaggctccagggtttcgatcctatgcctgccgggccggccctcccgcgccgcccacgcgggcctacccgggtgagggcggagaccggaccgccccggggcctgggggtggagcttagacgccgagctcgccgccaaaccatgaaccgatgcccccgcaggtgccggagcccgctggggcaggcagcgcgatccctctaccagctggtgactgggtcgctgtccccaggtatgatgaggaagggaagggaggggcaggatccttcaaaaagtgagcgaagtgggttaggagctccgcagaggtagggagggaagggcccctcaaatagatggagggagcaacatccctccaaggaaagggcttccaagacgagatcctggacagaagcggagcaggggatgggcctccttactgagcaggaggaagacagcgctcttcaaagaggaaaggagaggggcatcaaggtccctcacaatggtggagggggcggggcttctcaccgaaggcagaggagggggccttaactgaggggcagggcgcctcccagggatgaaaggaggaggcctgcagcagagcagggaaaaagttcagtcctttcctgcatttcttggctgaaggggtcttaagatgaagggttcagtgtccagaaggaaaaaaccctgagatgggcctagaccaacatgaactcagctagcaagttcatacatgacatgggactgatagacttgtgtggcttaaggattgtatgtctctgttttctctctctctgggagtgtgtattaatgggattgtgcattactaagttgtgcatcactgggctatgtatggctgagtctgtgtctccctggggttgtgatcactgggattctgtgacactgagactgtgtgtacctggagttctgtactttaggactgggttgagggttcctgagcctctaagttggttgtgtagccttcgtgaggttgtaccttggtgtgaaatttgtggagtgtatgaggtgtggattgttgagtatcccacggcactgctgaggtgtatgcacatctccacttgcatttccttatgactgcttgggcagggcccatagaacgcaacgtctcctctgtacctgacctcaaacagaccaaaacaacctggtcctgtggcattctgagatctgtcattttctggctctctccatgggtatccacttgagcccctggagtatagatagggcctgtggcctctccttgccatctgtcccccaaaaggagggtagatggatggtcctgagccagaaccatacctggaaatcttctggggagcatacaacctccaagccccctgcttgggcctgtctccagtgacagatggctggagccaggcagggccagctctcagtcattgcaggcatgacttccaggacccaaaatagccccaacgtctagggaggtcattaatcactcgatgcagctgggggctgcagtgtctttggcctagctgggaatggtgtgggtctgggggactgagagaagggctttgaggtcttcactggctgggttaacagtggcggtggggggtgggacaaagctaaactggggaaggtgggacagttgcatagagtgggttcccccacaaggcagtgttactcacatttgaactgggggagataaataaataaatgataggaatatctctgtggtaagatttgagggatctggggaaggcccacctcatgcctcgagatggttttcccttgagttcccactctgccaaattgcttccacagagattttactttgagtgaagagctaaattcgtggcacagggatgcttggggaggatggatctggcaagtttctcactgaacccgaggacttgagaagtctctgagtggggagaagggacagcctggaaaaataactcatcctttcactcctgacagactctgccacaggatgcctggctgatttaggaccatgagtcctggcaaggctgggtcaaggtctctgagagttgagagtgggagttaggaaaaggaggggccagggccagggccaggtccagggcaactggctgcaagttatcagtagcagggagcaagaaggggctgttgtggggcccctttccattcaaatagtctggcttggcattcaaggtttcatggaatttgaccctttttgattttattacccatagctcccttacctaaactaagctgtaggccctaggattccttgacaccccgcacatattggagagactgcctgagggagctgacagatcactgactctggttaaacaactcattattattatcattattattattattgagacagagttttgctctttcagtcagactggagtgaagtagcgtgatctcagttcactgcaacctccgcctcccaggttcaagcaattctgccttagcctcctgagtagctgggattacaggcaagcaccatcacgcctggctaatttttgtatttttagtagagacggggtttcaccatgtgagtcaggctggtcttgaactcctgaccttgtgatccacccgcctcggcctcccaaagtgctgggattataggcgtgagccactgcacccagccaaactcattcttaattagcatgtcagctgttatcttggaaaaaaaatcactcttttttcccaagataagcagggagcttatcttggcggggagcttcaattccttcatctgcaaaatgggtatactatcactcactctgaccatgtcagctgtaaaaacaggaataatagatcctacctctcaggtttattatgaggactaagtgagatactacatgtaaagtatccaggacacaaaatgtgctggataaatattatctttgtttatttgtttattttgagatggggtctcactttgtcatctaggctgaagtacagtggcacaatcatggctcattgcagcctcaaactccccaccttagcctcccaggtagctgggactataggtgtgtgccaccacgccaggctaattattattattttttttttgagacagagtctcgctctgttgctcaggctggagtgcagtggcgtgatctcggctcactgcaacctccacctcctgggttcaagcacttctcctgcctcagcctcccaagtagctgggattacaggtgtgtgccaccacgcccggctaatttttgtatttttagtagagacagggtttcaccattttggccaggctggtctcaaactcctgacctcgtgatccacctgcctcgacctcccagagtgctgggattacaggcatgagccaccttgcccagcccaggctaattttttgtagagacagagtttcgccatgttgcccaggctggtctgggactcctgatccaacctttagggattggcaagcaatccctaaatagactttttcctaggggaaaggagtggaacagaccaagcctatttgaggccagacgcggtggcacacgcctggaattccagcactttgggatgccgacgggggcagatcacttcaggccaggagttcgagaccagcctggccagcatgacaaaaccctatttaaaaatataaaaatcagctgggcgtggtggtgcacgcctgtaatcccagctattcggtggctgaggcacgagaatcgctagcgccaccgcactttagcctgggtgatagaacgagactctgtctcaaaaaaaaaaaaaaaaaaaaagagaaaaaaaagcctgtgtgaagcgtcatcttcccacctcttccctggatggggcaggtcggggagaaggaaggtgtatggtactgtgtgaggttggacgcgtgccccccggtggtggctgtatagaactgcagatcagccaacctcgactggggccttagggactggcccccaccccacaaattgggctgagacacagtcatcccagagctggacaagagggagggctccttctggggccaatccccctaaattgggcctcctggctgggccagctttctaagaagggagccagtgtagtgtggtggtttagagtgaaggctgagtcagactgggttaaaattgaagctctgatcttgaagatttgcttaacttctctttgacttagtttcaccacctgtaatatgaggataatagtatgccttcataggcttattgtgaaaattcggtgttacaacacctgtaagcacatagtgcattatctagtacatagtgaatgctcagtcaccgttagccagcagcggtagtaatggtgttactaacccagaggccctagtcttgtggctcattggctctgtaggcctctccccacccctttacacacacaaacaccccaccaagaagaagcagggaagaggagggagggactccggggatgctggctgggaggggtggctcccttagaaggttcagatttccctcctacagcagctgggcttctccatcagctcaataacagttcctaaggagcaggcagggctttagcatctcccggatgaggtcccagccacatacggagccagcacagtcccccctcctctcccaagaagcttgggtttcttgaccccaaaggcagctgcagtaagtcccctccccagagggtcctgatggggttaagtggcctttttctgcctaggctactactgtatcttatcccccctcccttgggcctcagtttcactgcctgtggcctgtgggaagagagtgcttccctcctcacagtctccatggcaaccaaatcgatattggtgatatcctcctagcaggagaggtcactgccttctccgccattattctcatacaattccatgccaatacaatgacaaaacagtagacccaccctccaaattatacaacacatccatacctaacaaacttcagacccacatcctacaaccctactaaaacacaggaacctcactccccatgcacactcacaaatacttcaacacactcctacacatgcagaccatagacacccagctcacatacccatatacgcaagagtcaaaatgcataaccatacgccaaacacacacctctgtgacaggtgcacagtcacgtgtaagcacacaaagacacacataagaggagacatatgcactgccatactgacaaacacaggaatatacacacaggaaaacacctggccaccacaacatattctgacccatgcatctgattacttatacatgtgcagatggtggtttctcatgcacatacaccctgcccttccctgccttctccctaagctcagctcctccctctgccccttccctttggcacagagtagccacaggatgtctaggggaagcacttctcagggacagaggcgggtcactgctccctccctctggcccatatcttggccaaaagttcccaaggaggtgccagtccaaaggctgaggtggccctgcgaagaggaagaggcggcggctgtggttgggaggcttgtggggcagaggcggggtgatgggggagaggaaggagatcctgggagggagagtgggagggaggctgcaggcagtcctactcaggctggggagtctgagggggaggtggtgtgaggcggtgaaccggcgtatctgaacctgggccctgtaggggccatgccccaggcccaccatgaacctggaagggctggagatggttgctgtgctcgtggtcctcgctctgtttgtcaaggtcctggagcagtttggcctctttgagcctgtctccttggaaggtaatccaggtgtcctggcatgtctgagctgctggctggtggggcagctgccccacagcactagggagggtgtttgtctgtcttcatgactggggcagggatgagcaggtgagtgatggcacagggatctgggaggtgagtaggggtgcttgggggatacaacatctgggaggggtgaagaggaggcctcaaggagtagatatggagggaggagggaatctgggggaccaaggtgtcaggaggtgatgaggggtgcagtgtgggaggactggggtgtggagatgaggaggtgaggggattctgggcgataccaggaggggtctggagatagggaaggagtgtctagagtagaggagggaggttctagggatcctgagataacaacggatttctggggggtcctttttggagtcaggggcccaccacggtgcctgtgcatcctctccacacctccatctgtgcagtgtagcttatggggtgtgtgggcatagtgtgtgagagacacagggtgtgactttgtgttcctgtatgtgagagagtacaaagtgtgtaactgtgagcctgtgtatgggacagggatatgactgtatgtgtgagagtgacagggcatgtggctttgtgagaaggtggatgtggccaggcctgagtggcacagtatgtggctgagcctctgggtatcaggttgtgcatgtggctgtttccagaatttcctgaggatataccagctccatacccaaggcttgggaggaggtgggttctggagggaagagtgtgaacattgtgaaggagacatttatagcccagctatgattggggatgaggagtggatcagatcagggaccctgcttcccaagtccccttgcctctccaagctcctatcaggatccaagtgcagagtgatctccagggcctagacattgggagtggaaaatcaactcccctccccagcccaccccaaagtcagtagggagagtaatattggggtggagtggggagcacttctgcctcccccttgggagttttgacctctccctcctcttcacggctagaactgtgtaactccgtagcatggctgttccccagtaccaccagggacaggaagacagactagaaccatgatggaggactgcagggtagatacctggaagaactggaaaaatatgaaggaaactgggaacaagaggaaggtgcatgaattgcctgctctagggttcagtaagagcagaaaactcctagctcaccctccatcctctgctgcatttattggggtggagtggggaacagggagttggacctagataaactgggacagctgggctgagcttgttctcattcaatctggaaaaggtgaagttgattgagctctaacttgccattccttttagatgggaaagggggaagagagggcatctggaaatcccaggagtcttgggctgaaggcagccattctgttctcacctttagaggagacagaggcttagaagcaggtagggggctggggtggggggcaggagagccacccccgagtcgggcaactacaccattggaggccccaggcgcaatccagctttgggaaactagagtccaggctaatggagccctgggccagaggccaggaatgccatcgatccccctgcctggcccactgcctccctcccacctctccatggctcctggggtgggagggaggtaaggatgtgttgaaggagaggaggtggttactcacccagtcacctcctgagaacagggcctgatctggagggtgaagcctggattgggagggtggggtatatggagggggagtaacctttaactaaaggaagttggacccctccaggaatggactgaggccaactttagtcactgtgtcagatccagtgggatctgatccaggaatctggatgcagtgcagctgggagacacagacacacacacacacacacacacacacacacacacacacacacacagtaacactgagggtcctctgggggtgcaattagagctgtagagcatgtgcagaaataagggagaagaggggaaggggagccatgatcagtgggccatggatagccccacaatacaccagaatactcgcctccaagatctcttattgccacaaagtttactattatttcaccctcaaagagcaagccatactggaagagactgtgaaggggccacagtttagggtagatgagttagctgatgaggaaccctgccctttggcagaaagattctgggcaccttggaatgaggaggggttacaggaaagaaaagtgggtgtacccaggaaaaatgaagcctctgtgggtgaggtattgaggtacagccttagatatctgggtgccatggggacccaggtcacagtatgatatggatatgtgtcatgacaaccttgatatgtctcataatgttataaggtcacaatgtcatagtgttctttgtagactcacatgtcatgatgtcccagaggcattgtgtgttcttgtgtggtttgatcatgctgtgtgtgagatggcctatatgggtctccatgtgtatgcatcctgttttacttaggtcacatttgtatatgtttgtgttaaggagttagcaggtcattgtgtgtgtgtgtgtgagcatgcatattacgccatcaggtgtgagttactggatatcaagctgtcactggcacccatcactgtgatgtattgttctacatgtcactatacacgcctgtcactgtaggtgtgtgtatgagagaggtgttcttacccaggcaatccttgggttggacatcatcctgagaggtccagccatggcacttgagccaagggtactaggtcagcaaagacactgaggccactgccacctcatccttgccgcctcgctgtcaccggccacgtcccattaaaccaagtgcctgagcctcacctctatggactcactgggctcccctaacccgattccaaccacccttgccattcctttcctccccttaattcctcccccagcccggtccccagatggggttgatttgtgactggcggggaggggacagggaacagagggacaatgggagttaatgtgccttcctggggtcttctctcttcccaggccaccctccagggcccactaaaaaagcgctgaagcagcgattcctcaagctgctgccgtgctgcgggccccaagccctgccctcagtcagtgaaagcaagtgcctctcatgtgcttccgggggcggggctcgatgtgtgcgtgcgtgtctgtgcatgagtgtgtgcgcgtgtgccccaggcctgcgagtgtgcgcatgctccaggcctgcatgtgtgggggggcgtgccccaggcctgcgtgtgtgggggtggggcctgccccaggcctgtgcgtgtgtatgtgtgtgcatgtgcgcgcgagcgtgccccaggccggcgtgtgtgtgtgggggggcgtgccctacccctgcatgtgtgtggagggcgtgccccaggcccgcgcgcgtgtgtgtgtgtatggggaggcgtgccgcacgcctgcgtgtgggggaggggcgtgccccaggcctgcgtgcgtgtgtgtgtgtgtgtgtgtgtgtgtgtgggcgtgaccagcgtggcgagggcgggtgctggcaaggctggagcataagggggcgtggctactgtgtgcgtgtgcggctgaagccagcgtgtgtgggcgtggtcagttgggagcgggtgtgtgtcaccgctcccgcaaaactgtgggacccgagagtgtgggtgtgaccattgtgaccaggctgaggcctgagcctgtgtagctgtggcggcctgtgtagaccaggcggccgtgagggtctgtatgtggcttagctgggttagtgtcttcaactccgtgcggccgcccccttccccaccgtgttttggacccctgatgtgtgttgcctatgccccgacaggatggtgacaggtgtagaggatggcgcctgccctcctccagacgccagggtatttgggttttctgtgccagcctggtcccctgctgagtgatctccagttgagtgacctcgctttgtctctaggtctccatttcctcagttgggccttgcccacctcataggatcatactgcattttgcaaaccataaaggcccgctttgtagttatttgagcatgctgttgtgttggacttagatgggtcccacacgggggtggattcggaaaaggacaggcgtgagtcccgcaagcttgtgtgcatggggtccgtttcgtgtgtgtctgtgctggttgggtgtgcctttgcacgggctgggttgtgaggtttgctctgagtgtgaggggccaggtgtgtgtctgcagttggccgggtcttccgctttctcggtgacagttcgctcccttcagcattagccgccccagcctccctccgcccccacagaccccgcctgctggacccaggtgacttacgctcctggtgggggcggggcggggcagggcggctttgccatcttggggtggggggcacttgcctgggggctggacgttgggggcggggcaggattgagatggggccgggggtggggtctggatggaggttggctgagctgggcggggcatggctcaggcatggctgggatagatggggctgggcggggcgaggggaggggctgggtgggacgaggggagggtttgggcggggcaaggctggggctgggcggatctgagttggtccccgaaggcccggagctctgaccctcagacgccccctcttgaactggcttttcccactcctccctttctaaaacgaagatgcggctgggggccttcccctccaacgagggatcgagggccgcggggcgagcactgagtcggatccctggctctggggccaggccaggccttggcccgctgatagacctcgaagatggccatcatcttttctccttacctcagtgtccttggctcggggcccagggaactggcagcctggtctccggcatcggatgggaccggggggcggggagggggtgaatggggcagtgatttgaagaggggtcgcggaggctgggcctgaggcgcggctgtcctcaccgctcccgcagacagcgtggacgatgaatttgaattgtccaccgtgtgtcaccggcctgagggtctggagcagctgcaggagcaaaccaaattcacgcgcaaggagttgcaggtcctgtaccggggcttcaagaacgtgagtgcaaggcgaggccaaactcagcgagggtgggacaggaggacccaagccggtccacagcttcccagaaagcatggcttggatgcttgaggtgtgggcggaagggaggcaaggccctgagactgaacttctagctggaggttctggggcggggccagaacggaagtggcgcctgtagactgtcagtttcgttccatgttttttatttgtgcactgggaaagaagtcttccctcccatcacatgagccacgtggtgagtcctctggaggcttgaagattatccccctccctgggagtcttgggccatggagggtgggggcggtgaacggaaggggattttgtctctgccctcagcctggtgccctctccttccaggaatgtcccagcggaattgtcaatgaggagaacttcaagcagatttactcccagttctttcctcaaggaggtgaggggacaaggcccaaggggaagcagttgtccttctctaggctgagggagggagggattctggaggagctgggaatgccaaggtgatggggggtatggggagctccttagagggaggaagtcctctcctgtgtggaagccaacttctccacactcaccctgcagactccagcacctatgccacttttctcttcaatgcctttgacaccaaccatgatggctcggtcagttttgaggtgagctgggcgaggtgggccagggaagcctgtttcctggagttcagggccaggatctccaggccaaacccagagaaggagttgggtgaagagtacccgaggacacagctccctcctgcctccttcccaggactttgtggctggtttgtccgtgattcttcggggaactgtagatgacaggcttaattgggccttcaacctgtatgaccttaacaaggacggctgcatcaccaaggaggtgcagggcaactgaagggctgggggtctgtggcggtgatgggggtggcgtgcagagggtgatgggagggaaatatgacccacatatgcccacaagcaagggatcaagggaggctggaggctctgaggaaggatcctcttctctcttggcctaacaggaaatgcttgacatcatgaagtccatctatgacatgatgggcaagtacacgtaccctgcactccgggaggaggccccaagggaacacgtggagagcttcttccaggtacttgggagtgggtaggctggagggccctggagtgaagggaagaaggccaagaaccagcagggaactcacctgacttctgtctgcctctctcttgccatccctcctgttctccctgcctgaccaccttcttgcagaagatggacagaaacaaggatggtgtggtgaccattgaggaattcattgagtcttgtcaaaaggtacagctccctgccctctacattaccctgacctggactcaggcctgatttagtaatgcagggaaaagcttctttgggaagaataccaccttcccacctcacccccatatttcaatcctattcctttgtgggaggcttaccccttccctacctcaggtctctctgggcatctccttcctctgtgcttttgaatgtccccgtctgtgactcagtgtccctctcactgtctctgataagctccttctctttctctctcttcaatctgcctcgctcacatcatggccacaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgcacaggctgccgtctctgccttttgtccctcccacctacaaatactacacaacccctaacgaatgcacctgcagccttttagatccccaagaaagtggctttcttttccatagttggccataccttggcatgagactgagacacaggctctggaatggttggaaacccacccaacctcaggcccccacatgaatctccctcccacacagcctgagaggagacaaggaaggaaggacaggacactgatgtcccgaagactgtgccaagcaagctgttttttagctgacattcttacaagttgaatcacagatttctaatttacagactttttagttaatctcaaagtgctttcttttgaggggcctccctttagtttctttcttttttttttttttctgagacagagtgtctctctttcgcccaggctggagtgcagtggcgtgatcttggctttactgcagcctccgcttcctgggttcaagcaattctcctgcgtcagcttcccgaatagctgggattaaaggcgtgcactgccatgcccggctaatttttgtatttttagtagagacagggtttcgccatgatggccaggctggtctcaaactcctgacctcatgtgatctgcccgcctaagcctcccaaagtgttggttacaggcgtgagccaccatgcacagaccttccctttagtttctaatgaaagttcctttgtgtcaacattccaaccttgcctccagtatagataaatattttttgtgtccataccccagccaggaatgatgggggaatgagatggagtggacccagcgcaggtcaccatgaggcagatggcacaaaggatgacatggactttctgtgtgttcccactctttctttgttctgctcctgcagagggacccaccaatggttggttcctctcatcctttctctgggtcaccattatgggtgactaagcttcaccatccataggaggagtaacaggccttatcctccctcgtgatgaa

SEQ ID NO: 14116 - DNA, 11050 bp, Human
ttttggtgtgtgtattgaggtcaggatgcgtgtcataggtcccagtgtgtatgacttagactgtgtgtgtgtgtatatatccaggatttgggtatatttaggatttgagatatatcacaggttgatggccagacgcggtggctcacatctgtaatactagcactttgggaggccaaggtgggtggatcacctgaggtcaggcgttcgagaccagcctggccaacatagtgaaacctgtctctactaaaaatacaaaaattagctgggtgtggtggcatgcacctgtaatctcagctactcaggaggctgaggcaggagaatcgcttgaacccaggagctggaggttgcagtgagccgagatcgcgccactgcactccagcctaagcaacagagcgagactccgtcttggaaaaaagatatatcacaggttgaaatgtgtatcaggtagtgatttatgtgaaagtgagatgtgttatttatgtggaagatgttcacagagccaggtgcaatattactgcacagttaactagtgagtatgtcataagaaatcctgtccttggagttatgtgtgaatatagttgggggtaggagacaggaagtagagaaacagacactcaaattgcaaagaaggaaatagaaggttcgtgctcccccttcccgtgtgtgtgtgtgtgtttgtgtgtgtgtgtgtgtactatgtattttccttttcctatttgtccacgagtaaggtctggcccactacccaagttttagaaatattccctcctgctacaacaaaattaccttaggaaaaaaaatagaaatatctgctcccttgggatgccctgctggatgggagaacaggtcctatccactaaccacacgtttttttttctggggtggtggggaggattcagcagcaaactaagctccttctggggacccttggatggccaagttggctttccctagctctgacaatgcctctttccctggcacccacttgtcttcagtggtggtggggaagggggcttcctgttaagggggatctaagtcaaggcttggaatttagctgggttgggggcagggaagcctggagtgtcccccttcctccaatcagtgtttacagtctgatgtcagaatgtgtgtctgtcaaaaataaccccctggagcctctccccccagctgctccaggatttcaccaggggagcccaggctggcagtccgggccagccttcaacctgagcgatcacaggggcgagaaagatttgggggaggtttgggaggtgctttgaagatcttggagtctgcagagaggagcccgccctcctccatctctgccagtggctttggcccacctgctcactcctgagcaccgtgcctggggctcgggggaggcgggctgcatttcgttcctggcccccacaggcctctcctccatccaggtctctcctggcccaatctgatccgtcccctgtctctcccagtctctgtctctcttttgtttttctcagcagtccctccgtcccagcctccctccctcccttgctcttcctctttcctctcagggagggggcggggccggtgggggcagctccaccctccgcccgccctggggcctcattctgagagaggctcggagagagcgagcggggagggagggaggcagggagagaaagggagaaaggcaggcagccggcgggcgctgcgtgtgtgtttgagtgtgcgagtgtgagtgagtgtgagtgccgggtcctgcctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccggactccccgcggccccccgccccccaggccggccccctggcccccggcccccggcccagtggccattgtaactttcccccgggacagcggccgccgcggggcgggccgaggctgtgcgtgcgagtctttgtgcggccggcggactggagctcccagtcgggcctgcccgtcccactcgggacatgagctgctgaagttgtccccccgtcagccctcacccctgccaggactcctctgggcttgcagtcgctcccccgtacctctcctggccccctcagttctcccaggtaagtctgggcaccctgcgagcctgttgggggtgggcggaaggccctcagcccggcccgggcctgatctgcgggctgggggagaggtgccccagcccagagccgccggggcgctcaggcctgctgacctgtggccagtccctaaagggaggaggcctgccctcgagtcagcctggttaccatggcaatacccagctggaggtgcccccctcagccccgggatgcagcttccaccctgagaaaactttactagttctgggctcttctctcccccttcctaaaggcttccaatttgctagaggtgggaggggggctatggctgactccagggctggatgacacatctcctccgtccccccaccttgctgcctctactcctgctgctggggacaggcagcaacagggacagatggtctgggtgatgtccctccccttctctactcactcccaagcccttgtgctggagccactgggagttgtggctctggagagatgctgagtttgtgtccattcactggaggtgtaaatagaggcccagagctttgggctctagctcctcagagctatttacccaggcctagacaatgcctgttcattctctagagagagaaatggaggctctgagagtttttttttttttttttttacaaaattggagagaaacccaggcgtcctgcctcctgtctcttcaggttcttgagctaacacatttcaagtggcccggaaactgaggaggcaggggtggttaagctatgggagaaaggatggcctagttgggggatgagggccaggtctgagaatctactcttgggtttattgcccaggcctggcctctggtgggctgtgtgagtttgggcttcctgtgtggccttagtctgcctgtctgtggattggggagacttggtggctgggtggggactgtctttctggagacacaggctcagtccagactggcatgtgaaggctgtgtgtgctgttcttggagcatatggatgtggcccgtgagagctcgtgcatggggtgagggcctgttgcgggcatctgaatctgcctggggctgctgggttccagcccttgataggcatgttagggcgagctgagggtgaaagcctgctaggcaggatgaggcacacgtgtgtgcaggcacacacaggctctgacttggcaccttcagagactgtgcagtctgggaccctccttttgcctgcattgtgaggacagggctctggggagagaattaaatgacacatgttggcacagggtcttcttttgtctcttccccccaaagaaacaaaataggttttgtatctaagttggggaggagatctagatacagccaatctagctacccttccaaatgcagtcgagttttagggacccaaggaagcaaatgtgattggagtcagatgaacttttgggcctgtgcctcagtttcccctcctatctggtgagaaggggaaacagagttgcaggggtacctggctcatacccaactatgaatttaacactttttccagtcagaaaacagtattccaggaactgtttgctgttaggtgaggtgagagagaggacatgtgcacatcacagatacacactagtgagacccctgtctagtgaccacttgcccctagactgaggaacataggcttcttcccagaccacctacttctcaattgtaggtagagtgggatgcaaaggaggctcatctgcctgcttccccgactcccaagtctcagaagagaaaaggggttgaggctttgggtttctggtttggagacaattactgtctacccttgggggcggggttgggggctgggctgataagggagtggccgttagtggggaggcagaaggcccaactggttatctggtaggccacacccaacaggcacccacccccatttatctttccatcccttgccctcctgagaccctgagggtggaggaagggcagagtttgaaaatcctcccttttcctcccccactttggtctctagagggcaatagaggggtcagatggtagaaagagtataggatgtgggaatcagaagatccaagctcaagtcctagctttgacagttactagctttatgatcttggcaaggtcctttgagccctcagttgcctcatctgtaaaatgggaatgttatggtcagccctgctacctcataaggttgttttgatgattgagtgaaagtatgtagattaaaagggggtttatcaatattagattctaatgattggatatttatttattctgtaatcattcttcccagcttcaattcctcttctgtcatctaggactcagccaaatgaagaaatgggatcttgggtatgcgctgggattagggtggactactcttgtttcttaatgaaataagattggagccagaattagaaggagagacaggtgctccctagagtagccccctcccctagtccaccactctcttataatcaggccagggagctccataagaccgtccctatccacacagtctagcaggattatcggacagctcccaagagggggtcaggggactcctttttctttttgagacagggtctcactctgttgtccaggctggagtgcagtggtatgatctccgctcacttcagtgttgacctcccaggctcaagtgatcctcctgcctcagcctcccaagtagctggaaccacaggcatgcaccaccacacccggccaacttttcaattatttttagagacgaggtctcgctatgttgcctaggctggtccctgcagcctcgacctcctgtgctcaatcaatcttcttgccttggactcccaaagtgctagattacagatgtgagccaccgcgcccagctatgactcctttctttctcgtctaggttgttcctcaaagtcattcaagctgtactcgccgaaggagcccccgaacggcaacgcctttccccccttccatcccggcaccatgctggatagggatgtggggtaagtgagtctcttggccacttcctaacccttctccaggtgggatcctgcctggaaaggggagggagtagccccctgcccccaataattcctatcttcaacccccattctcatagcctcttcctttacacagcccaactcccatgtatccgcctacatacctggagccagggattgggtaagtggagtccagtggggaagaaggtgctttccactgggtgaaggccaaggtagggggtggaggggggcaggctccgctcctactgacctcttctccttcacttcctcaaggaggcacacaccatatggcaaccaaactgactacagaatatttgagcttaacaaacggcttcagaactggacagaggtatggccaagggaaaaggggctgggagcaggagggccatctgggcaccctatgggatatcttatgacacatgaacacccgttaccatgctccctaggagtgtgacaatctctggtgggatgcattcacgactgagttctttgaggatgatgccatgttgaccatcactttctgcctggaggatggaccaaagagatatagtaagtggcctctggggtcttgctatgagggtgtatacctcctatgtcgttctaaggtctagaagtgggtctgggagtgccaggggatatctagattggtaggggaggcatctgcctggccccttttgcggtccctttgtcctgaagagtttgtcccatctctacagccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtcagcaacccagctggatgtggaacaccatggcacctgggtttgattcccatcctctctcccagtgtatactcacagctgttccccagggaggcataatgtgaactggcaaaataagaagggcgggtaggcatgttgcaaccgtcagcaaacatgtattgtgtttgtatgggatagttttctgggccccaaggctacacgagtgaacaagagtctgccctcatatagcttagagcaggtgggtgtatcactagccacatggggagaggacaaggatctgttaagcttttctactgtgtgtctgtgtgtgtaagggccaggtatatgggtggggggtactgtgacatttatgcacccagatttaatgtgcaggtgacaaaagtgtatgcaatgggagagttgtaagcaaatgggagactgtaatagacataccttcaggtatggtatgtggggagggggcagggttctgacaagcctgtccccaggtgtgtgtggagggccggttgtacctggagttcatgtttgacgacatgatgcggataaagacgtggcacttcagcatccggcagcaccgagagctcatcccccgcagcatccttgccatgcatgtgagtcgtgggcaggacccaggatgcaagagtgaaggcaggcgggggaagggtggaacaaggtctgccatttcccgactgactacttagacagagggttagggtttcttcatctgaacagcaggtttaataagagactatcctctctcaggagtgtcacaatgctcagatgatagggcaggtgagcagaggcaacccaggtgtcagtgttctttcttgtcttttctcccactctaggcccaagacccccagatgttggatcagctctccaaaaacatcactcggtgtgggctgtccaattccactctcaactacctccgagtgagtctccgaccacccagtttctgccccagtccatttagtctcggctccatgtctgtcccctgacaagccacctccttgtctacccctagctctgtgtgatactcgagcccatgcaagagctcatgtcacgccacaagacctacagcctcagcccccgcgactgcctcaagacctgccttttccagaagtggcagcgcatggtagcaccccctggtgagtgccttgcacctgctcttaccaggatctcacaccgctccccaaagctgtatctttatttccttttgaagttttccccaccccttccttgttcccgggtctacaaaattgggatcagggcaggctcatgctccttgggagccacaatggagaataggggacctggggccctctcccatctgagtctccgtttaccggcacagcggagcccacacgtcagcagcccagcaaacggcggaaacggaagatgtcagggggcagcaccatgagctctggtggtggcaacaccaacaacagcaacagcaagaagaagagcccagctagcaccttcgccctctccagccaggtacctgtaagcatctcggctttcttctctcttctgggctgccccaccactcacccctgacccctttccaagcctgagctcactagcaggcgtagaagcaaagacagtttttctcatgtactctgccagcatgggctaactgcttttactggtgagagagttcttgtcaggcacttgcatgggtgtgatcacacagactcagccataggaagctagggcataaagggacagagacacccatgaggacatacggatattcaggacagacagcttggggctcacagaccatccagcacacacactcacactgatagacatgcagactggagtgtttgcagatccagaatacatacccttgcacatgcacacactgccctccctcatgtttttgatatgctccctttcttacatgtggacagaagttgaggagtcccctaaaattttggggagatgggctagggagctaggggagtagagtgacttctagaatgtaatggatatgggctaaaggctttgatgctctggtgttcttcagtaggaaggattccaggagctgagggtgtcaggagttggggttttaaattcgggtatgaggagggggtggggactcttgagcttccagggtgggtactggggctctgggggtatctgccgccctgggccgggcgagcccttgccccgattatgtttggggacctccgccactctcaggatgtgatggtggtgggggagcccaccctgatgggcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcatctaaaatgggcagcctccatccacccgcttcagggaggaactggactctctgggggcaggtgccaagatttgcccccccagtggccctgggctgggcctggcctctacagagccttttagggggagggggtactcatgtggatgcctacttggaacctgggcctctgagacatgtcctgaccaccccccagggcatttgcctccatcttcaccccagattgtgggtttcccatccccctgactttacccctttcaagcctggggttgtctatacccacagcccttagggacttaaagttacggggcttcgttgaatgctccttcccctaggcagctggtaatagaggggtaaagctctgggcccctcctccctgctgccacttatcccagctccaagtttttttaaaaataatattattaaaaatgtaagttaaaaaaaaaatcactcatgtccccccctcttccccctattaaaagtccagctacctccctactcttggcagatgggggcctagggcctaggtgggggtgagagtgggggagggaggtgtgcataccattttatatggtgtgagagcttcagaccaaggagacatttcaccatctctccccctttcctctggggtgactgcagttgaggaaagcatgccatggggtagggggacattggtggccacattttggtgacagacccctgctgttgtctctgtgtccccattctctggactctggcctgccctcctagtgcttgtgactccctctcttccagccccacccccatggtatgtatattccttacaagtcctccacaagagcagctgtctaggatgcggggaggggaggctccttcccttagggagcgtggagagaagggagcagccttgttgctgtatttttggttttgtttcagttgggcaggcatgggatgggagaggggctcagccactttcctccagaatcttccctcagcccctccaactgcatatgtaatcctactctgtccttcatagaggggaaggagccacagatgacatcccagttctaagcccaccagggaggaacaggcctctgtccccataggtgaggtagaggtagagggtcttcacctgccagtatcccctgccgctccttcctcacagaaggaaggaggaggaggcagccgggatcctcggctctgccagggtgcagccaggagcagggtttcacgcagctggtccagctctgtggctttgctgccttttcctgtggccagtcccaggaagtgctaacaccacctctctccccactcttccctctggattctggggtcccccacaccgtatttcctccactccagctgccacttttggaagggtattgagtcaggagctgagggaaggggtgaggaaggtggacatcccatcccaactgtaatgcctttttttttttttttttttttttttttttttttttttttttttttgggccatttgagtcatgtatggtaccaatcaataaagagacttttcggtttgagagtgtcctggttggtcattgatgcctaataatgactcagtccaaggcaatcttttccccatccttgcagttcctaagactatgaattggatcccttcactcacctcacatttcccctcactcttgaagttgtttccctgaattacacttctccttcacccaagaccctaaagtttgttcccagatgtcccagcttggccccatctccctcaaaagttgagggagagttggctttctcagtctgctccccacctctcaccccaggactgttgcttctcacccttagctgtcatggggcagccagacaggtggccctcctggggcaggttcctgggatagactgccttgggttatgccgttgagggaggggtgggagaggggacttggcccaggagggggcttgggttagatggtcttggggtacttagagtacctgggagactcctacccctacccagcccccagtctactagcctggctgatgttggttggttagttggtttatttattttgagatggagtcttgctccattacccaggctggagggcagtggcatgatctgaggtcactgcaacctccacttcctgggttcaagtgattctcctgcctcagccttccaagtagctgggattacaggtgcccaccactatgcctggctaatttttgtattttttttttttttttttttagtagagatagggtttcaccatgttggccaggctggtttcaaactcttgacctcaggtgatccacccgccttggcctctcaaagtactaggattataggcgtggtccactctgcccggtcagcagctgaggtctaaattagtctcccctggtgctaaggtccctgggtgggggattaagagagtagcaggattgctactctccagactgggaagatatggagaccccgctgtagattg

SEQ ID NO: 14117 - DNA, 42846 bp, Human
tttttttgagtcggagtcttgttctgtcacccaggctggagtgcagtggcgtgacctcagctcactgaaagctctgcctcctgggttcacaccattctcctgcctcagcctcccgagtagctgggactacaggtgcccaccaccacacccagctaatttttttgtatttttagtagagaccaggtttcaccatgttagccaggatggtctcgatctcctgacctcgtgatgcgcccgcctcggcctcccaaagtgctaggattacaggcatgagccaccgtgcccggcccttttatgtgctttttaaaagtacgttatgtatttcagtttttcacacacacgcacacacacacacacacactcacacacagacacacacacacgttcttctctaggttttttctgtaaattttacatctctaggtgggggtagtaggggaagagaagcaggttttttttacagctgatgtgatcactgtacagacaagcttggaaaatgctacccaatctgccaattaattaaagcgttaatctgaggagcagccgggcccagggaatgtttacccagggaggagtgggggtggtaggaactgagtaggcagctccctatatttgcatgaaaatgaaggtgcttaggaaaccctgcttccttttgtctctaaaggtggggcagcctagatcacatccctaaacacttttggtctctttaggaagccttttagggagctggtctctgaaagatgaaagcacagcacaatctagaaaaacaaatttaaattctggtcagagtaaggtagggagtaagtacagtgtagtattctttgacctagaatggaatcttctaaattcaggagtaaaatttcatctatttaggtagaatagatgaaggggttttacaagttttaaaaccacataggctgggttcaaatcccagctctgcatattagttgtgtgatttgggactaatcatgtatcttatctgagccttttctcatctgtaaaataaagattatcaattgccccttcatctcagagcagttagttctctgctaactctaggcaggaaacaggccggacagtggttacgaacttccaagattacagactgcctccatgactaagagactgctcagccttttgttcttgttaaacttttttctcagcaagggattataaacctcagagtttcctctcaccctcctggaatatgctgcactctttctctaagagaagtgaccctgaccataacagcaaaggacataaagacaggagcccaccttgggacctaagggtcgcattggctctacccaagatgacgttacctatttatatcacaggggagggtggtgaaatgggcatggaaaattgactcacaatatttgatgatattgaaaaattattgttaatttttaaaaattgtgataaaatacatataatgcaaaatttaccattttaactgtttgttaactctttaagcataatattgtgggccaggcacggtggctcgcgcctgtaatcctagctctttgggagggcaaggcagggacaattgcttgagctcaggagttcgagaccaacctgggcaacatggtgtaaccccatctctactaaaaatacaaaattagccgggcatggtgacagacgcctatagtcccagctactgaggaggctgaggggcttgagccctggaggtggaggtttgcagtgagctgagatcatgccactgcactccaaagcaggactctgtctgacaaaaaaaaaaaaaaaaagataatattgtgtttttgttctttttttaagattcctaatcttttagatctacatgctgaaaattttacagataaaatgatacagtgtctgggatttgattcaaggtaatccagagggaagaagattgacccaacaacaaagacctctagcctcatggcacaaacaagaaactttttccagggtttagttttctcttagatgatacctcttcatttctgtgtattttcttgcagaactctcagaaattgagcccaatgtattccttcgaccttttctggaagtgattcgctctgaagataccactggccctatcactggactggcactcacctctgtcaacaagttcctgtcctatgcactcataggtaagagctcaggctttgttgcatgaccacagcacttcatttcccacctttcctggggtgcccaggccttaggcaatgagctggtgatagtgggaaattttttccagtcacctcttttcttgtagaagagaaataggattgttgttggttattcatcatgctagctgactcacgttgtacagggtgggaagggcaagagaagaagttttccttggcactctggcttctctatgctttggaaagagttaagggtatggtaccttactcttggaagtttggttaggtttgtttgtttgtttgtttgtttgtttagttagagatggagtctcactctgtcgcccaggctggagtgcagtggtgtgatctcggctcactgcaagctccacctcccgggttcatgccagtctcctgcctcagcctcccgaggagctgggactacaggcgcccaccaccacgcccagctaattttttgtatttttagtaaagacggggtttcaccatgttagccaggatggtttcgatctcctgacctcatgatctgcccgccttggcctcccaaagtgctgggattacaggtgtgagccactgtgcctggcctggttaggtttatttttaaagttattttttcaaacataatgcatgcacattataagaagacagacaatagagatgttcaaaagaaaagttaattgtccttcctgtactttctcaatgttcctcctccttctttaggcaaatagtgtgaacagcctagtttgaatctttatgtttttctatgtctttataaatgaagtaccattcctttttaaaatgaaataaggccgggtgcggtggctcacgcctgtaagcctagcactttgggtggccaaggcgggtggatcacgaggtcaggagtttgagaccagcctggccaacatggtgaaaccccgtatctactaaaaatacaaatattagccaggcgtggtggcgggcttctgtaaccccagctactggggaggctgaggcaggtgaatcgcttgaacccgggaggcggagtttgcagagagcagagatcgcgccactgtactctaacctgagcaacagagcgagactctgtctcaaaaaaaaaaaaaaaagaatagaataaaatgaaataaaaataggattatgtgctacatattttcttttttcatttaatggtattaacttgaccaggcacagtggctcatgcctgtaatcccagcactttttgaggccgaggcggacggatcatgaggtcaggagtttgagaccagcctaacatggtgaaaccccatctctactaaaaatacaaaaattagccaggcagggtggtacgtgcctgtaatcccagctactcaggaggctgaggcaggagaatcacttgaacccgggaggcggaagttacagtgagccaagatcacaccattgcactccagcctgggtgacagagcaagactccgtctcaaaaaaaaaaaaaaaaaaaaaaaaaagcagatagtattaacttaaatgtacatgatataactattcatctgatttattcttttatattgtagaaaatatatataaaacttgctatttccatcagtttcagtttacaattcattggcattaattacactcacaatgttgtgcagccgtcaccaccatctatttcccaaacatttttattaccccaaatagaaacttaacataatggggagttaacattaaccaataactccccatttctctctcccctcagccccttgtatgattttttttactagctctataatttccatagtgtaatatagatataacacaattcatgtgctcattcttaatatttaagattgtttcctattgaagtcataaataatgctaatataagcatccttgatcacatgtccttattaataatttttttaatttttatttttagtagagacggggtttcaccattttgtgccaccacgcccggctaatttttgtatttttagtagagacagggtttcaccatattggccaggctggtctcaaactcctgaccttgtgatccacccgcctcggcttcccaaagtgctgggattataggcatgagccaccatgcccggccccttattgctaattttactcttgtatgaaagatttctgaacttggaatttctggattaaagaccacgtgcatattgcatttttatagctattaccaggttgcttccccaaaaggttacatcatttatacttccaccagcagtgattgagaatttctacttccttaccctgtcatcagcactgaatattatcagttttatttgtgccaacttggtaagtaaaaaatgatattttgtttttattttttgagacagggtcttgctctgtcacccagactggagtgcagtggcacaatcacggctcactgcagccttgaccttcgggctcaggtgatcctcccacctccgcctcccaagtagctgggactataggcacacgccaccacacccagctagtttttgtacttttagtagaagtggagtttctccatgttgcccaggctggtcttgaactcctgagctcaagaaatccaccaccttggcctcccaaagtgctaggattacggatgtgagccattgcactcagccttttgttgcttttatttcctggaggctgaacatttgaatttcctgtccttcacttctttttttaattgagttgggtttgtttttcatgtcaatttgtaggagttctttgtatggtaggaatattaacccattgcctttcatagcattacaattatttgctcctaatctaggccaaatatttcccttaatctgtagtttatctctaaatttcttcatggtgtctttctttggatttcttttttagttggtcttgacactcaatttgggaattcattttccctgattggcagcccatgtacaaggatgaagaatatagaaaacaggcagctgtctttgtttcttaagcagggagacaagaaaagataaggctcaggctttagctagccagaaaagaaaatagtcttcagttcagagcaagaaaaccctttattctagaaatgttggatttgcttagctgatgcattcaggatcctgagcaggaatcctgggtaccaactagcttctgaacaggtgcatcagcctctccgacaccctagtcccagcttcatacttttcctaaacaaaatcaggcccagccacttccagccttgccctgagcaccacctgcaggtcatctttcttcacagcctccagtggctgccgctgctgtgccttttccctctgctgtcttgttggtgttactctttcctcttcctggacttggcagacaggctggtcattggagacctcaggccacctggtcattggagtttcctgtggtgggaaaggagaatgctggaggtggttattgcagtgggcatgagaaaaggagcaggaaggagtgtatgaaagccaagaaagcaaaggagatgggattggcagatttccctgaagttggttccagagtagccagaagaggaggacattttaaagaagggtttaggctgctcttctagaagaaaactcctgtctcttgctcctatgatccaaggtttcagggattattttagatcctccaaggactagccttttgtttggccccatacagctgccagaccagaatttttgtgccatggatttcatgggttgctagcaagccttgcctatggttcttgtcaaagacctgtcactctagtctgcctttttatttttattttttattggtttttattgagacagttcgctctgttgcccaggttggagtgcactggtgtgatcttggctcactgcaacctccatttcctgagttcaagcaattctcatgcctcagcctcccaagtagctgggaccacaggcatgcaccaccacgcccggctaatttttgtatttttagtagagatggggtctcgctgtattggccaggctggtctcgaactcctgagctccggcaatctgcccacctcagcctcccaaaatgctgggattacaggcatgagccaccgtgcccagcccataactgcctgtttagaaaattaactttgctacttcattcaacctcaggggacaagaactacaaagagatcagtagagcttaaaccccattaatggagtctctctgaatctattctggttgggggatggaaggagtgtctgattcaaagtaataatttaaaagacaccttaacaagagagattactgaaagagaggaagaaatggatccccaggagccttgtgagatgggaacaaggctactattcacttatctctgaaatgctacacaacactgagaaggacctgggtttcctatgtgggccctggtggcctgggtagggactgtcaggcagggctatgagatagaggccctgagagtatgggatttttttgtgctgatcgggagaaacgtggagaggtggtgtgataggaggagctgggtcaccccattttattatatgtcatgaaactggcttccttctgcatgacctctaaagtaactactcccagtgctgagtagaaggacactgtaaataggacaaagaaagtcttgatgtggtgtcggaggctaatgaggacagaagaaaaagaggaaacattcacaattagtaaaagacttctggcttatcattgcaagagaaatgtttgggggccaggcacagtggctcacacctgtaatcccagcactttgggggtccaggcaggcagatcacttgagcccaggagttcaagaccagcctggacaatatggggaaaccccatgtctataaaaaatacaaaaattctcctggcatgttagcacacatctgtagtcctagctactaaggaggcttaggtaggaggatcacttgagccccagaggtcgaggcagcagtgagccatgattgcaccactgcaccccagcctgggcgatagagcaagaccctgtctatttaaaaacaaaaaaagaaaaaaaaaagtttaggttctcagccatcccctgagctttaggctcaggaactctctgatttcaggtaccaagaaagagaaaatgggctgggcacagtggcccaagcctgtaatcccagtactttgggaggccaaggtgggtgaatcacctgaggtcaggagtttgtgaccagcctggccaacatggtgaaaccccatctctactaaaaatacaaaaattgctgggtgtggtggcaggcacctgtaatcccagctactcaggaggctgaggcaggagaattgcttgaacccaggaggcagaggttgcagtgatccgagatcatgccactggactccatctggcctggatgacagagtgagactctgtctcaattcaaaagaaagagagagaaaaaataacaacaatcttataattcctgtgactaaaattagggggtgttcctgcattacaccatgccacctctggagcaactttctctgtcactcacaaagctttttcatatgcctgccctttccccctacttaggctccccctttagaactaaacagctctggaaaggatccttcagagcagacctagggcaggagctaggcaagacccttgatggtgacaacttatttggctatttctcgtggctatttaatacatgaatgggagctgagttccctgcttaatagcatttgtgttcatttccagcgtggtgccggttgtctgacctctagcttctcccctcttattctgtacagctgaaattctccctcctgcctaccccccagctagtcagcctccagtcctgtttagtttatcttttttctctcctaatgcctgttaagctggaaacaggattcttgctcgtcgtcatattattttaaataagaatgaaactaaagaagaggtctttgggccaggcatggtagctcacacctgtaatcccagcactttgggaggccgaggctggcagatacctgaggtcgggagttcgagaccagcctgaccaacatggagaaaccctgtctctactaaaaatacaaaattagccaggcgtggcggcgcatgcctgtaatcccagctactcgggaagcctcaggcaggagaatcgcttgaacctaggagacggaggttgcagtgagccaggatctcaccatagcactccagcctgccaacaagagcgaaactccatctccaaaaaaaaaaaaaaagtcttcaatctgctgtaatgtggcactcagatatgagtattggcggcagtgagtgttcatttcctcctcctgctcccctaattcagttgcgcctgaacacaaaactccaaaagcaaccagagagagaagctgtgttgaaagatgaaaggagaaaaggccacaagctttggccctacctggttcttgttctgagtcaaaaactcttgtttccaggcccctcgtctatgaaattagtagatttatactagtgattcccagagtatggtcccctgctcggtggtgtttaacttcaactggggtcttgttagaaacacaaattctcaggccccactctgggcatacaaaatcaaaactttgtggtatgggtccagcaattgagaaccacagttttacccagtggattttgtgttgaggagctcattaaaaccagttatggggccgggtgcagtggctcacatctgtaatcccagcactttgggaggccgaggcaggtggatcacctgaggtcaggagttcaagaccagcctagccaacatggcaaaaccccatctctactaaaagtacaaaaaaaattagctgggcatggtggtgggcgcctgtaatgccagctactcgggaggctaaggcaggaaaatcgcttgaacccaagaggcggaggttgcagtaagctgagatcacgtcattgcactccagcctgggccacaaagtgagactctgtctcaaaaaaaaaaaaaaaaaatcagttgtgggcaaaaattctcaggtagctcaaggagccacgggttagggaactgaagaggaaaaactgtctctcaaagctagacaggctgccttaccttttatctctctcctctccacatcacttaatctttcctttttcgctggagcagatcccacccatgagggcacagcagagggcatggagaacatggcagatgctgtcacccatgctcgttttgtgggcacggatcctgccagtgatgaagttgtcctgatgaaaatccttcaggtaagcgagagggaaatagcaattaggctaatggccaggggctggtgccgcagactctacttactctgcccacagcatgaaactgtgttttgactccactggggcttaggggagctactttgtttccagacaagcagctggggtacccaaagtaaaagctttttctaaggaaaatcagtaaaagctttatatgaagtgatgtcaaataccagaagccttaaatacacttgtacctctggccgactgtatttgtgccgtccatctcttgggctcatgggctagggctagaatcagttctgaaatatgtcagggtcataaaaagtgaagaaacaattccaaggacaagcttcttggagacctctctaccaagctgaggtgaggtcagcattcttgctaacccctctctcttacccttgagtacctctcagtaccttgtttatcacagtaattcctttttcttcctgataggttctacggactctgctgctaaccccagtgggtgcccacctaaccaatgaatctgtgtgtgagattatgcagtcttgcttccggatctgctttgaaatgaggctcagtggtaggtgcttggatattagccccttcaccattcctggggccagtgtctgagtatgaatacaggaggctgtcttcccagagagatggaaaattcaggacttctccatcatctatctcatgcgatcataggggtctagaagaaatgtctgtacttggctattgtgaagctagaatagagacctcagcccattatgccagggcaggagttgggatggatcccagattgacttagcccaggcaccaaatcaccctctcttggggtttctgggattgacaccaacctgcaaccccctagaacacatctatacctccccttttttccctgactcagtagtgccacctagtgggccagtgaagttctggctgccaggctgagctggagctggttttaataagtttggcataatccttggtaaacaaggtttggaggggagtctgctctgagaaccctcttgataatagcacagcaagtaatgacacctgtgttatttgtttttgcctgtgcagagttattgagaaaatccgcagagcacactctcgtagacatggtgcagctgctcttcacaaggtaaacctgctgctgtttgcttcagcccggctgcccaggcctcttgagtctgcctgcttccacacagccacgtcagggacctggccaaccccacagccgcatcagaggccactgggattatggatggggggtagttctctgggcccagggttactgagcaagggagaaggaggagggagctgatttggcctcacggggaggcagagggttatttaatataggccagcagacctcattctgcttcccaaatttgtgtctgtttctgtgcaggtagcagctgggaaagggaacccagagaggaagccaaactcaagggatcatgatttctgtgggagagggccaaaattagggtgactagcaattgtgaattgcctgggactgtcctgatttcagcactaaaagttctgcatcctggcaaacccccctcagtcccaggcaaaccaagatggttggttaccctttggtaaggcccttagcctagggcctaggaggccttttcatactaggcctgtttcctgcacctcctttcaacagactcacagaagagctgaggcaatggctttaaaccttcctctgggatttctttttgctctcaaatctatagataataatccttattatctacagactagactgcccttggatcctgctgcaaagaattttttgctcctcaggctcaaatttactggtttcaaaacttcaacctgcctgttaattcttctcttttgcccactctcctagggttttgatagactgccctccccccatctcttggcagcagtatttgccaagtaaatataagcaggaaggaatcagtctcaggataaaaagagcctccacactccaagggcacttaccttgctctcacaactacctccttttgtccatgtcacacatcccccgattcctgtggctctttgatgaagctctgaaaaggatgaaattagtctgcttctcttttgtagccttttctaagacacagggcatgctctggctcagagcacctttggtttgtggctggcatggagggagacatttgtcattatccctaatgacagttgatggattttctatcttataggttacctcagtttaaagaagaacccaagaactatgtggggaccaacatgaagaaggtatgatctgagagctgatctgctgtccctcatccaaaccttaatctcccaacttcagtgccttggggtaaccttgcttagcaaagatatgcttttgcctaaacaggtctgcttggaatctagaagtagctctcactcctttcgtgagaaatgtattctcttccagatatatcccttcctcagcttttctgctctggcctatctttgaaccaccatgtaagctggtgagccagttcttcatggaaactgcatggtacccatcagtcttggctaaaaatgtctgttgacaaagatgaaagtcctgccatcccctcaagacttagccttatccgcaggtagaaggcctagagaggctatgtcccaaatcctacctcaatgctgaattagactgggctcttgcttgtgctagtctgtattgaagagattagtcaagttaagaaccaaagggttcttaaactgctaggagaagaatagtggtcaaaagaatggcttctttctatcttgaactgaagccctggacttcacgggcctctgatgaggattccgcttgcagccctaagagggtctacctatggagatgacccttagctgtgtgatgcatgcacctgaccttctcctctcccctgtcatccatccccattcctgccctgttccctgttggtatgtgtctgagtttatttcactgttaaatcgtgcgtttgcctgtctttcgcagatatctccatgtctcctcaacaaactggagctaagtagtggggagcagaccaaagccctgaaccagttagagagggtactactctttaagaacctcaaggtctctctccctctctttcccttcccctttttatttctttcaatgtttattttttatatataacacctgggtcccatttccattgtgtagagcacaacttactcctccctagtaacacagcacggctttggaagagttgcacgtgattgtagctttgcagtgttgggaattctcctggggcatctggttgcctggatacaggagaaggaagacttgaacatcacatagttagcctagaaagcctggggtctgctgttaccttgtggggaggcttaagatctaccatttctagggaaaccgtgagggaccttcaagcaagacccttcccccttctaccttatccttgtctcagagctggcatagagagcttaagcacagtcctcagctctatctggattacctggactgggtttggagggaaagggtagtccatctagttgggatcttttttttttttttttttcttggttaccattaaagaggtcattccaaggattagaactctagattgatggaaagaagccaggtgccaggatagcccaggacactgggaatactttgggatctgtgaagatgccctctgtcctctaaaagtcaaggtataggggagcttaggggagggatccaagctaaagattaccctaatctgcatatacctgccttaggaagaaaggggagagaaggaggtgtgggctgtctgggctgtccatcacaagagtgtgcatgctgaaggtgtggttgtggacatacaggtcactgaaagtaaaaaactctgtgtatgtacacctagctagatagtccattggcccgtgttctctttgaatgcattgtgtcatttcatttgtgtgcttgcacagtctcaagctgcagctctcattagtggctatccagcatgttgccatgattattaacctgggacctgctccttttttgtaaagcttacactgtcctttggagtacagagtcatacagataaggtggcgtagaattccatgaatacctactgcccaccccacaccttcagaccttaggagagggagaatagctataccttttaagggctgaggcattcgtgagaactggcagcctcttggcccctactccagccagcaggctgagaacactaattgaaatgatcaggttggagcaagctttgcagaagatagagaaggaaacgtgaaaaactgatcctcgtatgggaaggaatctcaatgactgactggcttctcagtggaagtaggactgcctggagtccctgaaatgggggagcctcctggagagaaaggctacctcataaaagtagatccagttcttagtacttttgggagctcaatgataactgccagtagagccaggaggtctctcattgatctcttggcctcttgcccttttgcatgtttggcggactcttctcccataacattttttactatgaacttgatccagttgagctccagtggttcctggggagagaatccttttgcttcctccttagctatagcggtcagtacgcctgaagctcagttctaagcatatgactgcaggcattttggagatggatcatctagaagtataaatccagtatgaggctgttgctatgttactaagagctgggggaaggaagggctcagctgttcagcctcatctttattggaaggagctatgggtaggaatggaagaattgtgtggtttctaagcaaggaatcaaagattacccaggttctgagagcttgggggagcttgaggaagggagtcaatccctcactatcaaaaggaattgaacaggccatggacaataggatatattcagcctttaggaagaggcagagagaaaaagtgcttctgctctctttagagtcattctaatggtttctggaagagtgttgccattgcccaatccaggaatggtccaatccaagaatggtctatcagtctaggaatagtttagaatgactttgtagagggactgagttcaaacccaactgagaaaacatcagggcttaaaaaacaaattgggccgggcacagtggctcacacctgtaatcccagtactttgggaggccaaggcgggcggatcacgaggtcaggagatcgagaccatcctggctagcacggtgaaaccccgtctctactaaaaatacaaaaagaattagccaggcttggtggcgggcgcctgtagtcccagctactcaggagactgaggcaggagaatggcgtgaacccaggaggcggagcttgcagtgagccaagatcacgccactgcactccagcctgggtggcacagtgagactctgtctcaaaaaaaaaaaaaaaaaaaatggggcctaaacaaagtaactttgaacttagaatggaggaaatacataaaaacacagatcctagggaatagttaacaaacaggtgatagagattgtcccttgccactaaaagtaagctataggaagaacagaaatacagcaagaggggagtgcaacagagcaaggagtcaaggaatcagtggccttaccatctgacaacataaaactgcatctggaaagaccaatagtgagagggccagagggacaggtagtctcattgatataacaaattgggagcagcagagagcacagcagcagcgtgacatgaccttctatcctgaactccacaaagaaactgggaggccactccttccttaactccaaggaatgagcttttgaccaatctgatacagaaattccagagagtaagagatatgttagctgggtgcagtggctcacacctgtaatcccagcactttgggaggctggggcaggcagatcacctaaggtcaggagttagagactagcctggccaacatagtgaaaccctgtctctactaaaaatacaaaaattatccaggcgtggtggtccacacctgtaatcccatttactcaggaggctgaggcaggagaatcacttgaacccaggaggcagaggttgcagtgagctgagatcgtgccactgcactccagcctgggtggcaaagctagactccatctcaaaaaaaaaaaaaaaaatatgtttatggcttaggcccagctcacataccagtaagaaaaccaggacaggaaggaataggctcttatagttggataaaactacaagtaggaggctgctctacaagctagttgaggaggaaagccgagagaccatgcacctgcagaactgagtgtcagggcaaaggaaaccctgcccttacactttctgcaagagggtcatgcatcatccatagggctcgggatttcctgcttaatgtaacactcaggacccagagaagcagagtgataagtgtgaggactggccctaccaatgaccagcccagaaacagaatgtcaccttctacatggaggctgccatgccaacctgtgaagtggtaaatgtagaagccaagttagaagagtaggaatgtgaactgatggtctagagtcttactttagcaaagatatggggtatagcttgttttctagagatcagtaggactaaatgaagggagattaatagggatagagtcttagtttgaataccattgctaatggggtatgatatttccagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtgagtgccctggactacttcctctgattagacaaaagaagagctcctttctctcttagggattttgaaattgaagaccaaccaactgaggggctttggtcttggcgctgagaacaaaaagggaaactccaggtcaaatcagagtgtgaccattcagcaactatgcagtgacttaaggttgttctctgacaactttagagaccaatatatgcaaagataagcatgtaatctgggaaacagagaccctagtaccatagagggtttgttttgcccacagcctctttcttctccttcaagcgtcacatacttttcttggcaggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggtatggctttgatttttaatgtccctcttcagtattccactgtgggaaatggcttgatcctttggatcctttatgcaggacttggctcgaaagaagcttggggtaacttcaaaagaagctctgatctttcctgcttctcagaattggttgtactgccttgaaaacccacagcatgactcactgtgagagatagctcatgagatttatcaagttatgcatataggtagtacttgacaaaagggaaggagctggccattgctttttctggaaggtaatgatccaaatcctaagcctgtgagaggctctgtgtctctaaggttctagtcattgtaggtcagtgaagcctcaggagatgtttttctgagtccttcatcatactcctacctgagccatcttgcggtgattcataaaccactgagttggccctacatctgtagcccattagagacagcttggaagacagctacttcaggggagtaagttccaagttgctcttgcctcatccctcttcccatatctccctgctactggtcatagcaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggtgggtattctggtaggctctgccaattcacctcccccatcctacctactaagctgcctgagcctagaccgtcttaaaccaagatattggactactgcctgttgctccaagttctaggctattttctagtcaggaaatggagtcaagccatagactgttggcatggagggagcccttccctaacttatactacagggaggaagtttgatgggcaataggaagcaagaaggaagggaaaaaagcttaggacttttaacagaaaggtaggatcatcaattctgatttcctccagaagtagactagtcccctcatgtccccaggaaaaaaaaaaaaatccttttcctttttttttttttttcctgtcgcccaggctggattgctgcagtggcacaatcacagctcactatatcctcgacttcctgggttcaagcaatcctcccacctcagcctcccaagtatttgagactataggcatgcaccactgcacttggctacttttaaaaaatcttctgtagagatggggtctctctgtgttgcctgggctggtctcaaactcctggcctcaaacagtcctcccaccttagcctcccaaagcactaggattacaggcatgagccatcacgcccagcccttttcttcaaagagaatcacttacctaaaattgccttgtgtaatgcagagcaggctaggcaaagccagcagactagttgttttatagcagtctcactctcctcctggccttccccaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccaggtaagacaagattgctagagggtctcagagcctctttcaagggccaggggaacacagggaggtctggctgattacgcaaagagtataggacctaggaaagcatctccctcccagttggctagtagttttagtaagagggttccagtagttccccagggactctggcagccagagagaaatataggaatggctagatgtagagttccctggaagcaatggacctcagtgacaccttcactcagtttgcctcttctgcctctcttggttgagccatagtcagcttcagaaacctcacagccgggctgggtgcagtggctcacgcctgtaatcccagcactttgggaggccaaggcgggcggatcacgaggtcaggagattgagaccagcctgaccaatgtggtgaaacccagtctctactaaaaatatcaaattagctgggcatggtgacgtgcgcctgtaatcccagcttcttgggaggctgaggaaggagaatatcttaaacccaggaggcagaggttgcagtgagctgagattgcgccactgcactccagcgtgggcaacagagtgaaactccgcctcaaaaaaaaaaaaaaaaaactcatggcctaccctgctctcatctccagctactcagcatagagcgactaaacctttatgctgcttccctgcgagtatgcttcctactgtttgagagcatgcgagagcacctcaagttccaaatggaggtgagtttcttgatgtggaaagaaaagggggaaaaaaaatagggagatatatggcatcttcagtggggccagctctatcatgctacaggggtaggatttagggacttcctataggagagtccttttagcctccagagttcggttcaatcaactggcctcttttgtggaaaagttaaaaggagaccaaaggaaactggctgaccccaaatatgagaactgccaggtaaccttaccatgaatagggacagctcttctgcccagcagttactctgcaacacaggtaggtaagtcaagccagcattgtcactaaattgctaaaaggaactctaaataggaccaggtcatgttcacatagcacaaaagggcaagaggcaacttgtctgggaccaggtatgtggtagagagccaggccttatcccccaacatggaggccaaagaagagatatatttaggggatggaatacctttgggtgtctcttaatacatgcctctaggctgggcttctgcatcctgtttaatgtttttcctgtctaattttttctcttcctatcttgaatcctttccccacccaaatggcaattactgggttattgccagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaaggtgctgagcactataactggcttctaggaaaaaacgcattataaaggaaatctccctggtggtagtgaggatgttacatacagagaggggaacacttgagagctgggaaatagaagaaaggcattttcttttcttttcttttttttttttttttttttttttgagatggagtctcactctgttgcccaggctggagtgcagtggcgcgatctcggctcactgcaagctccacctcccgggttcacaccattctcctgcctcagcctcccgagtagctgggactacaggtgcccaccaccacgcccggctaattttttgtatttttagcagagacggggtttcaccatgttagccaggatggtctcgatctcctgaccttgtgatccacccgcctcggcctcccaaagtgctgggattacaggcatgagccaccacgcccggccagaaagacgttttctaagggcaatgtacaagttagaagaagttttggaaattttagaaaatgatcaaagtgtaaagtgttctcctaactacaagtccaattgatctgtttactttccagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatagtgagaggcatttctttctttgatgaacccagtgttctatgcttatcccttctctactctctgagtcgtttttcctgtccccatatcacttcccctgggatgctcccaattctgtttctgggctttggcagtttaaatcacaggccagtcaggcagattagtagaactcatagccttctccctttttcctcctccccactttggttttttacagaattattatttctttatggcaagagaagagaacagagattaaagaatataggatttctgtctctgaaagctccaggtcccaccatccctcatccccaatatctgcctccactctaattagtcctctctagctcccccttgaaatttgaggttgcagaagatcagggaaagtgactgggtaatctcttcattaaattagagaatctaatgcttggctgggacagggactacttattttggcttgggtttgtcctgctcagggctggcgccctgtgcaggaaccatgcaggtcttctgggcttgggatttgatctatcctgcagctctgcttggcttcataccctataagtcttcacgtatcttcttctctcttaccagctgagagaactgccagcgatgggaaagctgtaggcatggcctcagacatcccaggcctgcatctgccaggtggagggcggctgccaccagaacatgggaaatcaggatgcagtgatctggaggaagctgttgactctgggggtgggtactgggtgtccatgaccctaagctcctcacctggagggcctggtgaagagcagagggagggagcagacacctaggatagtaactaagcaagccttggtagcccgcctcgccttcagactcagagagagggaagcaaacatatggaccctcagttgataggacttccagggaagtggaagactggtgaggacaagatttctgaggctccttcttgaaactggggagtatattggtgaccttccaaaagtccttatctgggtaaaaaaaggtgttacagatatttcccccctcttcttcctactcctagctgacaaaaagtttgcccggaagccaccccgattttcctgtctcctgccagatccacgggaactaattgaaattaaaaacaaaaagaaggtacatacatgtattccccagcctctgtccacctctgtctgggtgtccagtgttgtagggtttccatctcagaagatgaaggagagtctagcacctcattgtacagcttcctgaggccagtctttgggcttgttgggacttcagcaactcccatttgaagcccttcccttactcctaagctatgtagttgagcataccctatgtatgcccctgcgcaaatgctgtaccagttgagagccaagtgtcactagtggcagtgacaggagccttgggagttggtgtcttgtgggtcattgaaggttactgtcatctccagctcttgcaagatgattggcaataaagggaaattgatattcattctggtgctttagtaaggttcaaatagtaaggttcaaataactgtttgtactttggatttctttttttttttttttttttttttttcagacggagtctctctctgttgcctaggctggagtgcagtggcatgatctcagctcactgcaacctccacctaccgggttcaagcaattcttctgcctcaggctcccaagtagctgggactacaggcgtgtgccaccatgcctggctaattttttgtatttttagtagagacggggtttcaccgtgttagccagggtggtcttgatctcctgacctcgtgatctgcccaccttggcctcccaaagtgctgggattacagtcgtgagccaccatgtctggcctgtactttgggtttcttaacacaaagaaaacctaaccctttctggccgggcgcagtggctcacgcctgtaatcccagcactttgggagatcgaggtgggcagatcacctgaggtcaggagtttgagaccagcctggctaacacgatgaaaccccgtctctactaaaaatacaaaaattagctgggcatggtggtgcatgcctgtaatcccagctactcgggagactgaggcaggagaatcagttgaacctgggaggcagaggttgcagtgagctgagatcacgccactgcactccagcctgggcaacagagtgaaactccatctcggaaaaagaaaaaaaaaacctaaccctttctttctcttattgccagcttaaatgactttggttcatgtgtgcccttgagtacctggccgtgactggacatacagaaatatgagttgcctccacagttagtccactttgtctttcaaacccagggcattaagctaggcaaccaaagaagctaagctaggctaaaaacaagaggctggctatcaacaaatgtcagggatggatataaaactggagagaagaattacctagtttctttcttctacttttcccccgatcctaagttagagaagaggaactgttttatgtatcttgagcactcaggaaaggagtaaaaaagagctcgtaagccaattcaattagacatgaagatgggggaagctaaggccattatgatctagccttagttctgtaatcactaagaaccacatcctaggagctttttagctgaccaactgtgggtgggctatggtggactccaggctggccttgtctaatttagaggcaaagtagcttctatacctctagtttttctcatgcagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgaggtgaggaagctgtaagaaatgtgggatatagccaggtatggtggctcatgcctgtaatcctgacactttgggaggctgaggcaggcagatcactcgagctcaggagttcaagaccagcctgggcaacatggtgaaaccctgtctctacaaaaaatacaaaaattagctgggcatggtggcatgtgcctgtagtcccagctgttcaggaggctgaggcaggaagatcacttgagtctgggagttcgaggctgcagtgagctgtgatcatgccactgtgatagagtgagatagagtgagatagagtgagatcatgccactgtgatagagctgtgatagagtgagaccttggctcaaaaaaaaaaaaggtgggacatggttagtgatcagtttaaagggacagaacatccctacctcaaagcggtctctataaatttcttctggagaccctagccaatgttcttcctctacccatcatttatatctattggacctgaaagggactccaacgagatagtttggggagccccctccattctgcatggagtccattccaaaggggtagagcagggttccagggggtgagggttctaggcaagagtccgtggatgtgaaaagtattaaggctaggggttgtgttagggatgaacaggagatactgcccctttactagagacctcagcctcctctcttccagtaagagtaggttaggaggacagtgactaaaagagcctgacatgtgcagcttacacattttcagcctcttcttcctttctttccctatagcaccttcagttttcagggtctgcgactggacgaagccctccgcctctacctggaagccttccgtttgcctggggaagcaccagtcatccagaggttgctggaggcattcacagagcgttggatggtgagtttgagtgtcaggggctgagcccaggatccaaggtcagtttgactgagggctgaagaatccagctgctgtctcttttttttttttttttttttgagacagagtctcgctctgtcacccaggctggagtgcagtagcgcagtctcagcacactgcaacctccaccccccgggttcaagcaattctcctgccttagcctcctgagtagctgggatttcaggcacctgccaccaagcctggctaatttttgtatttttagtagagatgggttttgccatgttggtcaggctggtctcgaactcctgatctcgggtgatccgcccacctcggcctccctgagtgctgggattacaagcgtgaaccaccgcacccagcctgctgtctcttaaaaagtcagagagcaaaattagtgacctttccacaaagagatcagcttctgttaaggagttggcaagagactggccactttctggatggtacctctcctctgtactagcactgaccagtgggttggtagtgagggtttaattggccagagaagggcattgacacaggcgggatctttgctttttcagaattgtaatggctccccatttgccaatagcgatgcctgcttttccctggcctatgctgtcatcatgcttaatactgaccagcacaaccacaatgttcgtaaacagaatgcacccatgaccctggaggtaagcttgggtcccagtcaaggcaaagaagacccagcacagcttgggaggtagcaggaaggacataggatttccagtgggcatgatggatggggttctgtccaagggaatcaggaagggctggccaacctagaaaagggactggggtggggaagtgggttttttcgcttaccttttcctaagtcctatttactgaaaacccaagagttccttaggtggggcttcagtgttgacacaaggggaaaaaacttactggcctgtctctaggagtttcgcaaaaatctgaaaggtgtgaatggaggcaaggactttgagcaagacatcctggaggacatgtaccatgccatcaagtgagtatacatagagaatagtgcagtatctctgttaagaagaagcacattgcttcctttcccagtttttagagtcatgtcagactgcagtgactcacatgccctggatttagcctcaggacttagttgggcagccccctctctgccaactgtttcttccttaaagaagcccaaatgatattgggactctagtactctaagccagggtccaaagtgctgctcttaagtaggatatcatggccccattttctgaacttaaaacaggtacattttcctgtatagattacaagatgctggctggtagagaacccaagatgggcactggagtgtgaggcccaggttacaggtcagaaatgggccacttagttttttactgtaaatcagaaaaggtagaattgttcattttatcacacctagtaagaatgtgtgatcttactatagaactaaaggcctcacttacagatagggctttgagattatgggacacttcctttctttctgtctgctcccactggtgggtggaaagcagaccactgagctgcagttctgatgacctctcatcagtggagagtgctagtatggatgaactcctagtcttggtttggaactagtcaggttcaaagcagtgcaactgctccttcccttacctcctgacaggaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggtagcccagctttggccttggtcttcacctcccactagctctgtgagctaacatggttttctccatgcctctctgactcctactgttacttcattagaatggggttccccctgagtttttggagggaggctgaagcttgggtaggctcagtcttaaacagaaacaaaattaaaaggtttcttcctgggactgactggggaagagccccatgcaagctcagggacttggaagggctgcttggccttccagtgactctgtttctgggatggggggtaacattacaggaagtgcgccatgatctccgcccactatggcctcagcgatgtgtttgacaatctcatcatctctctatgcaaattcacagctctcagcagtgaggtgagcaggtgcaggaactgtgtacttggagctccaaaggaggacctctcttttagccatggatctacccttatcaacagacctggttgccctcagcgtcttccctcactgcccccacttgaatataccagagcttaggccatttctgtcttgcacactctgggataaaactagtgttacttcatgtaatggggatgggaaaggagatacaggagtggggaaggccttaactaggttaacccactcccaccagtattatgggggattgaagcagagccaacaaaaggacctgagggaaccatcataggcagagacctaagagattttcctttccagacattagctcggccttaagtctgttctcatcctcttttccagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtaattcttagtaggagactagtgagcgataacaaggcaagagctgcaacattgtatgctacctgtacatagaagtaagtggttgagagtaatgttgggcctgatgcctgccacagctcaccaggaatgcctcaaatgtaagaccacagatcttgggggatagctgtaaaagaaggctggtagatgccattgccagtcaccaattggcacaatagcataggggcagaagactagaggaggaaatccagagaactttggtgggtggaggcgggcacaaatgcaaaggacacatggaaagaaattattttgacttacttttccaggtagaagatttcgtggatcccaatggcaagatctctctacagcgggaagagacaccatcaaaccggtaagagcagaccagaggctcaggggcttggggagggagagtcagaactttggggctcaccaggccatgtgccctttttctacagaggagagtcaacagtgctgagctttgtgagctggctaacactgagtggtcctgagcagtctagtgttcggggcccatccactgaaaaccaagaggccaagagagtggccttagagtgtataaaggtaactgcccatccacccctggtgagaaagcctaaacaccttcctattagatgctacttggtgaactgaagaataaatcatccaggatttgtaaccagggctgactctgccctctccccctggctcttggggacattctgttctcttcagcctttgtcaaagaccccctctctcttttgccctctctagcaatgtgacccagaaaaaatgatcacagaaagcaagttcctccagctggagtcactacaggagctcatgaaggtaaaggatgaagaaaggaaacatggaacaactggctgaatctgggaggggtgacagggacagtattatttctgtcagggcagggccagtggttggcttcttttccatgcctactttcctgctgctgttccccttcaggctctggtctcagtgacaccagatgaagagacatatgatgaggaagatgctgctttctgcctagagatgctgctaaggattgtgttggagaacaggtaagatgagcgtagtctttaggcagaccccatgctgggcttgtgccaaagggatggaagccatcttgctgagtgggctctggggaactgtaggcagcaggggagaagcttactcatcatacctgtctacttagggtataataccaatgagtcctgaaaggcctaggggacctgttgcccagtggcccctctggctgagactatcttcattcctttatgtctacacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtaagcagaatgcatcttggagagtgggcaggtatgcaagggattaaggccacagttgtcaattatgaatatggcctgagacagagagtacatttagtgccccatagcatgagtccagtgaccaaccacagggctggtgcagtctagcgggtggtactgggagtgagcctggaatggcctcaggcatggagcttgtgtttggcacctcagcctcctatgaatctgctttgtaggactggcctgctactgccttataatagtctcagccctatacctggtttcctgtcatgcttatgaccctcttgagatctctttgcttaactacaaaaaacaacaagcatagaactaataagtggattcaacaaggtcacaggatgtgagatcaatacacaaaaagtaattatatctctacatgctaacaatgaacaatatggaaactgaaatttaaaatacaataccatttacaagggttccaaataaagtgaaatacttaatatatagctgacaaaacatgtataagatttgtatgatgaaaactacaaaactacaaaataaattgaagaagatgtaaataaatgaagaggcatactatgttcatggattggaaggctcaacatagtaactttgtcacttctccccaaattgatctgtaaattcaacataactcctataaaaatcccagaaaggttcttgtagacataggtaagcttattctaaaatttagatggaaaggcacaagctctagaatagctagaaagaataaagtggaaagaatcactctctctgggccggttgctgtggttcatgcctgtaatctcagcactgcgggaggccacagcgggcagatcacttgaggtcaggagttcgaggccagcctggccaacatggtgaaaccccatctctactaaaaacacaaaaattagcagggtgtggtggcacacacctgtaatcctagctacttgggaggctgaggcaggagaatcgcttgaactcaaggcggaggttgcagtgagctgagatcgcgccactgcactccagctgggtgacagagtgagattctgtctcaaaaaaaaaaaaaaagaatcactctggtattaagacttactgtccactttggggggctgaggcgggtggatcacgaggtcaggagatcaagaccagcctgactaacgtggtgaaaccccgtctctactaaaaatagaaaaattagctgggcgtgatggtgagcgcctgattgctactcgggaggctgaggcaggagaatcgcttgaacctgggaggcggaggttgcagtgagccaagattgcgccactgcactccagcctgggcaacacagcgagactccatctcaaaaaaaaaaaaagacttactctcggctggacacagtggctcacgtctgtaatcccaacactttgtgaggccaaggcaggcaatcacctgaggttgggagttcgagaccagcctgaccaacatggagaaacctcgtctctactaaaaatacagaattagccaggcatggtggggcatgcctgtaatcccagctactcaggaggctgaggcaggagaatcacttgaacctgggaggcagaggttgtagtaagccaagatcacaccattgcactccagcctggacagcgaaactctgtctcaaaaaaaagacttactgtatagctatagtagtcaagattatgtggtgtcgatggagggacagacacgtagatcaatggaaaagaatagagagaccagaaataagctcaacacaaatatgttcagtggattttttgaccaagatgtaagaacaattcagtggaggaggaatagccttttcaataagtggtggagtgattaaaatccataggaggaaaaaccaaatgaaccttgacctaaacctcataccttacaggaaaattaactccaatggatcatagatttaaatgtaaagctataaaaactttagaaacaggagaaaatcttcaggatctagagctaagcaaagaatttttagcatgtttggcagtcctgtggatctgtctcttgcctcaacactgtctggatggaacagatccgggggagactctctttcaaaaaaagtaataatttttagacttgacattaaaagcacaatctagaaaaggaaaaattgataagttgggctacattaatatttttaaaagttttgttctatgagagcctatgtgaagaggatgaaaagacaagctgtagacgaggaggaaatatttgcaaatcacatatttgaagaaaggtatctgtaatataaaaactctcaaaacacaacagtgataaaacaatccaattattaatagaaaatggacaaaacataggaacagatgtttcaccaaagaacacatacagatggcagataggcacatgaaatgaagatagcatcattaaccatcagagtactgcaaactaaaaccacaatgaggctcacacctgtaagcccagcactttgggaggctgaggtgggtggatcacctgaggtcaggagtttgagcccagcctggccaacatggtgaaaccatgtctctaccaataaatacaaaaattagctgggcgtggtcacacacacctgtagtctcacctactgaggagattgaggtgggaggatcgcttgaacgcaggaggttgcagtgagctgagatcgtgccactgcactcctgcctgggtgacagagcaagactccaaaaaataaaaacacaatgagacatcactacccacttttcagaatggctgaaataaaaagtagtgacaataccaaatgctgaaaggacgtggagaaactgggtcattcatatattgctgggtgggaatgtaaaatggtacagctactctgctggcagtttcttataaaatgaaacatataattaccatacaacccagcaattgcacccttggacatttatcccagaaaagtgaaagcttactttctcataaaaacctgtacatgaatgtttatagaagccttagttgtaatagccaaaaactggaatcggcccagatgactttcaataggtgaataaactgtggtacatacacaccatggaatactattcagcaatttaaagcaacagacatctccagggaactatgctgagtgaaagaaaagccaatctaaaaaggttatgtaatatataattccacttatataacatttttgaaatgacagaactttagaatttgaagacaggctgggcgcagtggctcacacctgtaatcccagcactttgggaaactgaggctggtgaatcacttgaggtcaggagttcgagaccagcctggccaacatggtgaaaccccatctctactaaaaatacaaaaattagccaggcgtggtggctcgcacctgtaatcccatctacttgggaggctgaggcaggagaatcacttgaacatgggaagcagaggttgcagtgagctgagatcctgcctgcactctagcctgggcaacagagtaagactccatctcaaaaaaaaaaagaatttgaagacagattgctaaggattagggatgggggcaggaaggaggaggtgggtgtggttataaaagggcaacatgagctgggcatggtggtgcatgcctgtagttccagctactctggaggctgagacaggaggatcacttgcgcccaggagtttgaggctgctgtgagctatgatcataccactgcactccagcctgggtgacagagcaaaacctgtctctaaaaaaagaaaaaggcaacatgagggatactgttgtggtggaactgttcagtatgttgttttgtggtggatacccaaacctacacaggtaataaaattgtatagaaattaatacacacaaaaatgcaagtaaaacaggaaatctgaataagatcagatagtatcttgattatgatattatactatagttttgcataatgttaccattgggataaactgggcaaagtgtataagggacctttttgtattatttctttacaactgcatatgagcctataattttctcaataaaaatttgtatttgaggctgggtgcagtggctcatgcctataatcccagcacttcaggaggctgagacgggaagatcgcttgagcctgggagttcaagaccagcctgggcaacatagcgagaccccatctttccaaaaaagaaaaaaaaaattagccaggtgtggtcacatgcacctgtagtcccagctactccagagactgaggcaggaggatcacttgagcccaggagtttcaggttgcagtgagctgtgattgtgctactgtgctccagcctgggagacagaccaagaccctgtctcaaataatataattaatatatttctatttgaaaaaaaaaaaaaagaccagagcagtatcctaaattgggtcctagccaaactgtcttcactggcctaaggagactggtgggaaagaaaactagacaggaagctgtgtgcccacacagctccccgcttccccgctccctgccctaaccccactccaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggtaagccctttcccagggagactcaggctggcagataaacagttacaccccaggagttgggacaggaaaacaaaacacaggttactgtgttcagcagattaaacagccctggctcctgccatcacttccagagcttccagtgcccgctggctagtacccataagttaaatagcatgagggcaaataagcaatgcagacggctgtgaagccaggcttcctactgtcctgaggactgatttgtcctgaggactgtttcccagtttctgtttctgagctgtcccgaggactgttttcccagaattctgggaaaatagaattctgtgagcagactttatatcactaaatcgatacatcactaaatcccagaaactgggaaaacagtcctcaggacagtggaaagcctggcttcatagccttctgcattgcttatttgtccttgccaccactccctagagtggtgctacagctgccactagatgccatcaggaacccagattagcctgccaccttatttggtcaacagagaaactgttccggccatcctttggccctctggtgacagaaattaaactatgccagagagaggggaggccaggcctcagcatcttttttctgagagcctgatttatccctcatcccagtgccccatccccaccctgactctgcccttctccctgcctaccataggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggtgagtgacaatatgggcagcaattgagtctctcctgcttgacctgtgggaagaattcctggtcctctgcaaggacattcacacaggggccaagcctgtgtccccagctcctctgtgtactttacaggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcatcgtgcgtgatgctgcccacatcacacctgacaactttgagctctgcgtcaagactctccggatctttgtggaggccagtctgaatggcggtgggtcagctgatgagggggcagctggggagtagccatgcaattatgcaggggagaggctgagaggggagaaaaggcagggtatctatgcctatatagacacagaaatgtgacctgagtctggctctgctcaggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacaggtcagtcaggacgtaagtatggcaccctttacttcctctcctcccctgcacctgatactgggagcctggggcggccagggaaagccagggctgaggggaagggcccatgtgtgccagcccaggccctggaccaccatcttcacaatattcccttacccaaaaccttacctgtaagtctttatttgcttaaatttatttatttatttatttttatttttatttatttatttatttatttattttttgagatgtagtctctctgtcacccaggctggagtgcagtggcgtgatctcggctcactgcaacctccacctcccgggttcaagcgattctcctgcctcagccttccaagtagctaggactacaggcgcgtgccaccatgcctggctaattttttgtatttttagtagaaacggggtttcaccatgttggccaggatggccttgatctcctgacctcgtgatccgcctgcctcggcctctcaaagtgctaggattacaggcatgagccaccacacctggcctttaaatttatttttaaactaagatttacttattttttgagtaggttcaaaatatacaaaagggtaaactgataaaactaagtttccaatccattcctgtccccagcttctgagttcccctcactagaggcagccactgtcaccagtttcttgtctatccttccagagttaccctgtgtctattcaaaggcatataaaattaattatgtgagcagagtttatatcactaaattgatggagaaccaattgccttaaatagaataaccatacaaaaatgacaaaagtggctgggcttggtggctcctgcctgtaatcccagcactttgggaggccgaggcgggtggatcatgaggtcaggagatggagaccaccctggctaacacggtgaaaccccgtctctactaaaaatagaaaaaatagctgtgcatggtggcaggcgcctgtagtcccagctactcgggaggctgagacaggagaatggcgtgaacccgggaggcagagcttgcagtgagccgagattatgccactgcactccagcctgggcgacagagcaagactccatctcaaaaaaaaaaaaaagaaagaaaagaaaaataacgaaagtaaaaatgtattaaatctggccagacactattgcccaatcaaagcctctgagcctgaggttttctgttttaaaaatgagattaacagccaggtacagtggctcacacctgtaattccagcactttgggaggctgaggcgggaggatcacttgaggccaggagttcgagaccagcctgggaaaaatagcgagaccctgcctctacaaaaataaaaatgcaaaaattatctgggcatggtggcacacattgtagtcccagctactggggaggctgagtagctgagtaggtgggaggatttcttgagcctaggagatccaggaggcagtgagccatgatggtgccatgcactccagttttgcacagagcaagaccctgtctcaaaaaataaaataagaaataaaattaggccgggcatggtataatcacacctgtaatcctaaaactttgggaggactattgcttgggcccaggagctcaagatcagcctgggcaacatggcaaaaccccatctctacaaaaatacaaaaaattagctggctgtggcagcgcacagctgtagttccatctactcataaggctgaggtgggaggatcacctgagcccaggagttcgaggctgcagcgagccgtgattgtgccactgcactccagcctgggtgacagagtgagaccctgcctcaaaaaataaaattaaattaacaacatgaggctttctctgtcatcagcaggtgtgaaatagaattgaaaagaaagtatctttctcactgtgagtaaggattgtgaaatactcagtccacacacctcctaaggctctctctctcatgagtaatctctgacttggagagtcctttacaaggactggaacaaccaggaagtcaagtcaagggaaagagtagcgagggggtgaggtatggcatgattggtgctagggacaccttgaggacttagttagggacagtgagtggggagggggaaagggatccacgagacctaaccccactcacatcctgccccctcctgtgatcctagttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtaaaccaggaggggcagaggtagggagtttggggagcatcaggatcaagatgcctgaaggatcctgaccctgctcttgctctcaggtattgcctgcctgtgctgcgatgcccggcgccaggtacggatgcaggcactgacctatctgcagcgagcactacttgtacatgatctgcaaaagctagatgccctggaatgggagtcctgttttaacaaggtgggacttcctactggtcttaagataaagttcaaatcctaagaaaaggaaagccaggcagcctgaagagcccctaatgtgagtcttcagcctgcatcataccttcccttcagctctatgcccatccagttcctggcttccttggggcaaggctgcctagctgaacctcatagggagacattgcacatttacccccaccaggtgctgtttcctctacttaccaagctcttggagaacatcagccctgcagatgtgggtgggatggaggagacccggatgagggcttccacattgctctctaaggtactgctcaccaccctatacccaccctctctcccatacctgccttttcccgaggagggaagccagggcttctggcaggacctagagatgcactgtaggtgctcacaaccccccagctatggacactaagcaggacctagggacctgagaggattctgaatcttaaatcagagattcctccatctctgatctaagattctcatgcaagataggacaggcttagctacccagcctcagagaggggtccagaggctcctacagtcccctcagctgaagggggctggtgggccataggtcttcctgcagcacctgtctccactgctgtcactctctacctttgcggccctctggctcaccatcttggacttcatggacaagtacatgcacgcaggctccagcgacttactggtatgttctacctcagctctgctgcctgcctcctgtcccacctgttggaaggacttgccctttcccccttggtagctacctccctttaccatactccccccatgccctctttcctattctcatggtcccactgccacctgcagtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccagggtagggggctcagcccagctttatcaaaaagagtctcctgcctgggcacaatggctcacacctctaatcccagcactttgagaggccgaggtgggtggatcacccgagggcaggaatttgagaccagcctgaccaacatagtgaaaccccatgtctacgaaaaatacaaaaattagccaggtgtggcggtgggtgcctgtagtcccagctactcaggaggctgaaacaggagaatcacttgaacccgggaagtggaggttgcagtgagccgagatcacagcctgagtgacagaacgagattccatctcaaaaaaaaaaagtccccaaagctgaatttattgtctgtgccctgggtgggtagaaaggctgttgggtagctagggctctgctggagagagaaagcactaagaggtgccatctcaattctctaccgtctccagaccccatgcccatggagcctcaaggccaaaagcctctcgcctcagcccacctgacttccgctgctggcgacactaggacacctggccatccaccgcccccagagattccatctgagctgggggcctgtggtgagtctctctagcctagcctgataggcactgagtagcaagcagggggcctaagaggaggcccaagggggcgtgggaatgctgctgagcagggtctgtgagccgagggaagaaggccactagagagaactgttgccgctcttcccatgggaaatgacaggaccataagctatgaggaactagctgcttgcagtcttcaggcttgggaagagaaggctgggtcagggacttggaatgaatttgcagaggtttcctttcagggattctagtagagagtaacctggcggccaggcgcagtggctcatacctgtaatcccagcactttgggaggctgaggcaggtagatcacctgaggtcaggagtttgaaaccagcctggccaacatggtgaaaccccgcctgtaccaaaaaaatataaaaattagctgggcgtggtagtgcacacctataatcccagctactggggaggctgaggtggaaggatcgcttgaacccgggaggcagaggttgcagtgagctgagatcatgccactgcactccaacctgggtgatagtgagaccctgtcgcgaaaaaaaaaaaaaaaaaaaaaaaaaagagtagcctggcaaaggagatagaaggtagctgaacattgaaatgagttttgaggggagactcccaactttttaggctggtggggggccgtgttgcttactggaacaaggaggaacagagactctataagcagccagctgggcaatgtgagagttgtcttgtaccaacaagggaatctgactgtaaccaccttgctttccctacagactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagcatcattgtctctccctccggtttccttcttgagcttgtgggtcagggcaccatgttatcgggtgcgcagggcttggacttggtgtgagcagaggctgagcctacctaacaccaccacccccctcccccaccccgccagatgctaggccgggggtcaggattccttcactgctgctgacccctgccctgccacagggtgtacccttgtcatcacaggtgtgcccaggggcttgggcagtggctcgggcagttgtcgtaatcttccctaacaactgtaacaagggagacacgtgagacaacctggcctaggtgagagggaagaggagtgagggctgagttgtagttattcagaagtcttctctcagatgtgtctcaccatccaagagaccaaaacagctgttggggtttcagaggagcccaagagttcgaggctgcagtgagctatgattgtgccactgcactggagcccccctctgtcacccagcctggagtgcagtggcacaatcatagctcactgcagcctcaaactcttgggttcaagcagtcctctcacatcagcctcccaagtatctgagactaaggtgtgcaccaccacacttggctaattttttgtgtaatttttataaagacagggtctcactatgttgcccagactggtctggaactcctgggctaaaatgatcttcctgcctaggcctcccaaagtgctgagattacaggcatgagccactgcacccagccctgggaagggtatcttgcccacagctgcagtcatgggtttggagcccagggcattcattttgaccccaaactgaaaaggggtaacttttcccagccccacaaacctcaaacctcactcactgcagcatgattagaggacccctcttctcctttcccttggcatcagggtaagacaggtgggaagtgtgtatggggcaggctgtgtggcccctgcagggtggaggtgctatgggtgtgtgatactgtgaaatagatatttggtcttcaccccgtttcctggcataactcttaaaatccttagaatctccaaagtgatgtcctttaatatatgattgactgatagctggcagcccctatgtagctgctggatgggggctggtcaccaaagcagaattaaagggttgggactttcaggctcagcccccaacctccagggagggaagagggactgaaggttaagttgatcaccactgtccaatggtttaatcaaccgtgcctatgtaaggaagcttctctaagaacccaaaagggcagggtttggtgagcttccagagagctgaacatgtaggcttacaggaagccaaacgagtgcatccttgtgcccagagggtggcgcaccacaactccacggggacatcactcccgggctctggaccctttcagacctcaccctatgtatgtcttcatggctggttatttgtatcctttataatattccctgtagtaaactggtaagtgtgtttccttgagttctgtgagctactctagcaaactagttgaacccaaacccaagaagggggtcatgcgaagcccaatttatagctggtcagtaagaaatacaggaaaaaccacctgaaacttaacaattggcatcagaagtggaggcaatgaccgggcaccatggcacacacctgtaatcccagcactttcagaggcgaggcagaaggatcccttgaggccaagagttcaagaccaacctgggcaacatagcgagaccctgtctctatttaaaaaaaaaaaaaaagcatttttgtaaagaagtagagtacagtcctggggaatgagccctcaacctatgggacctggcactatttccaattagatagtgtcagaattgaattggaggccacccagctggtgtctactatagagctgattgcttgcctggtgtgtgggggttttcccacacacacacatttggtcacagaagtcttctgtgttgattgtttttgagtgagaaaatagaaacactttgaag

SEQ ID NO: 14118 - DNA, 18925 bp, Human
cctgcgggaggggcagcggccaggcctgaatccctggttcgccctcgactcagcccacgcgggcctttcaggcttctgggacagatcctaggtccagctgcccacctgattttgtggcaaagaaaaaaagaagaagaagaagcgagaggcgatggcgtttgctttggccagatttaagggcaagcgaggctgcgcgcggctcccgcagggtcggatctccgagctccagggcgcccctccacccgggtgtagatttcccgcggaccccttcgccctcccgggtttcatcagctgcgcaggaatggagctggccagagctctgggagcggggagggaggcgccgccaccagagggcgccggagccccagcgctgcggccggtgagcggccaggctccccggcccagcccagcaaaggcctggggacgcccgacggctgccttcttcactggacctcactgccttcagttctttaagagcagggccaagtcagtggggttcccggctccaagcccagtgcccagggtgggtgggtgggtgggtgggtgggtggatggatggatggatggatggatggagtgccggcccacagccatctaacggccaaagtggttttggaaaaaaaatgcacagaagacacctactcccaccagcggagttccggagccctcgcagcctcctgttgaccgctcccgcctaatgcagccgctgaccgcccactccccgacggccaggactccccagggacagggacgtgtccccagggcaggcccctggatggacgcggcgactgaccccacttcgctggacgctgtgctgggaaggacacagagaggtggctggggcagcctgcggtcacaaagcgaggcccaaaggggcgctctcctcacccccacgcctcctgggtgccgacctgcaccctcccttcgccaccggactggggccatctgggatgtctcgggggtatccggagggctaagcaccgccgagggacggctccgtgggaagagttttctggacccagaaggcagacgccagtagtactgtcctaggagtcggaggtcggggtgggggagttctcagctctttgggtcgcacggagcttttcttgggtaaggcagtaagtacttaggtttaaaggacttacttacagctaccatttattgagtactgtctgcttgtcagacacgatgcagagaatttcgcggcgtggggcgggtctcattgaatctcccgtcccactccgcggggtgggcctgtgattagctcatttcaccattgagaggtcggaagtacaaaggctacattcgcttttactgagagccgccggcgccttctgctttgtttgtacaggcgaggaaactgaggctcggctggtggcgccgtgggcttggagtccgagccacgctgactgcaaagacgggtctcattcccgcagatcgagctctgccggcggctgcgccgcaagccgggcaggtggcgagcttgagcccccacgcacagaaagcaggaccccctcggctgccttgggccgccaccgccagcaggccctccgcccgggactaacttgtttgcttttcattggttctcattcagttcccgccatcgaaaggccccgtcccgcagctttccacgcgcgccccactttacgcctaaggtcctcagtctctccagtggggccctgtcacagggacaataagcggccctccagccggcgtcgctcaggctgcggacctcactgcagaccgggccagcggtgcggggcccagcggagcctgagaaggtcaaaggccggagcgcactgcgcctcgggagcacagagggagcggaggaggggcgaaggggatgggtggggggtgccgccgagggagtcgcgcgtcagagaccccggccacggccagcactcggctccgggcccgcccctcaccgcgcgccccgccccgccccgcctggctctcccctctaaagcgcccggcgcgcgcctcccaccgccgcactttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacggtaagtgcgctcggcggggaggccctggcgaggctctgggcttcggctcccgcccggcgcagagccgcggctcctctgcctgcgcccgcagtttgcgccgcccgacacagtgggggtggaggcagctcgcttagctgggcgctctggtgcggtgtcgcgttcaaagccctacttttgcgccgagggtttgtgacctgcagagagcgaccgcctgacctcaagctggctgcagagcgaggtcagccgggacaactgggcaggaacgccccaagagagcgttcgggactggcgcgggaaggcgcgagggtggggagccgcggaccccagacccctgcctgcccaccctccacccactgccttcccgctgcgggctcggtttccacaggcgaatgggctccgaggtcctgctgcgcacagtgctggaggtcgggcggtgcatggcgagagcgcgctttgcaaagttcgcctcatgccgcgacttgaggctgtgaggtccgatgcagccgcgcagcctccgctccctgcgaagccgatcctctccccacaccctcgcggggctcttggccaggcgcgggcgggctgcgcggcgcagctgtcgggcttgtgccacccgccaggccgcgcttctgcacagctccgcggtccgcagcgacgcggacctgggcgcgcgtccagccgctgtcttcctgtctcttctcgggttcacctgagagaggcccagggaccctccgagcctcacacgccccctccccagctccccaaacacacctgcagacaggctcttttgtcaccagctggccaagcgctttgccccagaatgagagctgcagcaaagttcaatctccaaggccctgggccactgggaaccgtggtgtcccgtttcactgggagagggcttttttcttttctttcgctgaagagaaactcgctgcgctgtcacaggacaccgatgcaaaccaaaataaactgttgcctctgaacacacaaaacaaaaccctgtggctcaggccgctgagcttccttggctgtgaagtttcctgcaaagagttgaaggacactctgagtgctcttgcagccgcgggctgtgcaggcccagcgcgcctcgagcccttggctgggttggtgcagacgtggccccggcgtcctagctggcttggactgtgcgctggtgtgagcaggaccagcgcagctgagtcgggctggagaagctgggcagcctggggtcgtggcggactgcctaagtgttaaggacacagactgaaggcaattgggaatgttcgtcgttgatgaaaagtccctgaggctgtgtctgcacactgaccccccccccccccccgcaagtcatggggcatgtttctagtttttattgctggatattcttctgttcctgtaaggtctctggtttgggcagttattgactgattggtgggatgagcgcggaggtgtcacagtgcgccgctctgggaaatggtgctgccccctccccggagggctggagagaggattggaatgaggaacctcggtctttgagttatgggtgcaactgacctgggggaagcacagagacgtggggttcatcccagactcctcctggcctgggaagggtgacatggccctcagagttgccccattggcagccaagtaaccagggcaggagcctgggctccaggcagatctgctccttacacacatcgccagaatgttttgttttgttttgttttcccctcacctcacagtgcctatgtgccccctatccccacacttagtcctcaagctgcactacagagagagcttggccaggggtcctgcccctcccccattggctgacttccgtcaggcagctgggcccttgggtttcccgggcttaaactcagggtgggcccccttcccaagcctgcttggaggggccagctgggctcctgtctctgcattagactggagggctttctgaaaactcctggagccaagctcacccggtcccaaatccggggtaccatcagagccagtcaggactcttgccggtacacggatttacatccagaacggttgggaaagttagtcttactgacaaaaagctggaggaaggagcacatgaggtacacacgagaccatgttcttttggtaagcacacctgggggctctgtcactttaaaaagacctgttgaaattcgctgcttgacaggcgggccttaggtcctgggagtagaagcaagaattgcttttgaaggaaatggataatcccagggggtggagggggagaggagagagagcctgtgtgttgagctctgaataggctctgatttctggcctcatcaccactgcttggttggggggccagaggagcttctctcctctgggcgctggagagtcacagccccacccatcccagcgggggcggctgcagcacttgcccttggctgcatatcttcaagctcactgttgccgggagggggcttgtgcctcactaccggcctcctattctcctgctccacccccaacccaccccctgcctcagcttggaagggcccaaaagaaatccagggaaacctggaggcacaacactcaggagcgtttagctcctcagttacccaggctgcaggccccggccctgggggtggctttcccaggtgatctggttacagtgcagtgctgacttcccctgcagggtcccagtgcagctgctggaagctggccccagaggtgcctttctggagttagatcaggtgtaactgtgaaggctgctttaggtctctccagtgccatgagtcaccagcaccctgatgcttggctttttcctggttttcagggagttgcatttggtcctggggacaaggaagtggggggacaagtggtccacttttcctgcaacttggtggctgaatacacaatgcaattcctagtccacatcatccctcaattgattgcagtctgtagaaaaaataaaataaaatgagccccttactcaagatttcctcctacttccccagcattctttcccaaaggtgcagaatttcagaaccacagaggtctctcagaactttgtaaacaggcaaacttaaaaaaaaagaaaaaagaaaaaaaatctctggaccaaatattcttagacatatatttaatctctgatgaaaggatccacaagttcaaataatttggggtattaagtggggcttggataaaatcttcaaggaaaaaagaaaaacaaaaagcacacacaaatcccagccctccagggcttgcaatcctatatttaaagggtgagcagtgggttctgcaggagccccttgctaatttacactaatgagtgtcaattatggcattttgtaaattggtgattttgcaaagatcttaatacaattcctgaggctacagcatccctgcctaggcaatgaaaaccacatttaactccagctccactaatctctaagccttggggaaagtgctgggcagaaggtgggtccttggcctgctctcaggggactcacaggtaggaagccagccaggattcttttgtgccttccagagctttaggtgaatgtgaggaggggtctctggggtgggggagggcagcattcctgagtactactgtgcttcctggctagaggcctgtgccagaggagagaggccagggagcctggagcctcttgtccccctttcttttccctgagtagggagatctttctcagttgtcccttgaggaattttttttacaaagagtaactggaaatttcagtaccttggactgaaaccgttatctactataattactacctttatcttgagacactgagcaggtggcttctaatttaatctcccccctcatctaggctccggctctccccaggcctgttgggctccttgccctgtagaagctgagcctgagctcagccagcactcactgtgttgcctgaggagatggcctttcccaacatacaccagtaacctggaacttaccccagtgatgccgtctcttgatccttaatcgctgcaccaactgctgcagcccagacacacattaccaaaatctggcagggtagtaaagtgccttgttgtccttacctcttctagggaagcccgtcagcctgagctacagatgcccatgccgattcttcgaaagccatgttgccagagccaacgtcaagcatctcaaaattctcaacactccaaactgtgcccttcagattgtgtaagtcttgaaattgaacatcatctaacgaacatagttgcatctaacgaacatagtaacatctaacccgagtcttattaaaggtgtagaggtgacaagccaagtgtccaaccttgaacttggcataattagtggcagctattcttatcatgaggacctttagtatgccaccaggcattaattttaaaagccgctcttggcctgggcaccctgctgtgctcgtagtagttctctcttctttccaaacctgtgttcttcagcacagcacagctggatgctggagaaactatgggcttcaccaaggttttggctgaagcctagtaaattagccagcccttagctaataacagtgataactggcctgccagtttcggggatctgatgccctacattaactcacaagacccaaatgcagtttaagtcctctttaaccattgggtgaaacttcaacattttcagctcacttgcctgtattttctcaagtacaacatatgaggttttggtgttatttggtgtggatggcagccactaacatttgattttattcatttgggaaacaaagaccaaaatcacacatccacaagacaggaagatctcagctgggtacagaagaccgggagaaatgcgggaagaaagccatgtgcttgaaagccctctcatgctcaagaggtcctgtgtctgaacacggggaagcgagggctcagggagtctcctggagaggatttgattgctcagaagttctagtgctaaaaatggggtggggagacagcagttggaaccaaagctacaactttcccaagacttttccacccaacaccaaatgtttttacttttgattttagaaaactgtttttagttttgagttaaccctttactgccttgaatgtgtttgttatttacagtatgttttagggccctagaaaatgaatgttttttcagtactttgcctacaacatgatactttatctcttgtgaagagtattttaaagatgctcaatttagctagcttggacctgctttacagcactgatcatgctggtttactggcctggaaatgcaccttgaagttgaagatgccaaatacaattctcaggtctgagcagacactaaattaacaaagaataggccccagatttggaccccaatgtgggttgctccgagccacacccatctctgcacccctcttcacctaatggacaggctgcttgaagactccctgggtgcccctgaaccactgttctggggcttagctgtcctcaagacccttaagtacttgggctgcatgagattacctggcaccaaagggctttctggcaagagatccagagagatgaaatcaggccttccccaggagtttgcatgtagggaagcttttaagagtgtgaacttttaaaaaacaaatgagaccaagaaacattcagtgaacttgtaaaatctttctagaaactattttctggtaagccacctgcactgcccctcccctccctggctggtcaccctcccggtcagaccgcggtgacttctggcaggcctccttcctccaggcttcctcatgcccatccttaagtcggccctatatctatcaagatgacccatccaaataaacctctgctctgttgctctccattctcccctccccaggtgcctagagcatcctgtcgtccccttcctcagtttcctctgtatgctttgatgacccccctggcgtatttgctcctgattttcccttcccgtttatttactctccaagctcctacttatccttcaaaggcagctcaaatgctcccttacatgaattcccctgcactgccccggaaagacttctgttcacatttccatgtctctgcaatggaacttcctgcactgccagcgctgagctttccccagcacaccgcgagcacctctggagcctgagcgtaccaagtggagcacggggtgccagcgagggccctagatgagtgttgggggagcggatgcacacgttgcagccgcgccttcctcctgtgcagccgcacactgttgccattctgttttcacagagcccggctgaagaacaacaacagacaagtgtgcattgacccgaagctaaagtggattcaggagtacctggagaaagctttaaacaagtaagcacaacagccaaaaaggactttccgctagacccactcgaggaaaactaaaaccttgtgagagatgaaagggcaaagacgtgggggagggggccttaaccatgaggaccaggtgtgtgtgtggggtgggcacattgatctgggatcgggcctgaggtttgccagcatttagaccctgcatttatagcatacggtatgatattgcagcttatattcatccatgccctgtacctgtgcacgttggaacttttattactggggtttttctaagaaagaaattgtattatcaacagcattttcaagcagttagttccttcatgatcatcacaatcatcatcattctcattctcattttttaaatcaacgagtacttcaagatctgaatttggcttgtttggagcatctcctctgctcccctggggagtctgggcacagtcaggtggtggcttaacagggagctggaaaaagtgtcctttcttcagacactgaggctcccgcagcagcgcccctcccaagaggaaggcctctgtggcactcagataccgactggggctgggcgccgccactgccttcacctcctctttcaacctcagtgattggctctgtgggctccatgtagaagccactattactgggactgtgctcagagacccctctcccagctattcctactctctccccgactccgagagcatgcttaatcttgcttctgcttctcatttctgtagcctgatcagcgccgcaccagccgggaagagggtgattgctggggctcgtgccctgcatccctctcctcccagggcctgccccacagctcgggccctctgtgagatccgtctttggcctcctccagaatggagctggccctctcctggggatgtgtaatggtccccctgcttacccgcaaaagacaagtctttacagaatcaaatgcaattttaaatctgagagctcgctttgagtgactgggttttgtgattgcctctgaagcctatgtatgccatggaggcactaacaaactctgaggtttccgaaatcagaagcgaaaaaatcagtgaataaaccatcatcttgccactaccccctcctgaagccacagcagggtttcaggttccaatcagaactgttggcaaggtgacatttccatgcataaatgcgatccacagaaggtcctggtggtatttgtaactttttgcaaggcatttttttatatatatttttgtgcacatttttttttacgtttctttagaaaacaaatgtatttcaaaatatatttatagtcgaacaattcatatatttgaagtggagccatatgaatgtcagtagtttatacttctctattatctcaaactactggcaatttgtaaagaaatatatatgatatataaatgtgattgcagcttttcaatgttagccacagtgtattttttcacttgtactaaaattgtatcaaatgtgacattatatgcactagcaataaaatgctaattgtttcatggtataaacgtcctactgtatgtgggaatttatttacctgaaataaaattcattagttgttagtgatggagcttatagacgtttctggtttatatagttaagcctgcctgcagtcaggtgtctgagaccccttctcacagcccatgtgtgacagtgtatgggcttttctcacgagcagattagatctgcagctcaagtttttggatcttttttttttttttttaacccgattgaaatagcagtgctggttttctgaagaataatatttgactcactaattcgtcttccctccctcctcctccttggttctcctaacttccccatgtaatccccagagactcaaccctagtaatatcaaccttttacattttcccatgtaaaaatcccatgactccaggccatggttaatatgaagctttcacagggacaggtggcctcaccccataaatcattaaataccattcagcttgaatcattttaatgtgacagtcacgagccagttgctctaataaaattctgctaaccagctctctcccttgctctccagaacaatcgcattcattcccaggagtgttcacaggcgtctagaaaggggaaggtgggaccactgccttttttctcctcttctgaatggcagtctgaacctggggcctgcagcctccaaaacgttattcaatttgaaatgcagacatttcttagagaaagctaagagttcagccctgcattgagaagaagaaaaagtcccatgagagcagggcagggtggggtgacaaggaccacgatggccagcctggccctgggtgtaccctgagatgtggattccttgtccccagtgggaatcaggttcaggttggcagattggcagtcgctgtaacccattcacaaaggtgttctaggagcccattgaacatttgtttgaatggaaggaaatgtccaatttattttaatgaattactgataaacagtgctttgaccaggggcctccaggcctgagactgaaggcacagtttaaccagtacacgggccagtgttaaatcttatgcagactgagacgaacttttgtttatttccacattattaatggttctactaattttatctaagggggcgcagagaagaaaaagtggggaaaaaagaaaagataggaaaaaagaagcgacagaagaagagaaaggctgcccagaaaaggaaaaactagttatctgccacctcgagatggaccacagttcacttgctctcggcgctttgtaaatttgctcgatcctcctccaggacagacccccatgcagactgggcaggggctcagacttccgtgggggagcagtgctttgctgccctgccagccacaccggcttctgtatttatgtgctttttaaggcccttgttggtctgctaagttatgaagaaagtagttgtgcagagactggggcgggggtctgtgacgcggagcctgtgtgctcaggactctgtccagaatagcctgggagctccaggaatgcccaggttgctgagccccccagcctgccctccacttcctctcttagaaggcctgcgctcactggggagctcaccagctccacacacttgcagtctgcattcctgtggagaccaggctgtggccacctggccagtgtgcagggcaacctgctagcccagcagaggtggcctcgccaggaagggggtgtgccacccctctgtggccctcaggaaaggtgaaaactgactgacccttaggaatgggccctggctttttccaaatacccattgcctttccctccagcactctgccacctgggaaggggcttcttcagcccctccttcctgggttgtgggagtggctttatccccaagcccgggtgggtttctgcaaactgtgtggggtgagcccgagggaatgctgcattctcagagagcagatgtggaaacacttctcagggagctcctctttgggcaattctctttagagtctttaaacgggtcccccacgtggaggacagatgtgctatggaactttgcaagggtcctgaatccctggggatcccagcctgtcccctcccgcctcctgcgtgatggcgtgtgctccagctgcagggcacagctgcctctgtcctcattcatgggaaataccttatctgcctaaagcaaataccacttaagctctaggaactttcctgcaccctccttccctgcccatgtagatgtatgtgtgagattttttggcaagtttctctaatctggaccgggaggatggaagagcaaggaccccatttcagtagtgctcggaaaaaggatgcgttgaatttctcagcccttctccacctcacataaacacccgcccaccctgcacccggatcctgggtcataattttaataaatgcagaaagagaaagtggttggaggatggagcacatggaattcaggagaaaacccacaaagacccctgcatgtcagacacaccctgtcccggagcgtggtgtccccttgagctttaatgagctccctgtgatcacagccatgccttctcctcgttggggaggtgtcctaggatgcttcagccaaagacctttgtttcccgctgctatctcttttacctggacaactctcctggcccacgttcctcttgccagcactgggggtcacaggcctgagccctgggtacaggggtgccctagtcttctgccctccccacctcttaaggcacagagctgttgggtgggctgcctggggctgccatccttcccgtggaagccagtagccactctagtccatgggactcttgacaaaagcgccccgagagggcaaacctgtgcccccatactcgcctgcattcttcggactccacatgcagcagggctttgtgcctggggaggggtggccagtctgtcctggtcagtatgaaaagctgttggccccctagggacagagggcccagctaaggctgcctgaggatacaaactgcttgctatcccactcctggggagcagggtctgcagggactgagagtgggtcccaccttgagaacgcatgcaaggtccgtcctgtcttgatgtcttgatgtgactgtatgtgccctgggggctcactgtggtttacaagtggcttgtgaagctcctgggagcaggtggtacacccagtgctgaagacagggtcgccgtggaagagcgaagagcctgaccgggattcctggtgggttgaaactaggaagtgctcacaccagtcagagccaaatgaggggtgcgctatggtcactgctctgtccagcatgcgttcctcctgggaggtcctggccacctgtgcacccacccctgtgccacctccagcagtcccacctggggccacctacggtggcatggcccctggctgagaggccccgagggcgaagggttactggaagccacgaaagtgcctcttgggacagccgaggccaggatgcagggcagcagcatcctgagcctcagccccacgccggtgccgggtaagcagtgtgccctgtccccgtcgtatgaccactctgatgggcctctctgtgccttcgtgcgtctgccacgcccagtgcttgccacgtgtctgtcctctgctttctgccatccatgggtccctccgcttcagcctggctgcgtctcgcactcccctcccgtctgttgtcgcagggcctctgaagggagatgcatggccaaggtggcaacttggaagtagggattggccccagggcctccgcgcaggccgctgtcctgctggagctggctgggtgtggggggaacctgccttaatggtgtttccctctgttcttgtcaacaggaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccccgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgtggtgtgtccccctctgtccaggcactgagataccagcgaggaggctccagagggcactctgcttgttattagagattacctcctgagaaaaaagcttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgtagccaccaacagtttgaaattagtgttactacttggaattttctggacgtgctttttttccccacaaacccaaaactgagggttgtgtaatcctggctacagtggttcatggaaaacagggcattgtaatcatgctaatcacagctgagaattctggaggcatacttgcctcttctggacagctgatccttagcagggaaaggtgctcccttttctctgagtgtctttgattttgctagaattgcttctgaaaggccagcctgtcctccactccacaagggatggttttgtgcaagggtctcaggtatttcttgacagctgtgaggagggaagcttccactctgcccttctcagtcctgggagaatgcaacagaggtctggccctgatggtaattgctgaggaccagcactctgtgtgtttcctgcactgcacagagaccttgctggaagccagacacgattctctcacctagcaatggctagccagcactgtcctggacatggggcataggagatgagcccagcagacaggttctggtcctcacagaggtcagcccttaacactctctagcacattctctgtcatccacagtcaactttgttagaaaggagagtcagcacaaaagttccgaatgtctgagtcagattgtccggtcctccaagccctcttccccattggtccagatgtgatcacatcatcccatgccaaatcttcccatgacttaatgggatggccgtcatgtgggtgctaagctgcagatggactggggaaggaagaagggttagagcaggccgggaagggcagcgtggtgtcaggggacctgtgcaggtgtgaagatcagtagactggggcttgcgtcccattcactctctgctccctctgtgatttgagatgcatcccttgatctctctgagttccagtctcccagctgcaacactgaagcttattactgccaacggtcaagaggattagactgggagagtgtgtggaagaagctagcttttgagggacaggacaaagcccgcccctccaccctgaaagttccccattttgctccctctctccacctcctgtttcctgaggtccacagagctagaataagacccacatctgcctctgctgagccccttaacaaagctcagagaccaagggagcaggaagtgacctggaagctgagcctgcccctcagctaaaggatggggagaagtcactgggtcgcatcccctgtatctccggcacaccacactgctatcctagcactgggaatcgacaatgggccaacccttcaaaatgacctggcatcagaaagaaagcctgagccctggcatgcttgcattctcccctcatttacttggccaacaacagctgtgatgcctctcctgcaccgcaggagtgtggggagcaagacacactcactctaattccatgaagcctgcagtctggcggctgccgtgtgagaagtgggtattttcatagattgtggtgcattcaggcatcagggaagcgtaaaacagaaaagacccctaacttaggcatcagtaaggatttgcttaaaaagcgctggtgaaggtgagacctgagaaaagtggattctttggggaggtggtctactgagcccatgagggctggcatggagagcccaggtggtatcctcctgtgaattggaaagggggcttattctagaagccggaggtgtagctcacacagggagtctggcatggggggcacagggcactgggtttcagcttccttattcccatcacttgtgggaggcacaaacacagctgagaaagctggacccccacggtgatggggtcccctcagcacggctgattgcatggagtggacactggatgcatattgcaggccgatctgattttctgtcacaggagtacaaggctgtgattcaacagcatcgggctttgctccctttctctgtgcctgcagctgaggactcggcactctggagtgtgggctgccgggagacagaagcagagg

SEQ ID NO: 14119 - DNA, 12223 bp, Human
aattacatttacatttggaaatagaagggaggaagaaatggaaatgcaatcagagatgataacccatgggcaaatcattagcttttcaaatcattagcttttcctcttctatttcctgaactttctgcaatgctgttggggctcagaaaccaaaaccccaaaatacggctcactgacaagctgaactgaagaagcctcaatgttcctttccagtgcccatcatctctcccaaagcacaggtctttatctgcctaagatccagactaccaaaaggaataattgtttctttcttctccacccaagaatgtaatcacacctgaccagagacccttatactgtcaaaagtagctatttacagccgagcacggtggctgcagcctgtaattccggcgctttgggaggccaaggcaggaaaatcgcttgaagccaggagtttgagaccaaactgcctaacatagcaagactgtctctacaaaaaaattaaatttggcaggggctagtggctcgtgcctgtggtcccagcagagacaggaggatcgcttgagcccaggagttggaggctgcagtgagccgtgatggcaccactgcactccagccagggctacagagtgagaccctgtcttcaaaaaaaccaaaccaaaacaaaaaaaaaaacacaaaaaactatttacaaatttatctctgttcccttattcattcattctgcctagtaatccctgaacagaattcctccttctcccaccctcacaaacctgttttaccaggagggtatataagcttctgaacccttttcggggtgggtaatcatactgtgattctccccgtgtatacattttaaatacatttgtatgccttttctccaattaatctgccttttgtgaattgatttttgagcgaatcttcagggggcaaaggggaggtttcccattggctcctactttgtcatttctccatttaattagaaaaatacttcaggctgggcgcggtggctcacgcctgtaatcccagcactttgggaggccgaggcaggcggaccacgaggtcaggagttcgagaccagcctggccaacgtggtgaaaccccgtctctactaaaaatacaaaatttagccgggcatgggggcacgcgcctgtagtcccagctactcagaaggctgaagcaggagaatcgtttgaacccgggaggcggaggttgcagtgagccgagatcacgccactgcacttcagcctgggcaacagagagagactccgtctcaatttaaaaatcaaaacaagccctttcttgcggtgacgacctacccacgagaacatgcctctcgcaaaggatctccttcatccctccccagaagaggagaagaggaaacacaagaagaaacgcctggtgcagagccccaattcctacttcatggatgtgaaatgcccaggatgctataaaatcaccacagtctttagccatgcacaaacggcagttttgtgtgttggctgctccactgtcctctgccagcctacaggaggaaaagtaaggcttacagaaggatgttccttcaggaggaagcagcactaaaagcactctgaatcaagatgagtgggaaacaatctcaatgaacacattttgggaacaactacaacaacaaaaaaaaccttcaaaaaacctaggaactccagatgacttcctttgggaattgtcccttaacccttcatgagaagtcaggagatgactcctgtttttcaggtgacaaaattggagcatggcaaaggtgatctgcccacttcaaatcgctagctagacggagcatagggactcgaactgccgttttcctcgcctccaagagtacagggacgaaccggtgagcagaaggcctaagaagtcaggcacaagaggtttctgcccaggaggcacagaatgaaacttgccggctgttggccccgccccacttcgaagctccgcccaggccaagaagcgcgggggcgggagtgagggggcggtttccatggtgacggcaaacaaggcccacactggacagggcagctgctgggttgctactctcgcctccgccatgattccgcccgcagactctttgctcaagtacgacaccccagtgctggtgagccggaacacggagaaacggagccccaaggtaaagacgggggctcgggagacaaaggagcctcgaaactccgatagggaaagacacattcccgcatggagggtcaggaatctcaagggacggggattgcagcgactgggagtaaagggaattgggaagtcagagaaggagggtgagaggattgtataggaagcccagatgttgggtgtgaccccagagggcagatttaggatggggaaggaggtcacagggagatggatggggctcactcttcttaatggtacgcgggtccaagaacagatgactaggtagtgatttccccatcaccagaggtgtgaaagcacatgcgccagaaacacctgttcaagcattgagttggggccagacttcatggcctccttcagctctgtgacataatttctgctgagaagaccgacccaaagtaggctaggaagaggggagggctgtgcagaagacctggagcaatatacaggttggggatgtgtggagctgagctcctgaacaatttcctgccctcacctgtgccttcatctcaggctcggctactgaaagtcagcccccagcagcctggaccttcaggttcagccccacagccacccaagaccaagctcccctcaactccctgtgtcccagatcctacaaagcaggcagaagaaatcttgaatgccatactacccccaaggtaagaaagtaggagcagtggctgggagaaggcctaagcttttacatcgtggattttgggagtgtggggggaggcactctgcctctgttcctggctggggtttcctcccagtatcacagagctcctagaacttacatatggctggatcctggcagggtggtgggagacctcttctcaatctaccctcatttcctgcatgctgtcacccaatctcatggctttagataccacctatgtgctgatggctcccaaatgtgtatttccagccctgtcttctccactaaactccaggaccatatagtcttctgcttcctcattatcttcatgaagatatctaatagacatctcaaactcaatatattcaaactaaatcacaatttcttccttccccaatctgctcatcccccgtattctcctttttactagggactcaaaccacctttcattccttttgatcactctcacagcatgtgtcctatccttcgtcacattcttttggctccaccttcaaattctttcccaaatccaaccacttttcaccacctctgcttccaccatcttgctcctagtcactggtggccactcgcactgctgcagtggcctcctatctgaaaacactgcttccactctgctcctagaatctatcctccatacagcccctaagtcataagtcagatcatgccagtctctgccagaaactcttttgtggcttcccatctcagactaaaatcaaaaatccttacaatggcctggaagatgtggcatgatctggcctacgatgtatccctgaccttatctcctgttattctgtttcttgttcactgtgctgaatccacagggacctcacttgctatttctgaaatgcctcattcactctcctaccacagggccctgacagctggtgttttcactgccaaagatgttctccccttgatattctcctggttcctttcatttcttccaggccttccttgagaatttgctatagcagagcacccctgcccaacatgatctccttttcttgcttttttcttctgcagccacattgataaaaggacatgccttttcatctatttttatgtaataagttgacagcacagttggtaaggctatgaggaaaagggaaatgggggcctacgcaggcacacaccttcatgaacctctccaccccgatacacacatctgcctctttctggctcgcacaaggttcatgatgtcctgtgtttcccaccccgtaagttggtgggtagttcctactgttcacatcaagcaacaaccataaatcggtcttcagcatgttaggagggtaagatctggaacagtggggaatgatttcacagaggcccgttgccaaggtggaaattgtctaccacctacccattcccaagatccctgtggaggcagcatagtgggtgtggctttggagcctcacaccccaagggatggaggattctggtgggttggtggcaaagctgcccctcaccactactcaggcagagggctcaaagggccctctgctcatgtgctagggaccttcaagtcaacgggttttgctcagcctcgctgtgtctgccacagggagtgggtggaagacacgcagctatggatccagcaggtgtccagcacccctagcaccaggatggacgtggtgcacctccaggagcagttagacttaaagctgcagcagcggcaggccagggaaacaggcatctgccctgtccgcagggaactctactcacagtgttttggtgagtgagccaggtgaggggtgggcactacacaccctactgctcccttcccttcaccttcagcacagatccaagcctgagcaccttggagctggagcccatctcatgctggaatcccctcttctccccctgcctgacccacccagcaacagctaactgcccccttccccttcccagctgaagggggccagcccctccacacctgtgggtatttctcctcaggcaggaggagagactaagaaaagaaataagacacagacaaagtatagagaaagaaaggtgggcccaggggaccggcactcagcatacggaggacccgcaccggcactggtctctgagtttcctcagtatttattgattactattttcactatctcagcaagaggaatgtggcaggagagcagggtgatagtggggagaagatcagcaagaaaacacgtgagcaaaggaatctgtgtcacgaataagttcaagggaaggtactatgcctggatgtgcacgtaggccggatttatgcttctctctacccagacatctcagtggagtaaagagtaacagagcagcattgctgccaacatgtctcgcctcccgccacagggcgttttttctcctatctcagaacaaacgtacaatcaggttttatactgagacattcagttcccaggggcaggcagaagacagaggcctttctcttatctcaacggcaaggggccttcctcttttactaatcctcctcagcacagacccttcacgggtgtcaggctgagggacggtcaggtctttcccatcccaccaggccatatttcaggctatcacgtggggagaaaccttggacaatacctggctttccagggcagagatccctgcggctttctgcagtgcattgtgcccctggtttatcgagaatggagaatggcgatgacttttaccaagcatgctgcctgtaaacattttgttaacaaggcacatcctgcacagccgtagatcccttaaaccttgattccatacatcacatgtttctgtgagctcaaggttggggcaaagttacagattaacggcatcttagggcaaagcaattgttcagggtacaggtcaaaatggagtttcttgtgtctttcttttcaacgtagacacagtaacagtctgatctctccttcttttccctacaccagccccgcctcttctacaagtcctccagctgccaaccactatattcttggcaacttgagttcctcaccccttagcagatgtttggagtaaaacgataacttccatctgttttttcaaagattttctataataagcatgtgctaattttttagtcagaaagattaatgttcagtatttacatccatccatccatccatcaatatttggcccttggtccagaaaaatattgtgatttgttgttaacccacagacacgagagatttaagatgcacctccttgagtgctggtgtcaaatggctgtctcccagcccagtctcattggctcttatggacgccgatctgcaaaccacctccaaaccctcaggcagctgcagggtctagcaggcttccctatccgtgtgttattatggtttgccctccaggtcagcatttatggggagatagatgggcaagctctagaccctgccatttccctcaaaccagtgcagccaagggggcacacaggatgtcccagctgctttaaaacagctgccatctttaaacagaaaaagtcaggttttttcgagtagtaaccagtttttacctaaggcaggaagggaggggacccagtgctgtaaacaaaccagagcctcttgtctcctttgctctggccaacccagtcttgctgactgtgctactcacaagtgccaagttcagaggagtgactgcatggcaaggctctttgggccactgaaggcaccctccctgaggcccttctctgaggccttgcactttgtctccaagcgagaacaccctaatgtccttcccaagaggaagggtgtttgcagtagacatactgcaagccccctccccacgccctgtctgatctcatggtgtgtgtgcattggaagatgagttgatccgggaggtcaccatcaactgtgcggagagggggctgctgctgctgcgagtccgggacgagatccgcatgaccatcgctgcctaccagaccctgtacgagagcagcgtggcgtttggcatgaggaaggcactgcaggctgagcaggggaagtcagacatggagaggaaagtgagtggggtttaccgtgacccttggtcccatctcttctgtaaacctcagggccacatgcttatcattccagcactacattctgacctcctaaggtgctctgctgacagtcacgacacctggacttgcatcacctcagtgagggacccctggttgagtatgatggccagcctggtggtcttggcagagttgtttccgctgtagacgctccatgccaggcactgacctcccactgggtggcagtatataccctggcaatgtcatgtcccatgtcccttccacccaggctcacaccattccattcacctggcgacatcccaggatgactgggcattctctcctcagatcgcagaattggagacggaaaagagagacctggagaggcaagtgaacgagcagaaggcaaaatgtgaagccactgagaagcgggagagcgagaggcggcaggtggaggagaagaagcacaatgaggagattcagttcctgaagcgaacaaatcagcagctgaaggtaatcaacgcgcagggtggggtggaggtgccccctgccctgcgacccagccccacaggccaggcattcggttccttttccatggcttttaaatgtttgtccacatgcactgccaaaggataaaggaagctgactttggtggtgggagaaggggagggctccagagggggtctctactctcaactccaaatctctgaggcgcctcagcctggctctccagtggaggattcttctccctggaaaaaagttgcccatcctcaaggaagaggtggatatggcaaaaagtggaactccattcccctggaagctggtatgttggagcctttctggagggggctgggctccaggtggcttgcgtggtagtgccatcccatggctgtctcctctgaggccctgtttcagggcataaccagggaagaagtcaaagggcagcagggccctttgagaggaagaaccatttcaaatcagaaaccttccccagaaatgtggtcggggaacccaggcacaggtgctcttcctcgaagtccgatgccagcagtggtcttttatccagctgaggtgataggagggagggggctggtggacaaagctgggcaggaggccatgctacaggcactgcaactcccagctgtttggtccaaaggtctcaaaaggtaggccctagatcaacatcgtcctcacctggcaaagcaagacaaattattgggcccaccccagatctaccaaatcagaaaattcggggttggggtccagcaatgtgctttaacaaggtctcaggtgattctaatgtttgcagaagtttgagcatcactgttctggaaagatggcctactgacatttagtggccttctcccatggccctggccaaaggaccctggatggatctccctctcctccctaggctcagatagaaaccttacaatcttgacattgcaggcttgtttggtctacacaccagcaggactggccatttgcgataaagaaggctttctgttaaccactactggaacttttcttgttgcacaaagaaaagcaagaaactttcacagccagagatgaatctgtttccttagcagcctctgaggctgctttccttaactgccatattcctttttcataagcctgagttcctcagttcttcctggattagcaacaagagcaaaccaaataccttagcatgtttctaacatttaaaagcaatcttgtaatctccagggtgaaagattctttagaagttggcatttttaaattttttttcttttgagacggagttttgctcttgttgcccaggctggagtgcaatggcaccatctcaactcattgcaacctctacctcccgggttgaagtgattctcttgcctcagcctcctgagtagctgggattacaggcatgtgccagcacgcccggcaaatttctgtattttgaatagagatggggtttcaccatgttggccaggctggtcatgaactcctgacctcacatgatctgcccaccttggcctcccaaagtgctggaattacaggcttgtaatacaggaagtgagctatttttattggctcaaaactgcattgcaaataaagcagctttgctgtccccaggatagacctacctaaagatctgtccagtattattttattggctaccagaggaacatagtaaataactcccaagtgtcttaagctttacataaagagggacagctctcggctgggtgtggtagctcacacctgtaatcccagcactttgggaggccgaggcaggtggatcacatgaggtcaggagtttgagaccagcctggccaacgtggtgaaacccatttctactaaaaatacaaaaagtagctgggcgtggtgatgtgcatctgtaatccaagctactcaggaggctgaggcaggagaatcacttgaacccgggaggtagaggttgcagtgaaccgatatcacaccatcacactccagcctgggtgacaagagcaaaactccattccccacccccaccccccaacaaagagggacagctctgtattcactggcagcatttctctaattgtgtgccaagttgtctcagtggctgaaaattcactgtttcccaaacctctggtcccagcagaactcccaggatcctaaaccagagagccaatatttttttttttttgagacggagtctccctctgtcacccaggctggagtgcagtggcacgatcttggctcactgcaagccccgcctcccaggttcatgctattctcctgcctcagcctctggagtagctgggactacagacgcctgccaccacgcccaactaatttttgtatttttagtagagacggggtttcaccgtgttatccaggatggtctggatctcctgacctcacgatccgcccgcctcagcctcccaaagtgctgggattacaggaatgagccactgcgcccggccagagagccaaatgtttaacttagcagacatattctggcctgaaacctgagccatgaaaagcccttacaacaatgcattcaatatccttttcaatgctttatatcatacccggagccattattgtgttgaaaccaggacagctctggcttctcctcatatactaaagactgtatgccaagctagaaactagctaatctagaaaatatggatttggggatcaaggggaaaaagaacccttggagtgacagcatgtggattcttcttcccagagatttgatcacctctcagctatttgtatcaggctgcaagtttcaagtattaatggagcttgtttttgtttttcaggcccaactggaaggcattattgcaccaaagaagtgataatttccacatgattaatttccaacaagacacttgggagttatttactgtgttcctctggcagccaataaaatcatcataagccctttgtaataaaaagctagtttcctgagtgaacaagccataacctcccctaaacaccacctaggtatttgttagaagtcacactattactccaatgtcatcagacacctaaggtctgccagccaggctcctggctgggcaatggaagatggtgtggccctgttagtctccgtgtgtggcttactagccagccttgggaactgccaactcaaattctaagaaagccactgctttctcatcatcactctataccaatacttatttctggccaaatgaatctgcttctctgcccctcaaacttttagttcacaattcatcttctaccttaacttgggcttcttgggcctctggccttccttacttaatgtcttcttttccctactctaatgcatttctaactcactttggagctttggttttctaatgtattatccccacttgccagtcaactggaccccttcctcctcggtttcagactgcctacattaggaaacaatggcagtcaaacccatggctttggagaaagtaaatgtttgccagaaaggaatactagtcacagtggcctttgtgagttgtctgcaactcagctcttcccccagcacagatctgttccccttatcctgcagaaaatcaagccctgactctgcactccccgaagtagtgatgttaattaacaactgaagaggtaactaaatctcacatgcaggtctaatgactaataattggagtacggctgctagacaactgcattttagtatttctcttccattctcctggttttgtagacccagaagattgaatgagtgacataaatctttagttcggggcaagccagggtgggctagggtggtaagctggaggacttcatccttcagttaggctgcacaagtaacattacctaaaaggcactaacatgctcaggttccccagaaagaggcgtaagaagggcctctccttagcagagcttccacctgccatccgtcttgggttcagtgagcttcaaggctcacaatggaagcactgtcatttccccagaaaagctgtgttccctatgctgaacacaccatacacattctcatctggaatctaaggagcagcttttaccctgatccagtatcctgaggaattttaagcctccactcaaatgacctgcctgtgttgtcatttccatgggaaagaactctttccacgagatctgctagttccaggcctctaagacaggaacgtatgtgccataagtgggtctacttcacagactcaatgaggcagaaattattgtagttttctcctatttcttctgcacccaactttctccttgtatttcaaaggccaggccatgtacactaacgtccttgaaatttgcagttctgtatgcttctattccaaatcattcattaccaataaaaacgaaataccaccctttccattttatagacctcatcccctatttctgtcagacagttatatgacagggtgactgtggaacctcttagttcatccaaagtctacctgaagtgctagactttcagactcttatcactgaaatccttaaggttgaggaggctttatttccctagcactggtgaagggcttcaactgtcaaacctcagaacaaatgcattagggccttagaaatgtcaatggggcaggaagaaaacacaatttctaactgcctgtttttgtataatttaataaaaaccttttaaacattactgcttttgtctgaattttttgcgtttgtgtttctgtccctctgagtcattggtcttctttttgttcctgttcctatttttcacgttgtgtgtttcatagtagcgcacaccaacttttttcggccgttgctgtcgtactgctcgcctccgctgtaaaaaatggcaagaaaagatgaagaaaaaaaacaacaaaaccctgaaagtcattcacaaaacaggagtctctgcttctcatctctgtgttctatttcccgtgctgcttccacagctactggaagcagtgctaatgagggagggctccccc

SEQ ID NO: 14120 - DNA, 125192 bp, Human
  misc_feature (1)...(125192): n = A,T,C or G
atcattttttctgatattatattcactttactgtttgggttttcaaatggccatagtatttttagtaccttagtgaaataattattatagttgaagatagattttgttgttgtggctgttttgtcttaaaatgtttcctacttgacaaaaaaaagagaattaatcctgtatcactatccctttcctttttaaaaatcatactggtctatgaaaatcaaatatggaaaccattatagccaactaacaatttataaatataaattgtggcaagtcactataacccttttgtgaaatgtacaagaagaagttttgcatttagaaatcaaaaaccaattgtcacctgatgctcaacaacaaggagacataaattcatcaatggaacttaatagccagggtcatgtactttatgttctttgtctctgcttaaactaaccatttccaggtatcattatcactgtttttcagatgacaaaaaccagatggagttaaataattgtttttcaaaatagtgtagttggtaaatagcagagccaagagttaagtaggagtctgaatggctccaaaatgtttcagatttaaatagacgtctgactgcctccaaaaacctttcaatgtctagagaaagacaaaaactgaattaagggttacaaaatgggattttcaaaaaataaagaccaaaagattatacacttacatattttatgtatatttcctagagaaaggaagtgtaaaaaggaacttcataacttgttttcaaatgtatatatgaatataatgcatgtaaaatgaatataatgtatgtaaaactcagtaactgttttcatttccaccaaagcaaatataagtgcggtagagtataccacagcaagtagaaaagtccctctgaattgttaatacacgttggtgtatcaggaaggaatgtgcttgttgtagatttgaggacagtagcttaatcaaatatagattatatacatggtaaccagaagtccagatatggatgcttgctgtgattgtttcagtagctcagtattagagccaaccttggccttcctctcatagttacacaattgctgctacagtttcagctatcatatctccattcaagcaggaagggcaaagtggtatgccagctatatatgactcatttcatcagcttttctcaaacatcctcaactgcttttggttttgatctcattaaccagtgcttggcctaatgtccttccacaaagttacaagggaatttggggaagcagggaataacattgtcaggactggcttagaccatgggtcagccaaactctgccctgggggccaaattcagctcatacttgttgtaaataaaattttgttggaatacttccatacccctttatttacacattgtctatggctcctttcatgttacaatggcaaaactgagtagttgcaactgagaccatatagcctgcaaagcctaaatatatttactctctggccttttacagaaaagtttgctgacacctggattaaaccaatcatgatcctttgcctggggttgaccatatggacactttgggggtagctgggcttccattaagcaaggaaggggagaaaggatattggaaagaaccaacaatatatgtctcacaggtggtcacctggtccaattaattatatacaagacccaaaagtgataatatattttcggttttaagtcacagagtctccttgaatatgtttttctactccttcttttcctcaagacccaactaagacactttagaaaggcagaaattttgcaaatacacagtatcaaattattgacaatgttgtgacagacagtgaattcatttctagttttctgacttttactaagttactgtcagagtagatcttaaatccatattttattgattgacacttccctttaaactgtttattttaggttcttgcatacactgagggacttcacggaaaatggatgttcagcgagatacgagctgtattttcaagacgttaccttctacaaaacactgctttggaagtatttatggcaaaccgaagtaagtccccttaatattttgaaagaaaatgtgctcatatttacatattattcatttacatggtatgataatgtcttgatttttcctactgtatttctgatgtgctctagcttaaacaaacagaaattctttttaaaaaataaaaaaagaatgaatttgtttgaaatgttagccctaggtttctcatggataaagttatactgaaagctgatttttcatgaagattcattagctttacaaataaatcatgataggcacttgaagatgacttgtaaaattgatggctaacttatcctgcggttttctaaactctgttttttttcttcttaccacagcctcagttatgtttaatttccctgatcaagcaacagtaaaaaaagttgtctatagcttgcctcgggttggagtagggaccagctatggtctgccacaagccaggtaattatatcatattacatattatctatggcttgttaacatatttcaatctcaatattacagcaatgtaaatgtggttataacattataattatttcagagaccaaagaattttctttctctgaaggttatttgtagggatagagattatgaaaatagctattttgagaatgacagaatggttagggcagatttttatttaatacatataaataacaaagtaaaaaacttgattgcttatcacatagctagcatataattaagacattcttgcttgttaaaatcttacaggaaacataccaaaagcctgaagatcataaatgattaattgctatgtaatagcatataaataatgtttttataaatgccatatataaatgcttcttaattaaaacaataaaaccctgagagtttattaagggtaatagtcattaattatggtatagttgtaaccacatttcctagattttcatcttggtattttagaagaatcattttgaaatcttatattattaaaagatactaatgtaagtagaaaacataatcagtagttacttatattgctgatatcagtttgtcgtttttggctcgaaataactgaataccttactaaaagtggcttaaactataggggtgtgtgtgtttaatataaaagatctggagttaaggtgctgccagtattggttcagaggttcagtgatgtcagaaccctgttggctttgtattcacaaaatcaccactacttcttcagctactacatcttcacacaactgcattacagtaggaaaaagacacaaaggatttctctttaagcttctctgttttaggaagaatgtatttctcagaagcctaaagcaatctttatcttaagtccctttggccagaatacagtcaccttcccattcctaaaacaatcactgccaaaaaggtgtgagttctgttggcttagcccaatcattccctaggttttatggaaaaagatacctctgattctttgccagctcctacatgaacaaaagaggatttccgttgatgaagaacaaagggagattgactttaggtagatacaacaatgtctaccacatagactgttatgtccttgagaattattacacagcactgtatggatggaaaggaaaactaatctttgtctatcctcccttaaataggctacagacaactgaaagacagggactgtgttttatttatcctttaatctacaggacctaacacagtgcctaattgcagcagtgctttttaagtgctgtttagctggggttaccttgtattgcaacttatctattctctttaagcttacagtgtaagaccaattcactgacacgtatacacatgctcaagatatttgctagtagaatgacaagattaaactaagatattagtagataatgaagcacttatataaaatacaggtcaaagaaaaatgcatttcatctatcaaagaaaatgaggttagttctgcaagacttgttcttattgaatctaagctgactcataataatcattacttcctttcccaagtgcttacatactatttgtttaatcatcaattcaagaatttactcaggaattgacattaagaacttacgaatgggcctaactttttcctatttaagaataatctcctgtcttctggcatatttctcaatgaccatgattcctgaaagattactaatagaggtttctatatggcatgtataatttccctcagtattctttgacttgtctggaccggaattcatttaaaacaatcagaagctcttttattttatttcttacctatgatgagtattgtttcccttttaaccacatttggtctctttttgacgtttggaagatcattcttttttttttctttgagacaaggtctcactctgtcacccaggctggagtgcagtggcgtgatctcagctcaccgcagccttgatgtccccaggctcaggagatcctcccacctcagtttcccaagtagctgggaatacagacatgtgccaccatgcccagctaatttttgtattgtttatagagatggggtttcaccatgttgcccaggctggtctcgaactcctggactcaagcaatccacccacttaagcctcccgaagtgctgggattacaggcaacagtcaccatgcccagctggaagatgattctttataagaaaactgaaaacaaaaggcagctcagtagttttggtctctctgtaattcataatgccattctatcttcaaacgtccttttgttgtccttggcttattttcccccaaaaagctcaactaattattagtttcctaataatattcttacagactcagttttatgtacttccctagatatacatccttagaagtaccaagtggcaatggggaaacactgcatctaggcttaaacctgtcacttagctgggtaacaataagcaagcctcacacttagtagcaattcaataaatattggtggaaagaatgaataacactactcaagcagaatgacattcttatctaccataaaatggggaaaatatctttacaagagatattctgccagagatattttgcaagatatctttgcaagagatattttgataatcttttgtgctatgtacaagacaatgcctattaagattccatgtgaatactcatgttaataatccatgagtaacagaaatagccttaagtctgttgttcccaaactaaacacgaaggagtcctgcgatatcacagtgaattctcaggggtgctgcaggtcattttttaattttttagggaaaaacagcaacatttgtcagataccacacaaactatttgctcgagttagttccaagtttcaacttagaatgattagatagggctgcatctttttcagtgacacctctgagaaactggtgtttggtggctactgtcttcaaaaacaagagccatatgaaaaatcagtgtggaacaggaaatgagtgtggtggtgtcagatctgattccaaggtttcagaagctgtgcagtttccaacagacatacacaccccattagtaaatgtggttatttaagaatgaaatataaatatttctctttaagtttatgagtattgtattttcaaatagctactcagttgttaagatgttaaatatttattgagttgttagagctaactacttaataaacagaattgtaagatatttctcttggtcaaggagcactatgaaaaattatggagatactaagggtgccatgaattgaaaaagtttgagaacctctgtcaatcagtttaaaaacccagtagctttatcatacttttctaaatacaactgcttttgttatttttagatgaacacattgaacctggaaagtttcataatttggaccaatgatcatggtttattcccttaggctgttcctatgtcccttcttctggacccatgcattttttcaaagttcccagttgtttatattttacaccattgcagggatagatattgtacgggcagaggctgtgcatgtgtacacactctgtgtgtgtgaaggcaagtcgaagaagttcattgatagacattaagtcaaatgcatgtaaacaggtacctgactacctacctacctacctaattaacatggagcagatttgctgtattgtttaaaagctacttgatttatcttaagtatagttttactttttttcttgttgatttgtgactcatttgcagctgtgatttgacaaataaggttgctttcaaattgttttatcctgagtaattaagtgtatcttctctataatagaattctcaaatattgctaatttctacaattaaaatatattttctaattcatctaagaaggataaaccataaattattttaagttgattatcaaagcaatatattagttaatattggattttttaaagttatgaattaaagagactatgtttgttatgctgtgcttaattgctaggaggatatcattggccactcctcgacagctttataaatcttccaatatgactcagcgctggcaaagaagggaaatttcaaacttcgaatatttgatgttccttaatactattgcaggtaagatgtctcattctttaatctaataatatgtttatgttcatcaaaatcatggtaatgtagcctgatataatacatttttctctttggaattcaaatgcatcattagagtaaattttgaagcactcacattaaattttatcagaaactgtgcaagctcataccaaacttttagatgcatttattgttgaagaggcttttccttgctttccttctgccatttcctttgctgacagctttgtctgaaggtttattagagtcaacaaaccattgccagagtgtctggaaataataatgggaaaagtaatttcactactttgtcattctcagcaatagcagctagacaggagaataacaacaggattctgcctagtacagatgtcacctggaatatggcatgattaggttacagcatctttttttcttaaaatcttcaaataaaaatacaaaatcagattacattttctaaattatgagtaactgccatcaacctttgcagtaccatgcttgcaaatcaaaaggaggtagtggctttgttttctgctaaatcagtggttgtcagtggttaaacatgtctatgagatttaagtacttcatcttttttcttaagttaagctccaaaagcccttattcatgatgaattacaaagagtttacttctataaaccaggctctacaaaaagtttttgcaattagatgaattcaaataaccacataaataaaggtgcttaccataattattgttttgttatgaatgaatgctcacaaccgtgtatttagagctgtgtacttctctgaatcattactttaaaaatataactatgtaatattactcttttttaatctatcatacataagtgtgactaaagatactataggtatatattaaatgcgggtaatatagatatgtattaaatagacaaaacttgatttgtccacaaaagggaataaagctatttgatatattaaaatgctttttcactttaatcccaatacattcatgtatatatatgttcatatatacatgcatttattcatatgtgtagtacatacacatatatatcttgaataaacctgtttactccctcaaagataaaagaaatgtgttatactatttaattagcacattatttataaatagaatgaatttaaacatctgaaatgtaaagaacttaatttcatgagcatatttaagtaaatagcatggtgtagcagaaagaacacaactttcaacaccaaagagaagagggagagaatcccagatctgccaactttctgtcctggagcataagttgaattttaacttttaactctatcgtggacttttaatattttaatagcaatatttaatatgtttacatctgttttaataactggtatgtttggtcttatatcatcttgttttatacttttttttaatgtcctcttgctttttatattgtttgttctctggctttacgaatgcttttttgctcagtgctcttgtgatttaaaatgtaagcaccttgttattaattcccctagagatattacatttttaaaagccttataaactatttttcttaatttgaactcaaaaatcaattaacatttttaaatcatacctaagacaaaaacttcaactcaattttatttctcattcattgcttatattcgcaaatataaattactagccagaatccagattattattaacttcacactctggggtctacgtctttttgcaaattaagaaagatttcaaactattgaaattatgtgttcatgcagtatattattttcagctatatggatctttacctgatttttcgggatgatattctctgtacgttcttgtgtaacagttttccatattccctgtattaggtttttatattatctgctcttgagagacctatcaagacagtatcattagacaccattaggtgattttttttcccttggctgtgctagctatttggagctgttggatataaaactggagggcagggtgatatacctcacttgtagttcagtttccaatgtagcaggcattcatattaaatggttttcctattctaaaatgagattttctccaggctctggatggaatgttttctagttcattgttttaaaggtctcttctagtctccatcccttcccactgcattttactcatgtaaggtcagtttcccacagtgtggtacagtaccacctataactaccacccacttcatgcctgttactttctgggagtctctttatctgtccaactctggaaaggttgctgtgtctaaatctggatagagataacattgtcatgccttctaaaagttacacctgagcagtatagagcctaatatgcttttttctatttgggacaatctttgggtttctgagccagagcatgcagactctggtgggaatttaaaagcatcttgctattattgtttgaatcgttgaagtctgttttatttataacatgaagattatatgggccactgatttttttcaaaaattactgggtacttcctttgcaattattatgactaaacatgaaagcctgactattgtaagcaatgggataaaaattaacaatagggactaggcacacagaacacttacagtctagatgaataagtgaaatacacgtaaataagacattttaagatggctgatagtaaatgctgaatcattgctatcgtgaatgctgcatgagcttagcagaggggaggcattttaaaatgtgtttggggagaaaaaaagagaagagcttcacaaatttctgctagttgtatatatatggtgtattcagtggacagaattatcataccttctgtggagtagagaattatatataatattggagccttagagaagagccagattataaagaggcttttaggagtcagtatagtgttagagtagaagggaatgcgatgtggagttttagaaaaattaaactgataattatgtatggcataaatcaaaattgagattccttagcattagtgctataaggggagtagtaatagtaaattgttactgaatatttactatgtaccacatattctatttttccctgactacagaagcaagtaaagtatggtttctgcctttgaaaagatcgtaatatagtgaggaagcagacgtataccagtaattccactaaaaagtattggaatgtataaaattgtgtacaattttataatgtataaaaaagtattataatgggagtatatgtgaagccatttgaggtagtcaaatctaggagccattatttataactaagagagcagaaaaagcttcccataggtgacatttaaattgggaattgaaatatgattaagagttcactagaaagtaggcagagggcattccaagaagaaaatgtgaggtgaagattttggatgagcatatggcagcaggtatggcaaaaagagagtaaatgacactttgtacaatatcattatacaaaaaagtttcactgtcatttgttctagttcagtggttatcaaagtgtagtcccctgacctgcactattaccttggagacctgttagagatttctgatcctcagactcctcctcaagcctacagaatcagaagccggcaacctgcctttcagcaagccctctagttggttctgatacaaaaagtttgagcacaattgcattagccatttaagacctaattatcagggcaagatttgcatataaaacatttaaaacatagaagaaagtacaggattaagtgccattcagtgtaataaaagtttagagaagtgagagattaatatgaaatagtctactcgaggaaaccttggaaaagatgagctttaaatgaactctttaaggattttgtcagatgtagatgactatccaggcaaaataaaccgtaataagtagaatgacaattgaaaaaaattatgaatatgaatatcctgaggtactctccctggatatattcctattaatttaattcttcctttgctatcatcctgaaattttaaataggagtgccagtttaaactgagcaccagcattaaagacatgggtgatggttttcttagagaagcttcagtaatgccatgactgaatacttgttagggcagcaattagatttgcctgttttcctgattggtggacagtgtgtatccattcatctcttcttatcaaatcacccttcagagttctcttatgatcctaaaataaagggtgctctaaagatgttaagttgtaccagtatcactttaacgaacacgggtcctaaaaataatcatactattttataacactgttttagggatacggttattgttcaggaagtatttatttcatttgattgattgaaacttaagatttatcatttctagataggatgttagtcttctttttgacaaatgtaatttcttaggtaatctaaagccaagacatggttggcttatattttgtcataatatgttttaaacatttttatttgatatcaagattcagaaaaaaaatagtattgttattatgtctttctttcatttttcctattgaaacattccttggccgggcgcagtggctcacgcctgtaatcccagcactttgggaggccgaggcaggtggatcacgaggtcaggagatggagaccatcctggctaacacggtgaaaccccgtctctactaaaaatacaaaaaaattagctgggcgtggtagcgggcgcctgtagtcccagctactcggaaggctgaggcaggagaagctgaagcaagagaatggcctgaacccgggaggcggagcttgcagggagccgagatcccaccactggactccagcctgggcgacagagcgagactccgtctcaaaaaaaaaaaaaaaaaagaaacatttctttgttaataataagaactcagaaaaaatagtaaataatagtttatgactattgaataatttataatgtgccaaacattgttctaaggactttatatatatttgctcatttaatcctcacaatagccccatgagttaggttctgttcttatccccattttacagagatgaggtagagagtagctaaataacttggcccaagtcatagggctaataagtgacacagtcgggattcaaacctaggcagtttagctccagagtcttcattcagttactacagcgtactgttccaggatattcctggtaccatacaacttcacctccagtcaccagctttaacttattagctgcttttaaaacataaataattaatgatttaaaacaattttgtaattttcttttacatttcatcaaattaaccctttgaaatttatttactgtcatgacttttgtagatactgatattctagtactagatctgggcctggaattactatctttaatgtagaagctggcactgttttcagttaagctttagatcaagagaaaaagactctgagacagagatttgcttgaggatttttattgaaaagcccttgggatcaacatctgtgggggagtgaagaagttagaactgggcagaaggaggattcagacctcagtgcagttgtgacaaaggcttcagtagatcccacagggtgcctggggctggggtaaccgttcaaagttgtcttggcttgaggcaagggagccaggtcttcattacctccactctgcaatcattggatgcagactcctgggaaggagacatgactggattgggggctttcttctaatggtagcaattcttcgagatggacatagctgaacaccaccagccatgaacaccaccagccatcattgctcccagcatccaccataccagcagttctcagacttcagtgtatccaaagcaggattgctaaaaccctgatctttggttccctactgccataagttctgattcagtaggcttggattgagccgcaagaagctgcatttctaagaactccccatttgatgctgatgccattgatctagggaccacactttgagaattactgccctatatctatatctttaaaagacatacctaaaaataattttattaatcttcatatagcaccgtcagtatcacacatgatgactcttatgatagggcatccttagcattttatgtgcattttatcttcccaatgagaaaaaaagttttgctcagtaaatacccatgaaattaagttacttaatatttatttttgtaaatatttgcaggatgttgtgatctattatgtaaattcactagaattactggacgagggattctttaaacgtcttggattaaagagaagtgttacagaattggaatctggttgacaagatgaaacaatcttttctggcttcacatgtttaaaaatataggtcaatgtgacctaataaatttcatattttctataaatattatccacaaatattctataaataattctaagacttagattaaaacagtaccaaactgtacattattattacactctcagatttatcttttttcccaaaaatattattttagtatgaaatgcaaagtacattttatgacccatttcttaaaagtgtctcatacttgaccaatttcacttttctcctttctagatgcttttaaaaataagattctgtataaagcacatggtctcagtatcatagtattaatgcattatgcagactttttacaccctcctgtggtatgtgtacatgtgcataattgcatataaataaacacacatttactgtatgtaagttttgtaaagatactttacatagaagtatcttgccaaaagaagcttgccaaatatcccggaaacgtatttaaaagacatctaaaatcccataaatgtgttcttaggctttgttttattctatttataaatttaatgaatgttcattatagaaaattggaaatacaaaaaatggtaattttaaaaattaaaccactcaaaagtctaaccgtaaatatcacagttgacatttgggtgatttttctgtttttcattctctgtgtgtggtgtgtcattgggaacctgtaatgtatacaggtttgctttctactttttccatttcactaaatattctttgaaggcatgacttttaaaactacatgagagtccaacctagaaatatggcaaaatttctttaactatttttgaaacacttgatttttttcaaagaacattaaattttagatgattgtgtaaaataatcttaatgatacttagagttctactaaaaatgtggtttcaactttcagttcccaaattgacctgatttctgtttgttttctgaaaaatacaacctatgccttattttataccttgttagataatattatgcaaaagatattaaagcctgtaattcttgcattttaaaaaataggagagtaaccgctaacacggctttgtgtaaatgatcccctgttaaacttgagaattttttttaaggattttgagttgtttttcatatgatcagctaatgaattcagcacaacttctccaaccccaacctttttctcctgtttagcattttccacttttttactctgtgatgaacaagccctccctggttaattatgtatatatttagcaactgcatgtgttgggcttattattgtcatctaattagatgtaacttgaactgcttgcttctagaaaaatcattaaaaattctttcctaatgacctagagatgacaaaatgtctgtaaagtgtgaagaagcagacaagcacaggaacatcgctcttaaagagtgttaatccagatgctgccatcatctaattaaacaatattttgctgtcattaacattttcaccaaggaattgcagttataatttctttgtcagctgtctctagatcactttaccttcaaaaccaaagtgccatataaaaacattaaattggatggtttaattaaaaagtttttttaatgaagaaacatatccagtgtttctgagatctcatttactgtttcacttttattatttgagtagattagtgtcataggcttgcggtatttaatattcatcttccaagataaattcttataagcatagttagcaaaataaagtgtatgtgtgtgtgtgtgtggagatagatagatagatagatagatagatagatagatagatagatagataatctccacacacacaaatatatatatttacttaccactgctggaaaaggaaaggaccctaccaattatagcaccagtgtatttactaaatatcaactatcctaaagaaaaaacaaaacaattagtaattaaacatctaggtatgccagagcctcatgagtattactttggaaataactcattttttggatgatttaatgaacagtattttttttcatttcacaaaggtgttcagtaaaataattaaaggagtaatactaattcatgattaaaacatatcaatgcaaaaccccaaagtgccacttcatcactctttttttccatgtaacattaaatacattgtgcatttttaattcaaatcaaatacatatatgactgtccattttacaaggctcttatgcagaaatttttattaaaaacaagcattaatgtcatatttatttataaagtttattatatttattagaattaaaataatgctataaatctctgctaatttaaaaattactaaaattttccttttagcacttattttcaaaggacctctcaaagattattgaaagtgaattacaaaaaaaaatgcaggacagaataatagacatgaaatatggctattggcatcattcattttgtgtatacgtgtgtgtgtatttttaaataatgcttttcttctttgtatttttttcctaaaatagcattatttttttttaacttttattttaggttcaaggagtacatgtgcagattttttatagagataaattacatgtcatgggtgtttggtgtacagattactttgtcacccaggtgataagcatagtacccaataggtagtttttggatccttaccttcctccttccctctaccctcaagcagtatccttttctttcttagaaaatcatttctattaaaaaggctggtgtcttcaaatatagtctacatttttatgctgtttgcattgacacagtacatttaaatactgtgtttatgtaaattggctttttaacagttttccttaatatataaattataaaacttcatcagaaattattttaacaattgtggttatctgattttcatctatcaattaatttatttaagtaatatatgttatatctagataggtagcatcagcattattctattaaaaaaatatacactggaatacttgcttttcattaaaatctacagatttttaagtagaacagctcccccaagaaaatggaagagctctaaactctgccatggacccatttaggatcccagaaatagctctgtctagccaatctgtactctttgtatatatacatataaaaaaagtactgagccctatcaggtgtcctaggttagcatacatatgaactattagtaataaattttcaagtttagaattgtacagcttttattttacaatattggtactgttttagcagattattgtcatgtcaaaagactttaatatggctccgaactcttgtttaatctcatcattagtattattcaccatagacttaaacacaagcaggttcattgattgcttgagctacctagctgtagatgttttcttctcgtttaatgtagacattcacaatatcattctctctcatatatacctctacgcctttgcataatcctcatcttctaaagataatgttctgcagttttcctttacttgacttatatttgttcatcttctgaaatttgggtcattttattccatttttatcacatgcatatccattccatcaacaaacatttattgggcagatggcatatgccaacacacagagattaaaacaaacaaacaaacaacccagccctgatatttatgagtttacagactggtggagaggcagagaagtaaacagcaatgtatatcaggtataatagaggtctgtatgagaactgtggtgaggcaacacaggggaagccctaacctagctgtaacctcatcccagtaaatgcaaagtggaagcaacattctgctgccattacccacacctatattacatacccacacctatattacatacccacaccagtttatacatttaaagcaatatgcagtttagttgtaaaatgcaaagcttcatataataaacagataaaatagtcatcaataaagtgttttctaaatatattaattaatttggtttgatgcttgcaattacagattttggttcttactcagattgtatttctttttttttctatttcacagttatgttttccaaatgctgtaagagcagatatcatttaatgtaatttcctgatgatgaacaagataatatctgcatatctatgctactgtgatagtacatgtggtgtgtgcaaccatggcatactggatgaaactcatatcactaaataccagtgaaatagctgttttgtgtgaattttaatggaaatttagaaaattactgataattggatcataacgcatttttataaaaaataattttgttcaacaaaagttttcttaggatcctgtttctttaatagctattctcttaatttcacctgatcatgttttttcagtttcagtttatgagggggggccgcagcttgctcccctaaactttccccattcccactgtgcctcaatatcatacctgaaatatttaagtcattctaccaaaacataagcagacatattcaccctaagatcgagcagttcttcgctaaagtgaaacaacataagacaaaaaaatatttcatgaacttaaggagtgaaaaaatgtatgattgacatctgcctctgtagtttctcatcctagcttcagagtacttctgtccactcgcaaattctctgcattcattcttgatataagtttaacatagtattctgtgtactcataatataatttctagatatatattcattataatagaataccatcacagccaggtgcagtggctcaggcctctaatcccagcacttttggaggccgaggcagatggatcacaaggtcaggagttggagaccagcctggccaacatggtgaaaccccatctctaccaaaaatacaaaaattagccaggtgcggtggcgcgtgcctgtaatcccagctactcaggaggctgaggcaggagaatcgcttgaacccgggaggcagaggttgcggtgagccaagatcgcgccattgcactccagcctgggcgacagagggagacaccatctcaaaataaataaataaataaataaaagataaaatagaataccaccacataagctgcagatgtgcaggtcagtggggtgacttcctccataattactttcagggcctctgactggcaaggctctgcttccggggttgcaatattatctacatcagcagaagagagatgagacacacatgcaggaagtttcagtgggccaagtcttgaagagactttgctcacattctgtagatgagaactaaatcctgtggccagagctacttgtaagggaggctgagaaatgtggtgtaacacaggaagaggagaatcaattacaataaccagccagtagcctctatcacagtcttataaatagtaattctagttacgtcttaaaacaattattgagtgaattcccttgaaatgcattgttatcagagttaaagatacggttcaataaataaaaagttattttcttctgaaattcagtagatgctttgtaaaaacagaaactatttcataagcattttgtgtatacaaatttttatttctgtttttctttactaggacggacatataatgatctgaaccaatatccagtgtttccgtgggtgttaaccaactatgaatcagaagagttggacctgactcttccaggaaacttcagggatctatcaaaggtaacttttaaatatatagaagtcagctttcttcataaggctatagtctaatagtatttctgtcagagtatatatagccagttaatgtttgtaagaaggtgaaactgattatcttgacttacatagtcagtttctaaatcttaccaattcttagcacaggaattaagctacaagaagataaactagtactagcataggcaaaatgaaatgggtatttgagaaacagcagatgtagagagagttttctcatatatcctaggctttaaagtcaaggttaaaaacctaaaattagtagaaaatatgatggcaaatcatttatgtgatatgttccttagatggtaagacatttatattgaccataaaatacacacattgtagggaaatataatactgaaaagaaagtcagttaattttaccaagtgtctgtctatatatgagagagaagatatggcccaaaagatggcaagaaaatggtgcataacggtaatgagaaataaaaggcaaaatttttattagctcacctcatttgtccagaggaaactacagtgtgatactaaactgtttgaaattcagtgaagaactgggaactaagcccaaaaagctgctctatagtctaagcttacgccagaggcctgccttaaagtttatgtatgttagccatagtaaagcctcagcccattgacttggaatgtatctctgttttctatcagacttgattgtctgatttagcaatccacagaaagttgaaaggtatttgtgtatacatttggttttagggggcaggtttaaggggctaattgacaagagcagcataagccctgtgatttagggaaacaacattacagctgatttaaaattaatcccacagatggtttttaactcagcatgcctgcttctgccccttttctggcctttgaaacctagacgtacctaagttgaagttctatattgcactagttactagctctgtgacctaaagctagtttctcttgtcccatttgtaatatgagaataataatactgtcccatgtcaaatagttgtacagatctaatgacatgtacatttaaaaattataacatagtacttggcacatagaagcacttcctgagtattaagtattattgttacacatggaatatttcttagcctcttttgaagactgtttgctagttttttcatgttcttatgcgtcattcagtatccaattcttttattttatataactccctattaaattttagttgatagctcatggataattttagctgtggtattatagatgttaaagggacctaaaagatcagttagccaacatcttactgagagtcacacaactggtagaaataaattgctagcaaatgaattctaatacgcttgcaaatatagtaattcttccaaggtgagtcaaccaaaaattcttaactatttaccatattcaggtaactaaattatttaagataaggtagatagaagcattgtaattcatgcagcctgcccttcaggaacaaatctagttatagattatctaaataataagatcagtcccccaaaaaattaaaaataaagtacaatattttagagagacccacacaagagataatacatgcaggttgagtatcctgtatctgaaatgcttgggaccagagtgttttggattttggatctttctggattttgaaatatcaatatatacattatatacttaccagttgagcatccctaatctgaaaacccaaaatccaaagtgctgcagtgtttccattaagcatcacatcagtgcttaaaaacttggatttggggcatttgagatttcagaattttggattagggacaagattaggaacaagaactctgcagctagactgcctacattcaaatcctaattctgccatttaccagctgtggagctttagacaagagtattagtttctctttgtcttaatttcctcacctatataatgagacatcaataataatagggttgttgtgtggagtggtggatgggttaataagcataaaggacttagaatagtgcagggacatcagtattagctaatgctatgtatatgacaataatagagtggtgaatcattgatataggccatatgctttgaattgtgtttcaaataatgatgatgaatatatgctactacatacatattggatgagaatatttgaatggcatgcatgacttgccaaggttgaagtgtaattttggggtgtaaaacaaaaaccaaactaacttattgatgtgaggatgaaaactgtcaaactagttctttgacaaaatcttgtctgcatgtattttatttaacataaattgaatagccattacttagacattataaaatatatatacgataaaaattcagagtatagattctcaggtagcatattacaacctcgtacgatgactactattatggctattgtattatttttaaaacaaggaaggaagttctttttatttaaaatcaactgggatgttgtgtttaaaggaaacttatagactgaagctcctttttttctctccatttatttattctttcagttgttcagtcaacaaatatttatcacacatgtgctatatgtcaaacactctacaagtgaaagagtgtacaggagtgaataaagcagacatactcccagccacttgaagggagttcagcccagagcaaaatgaaaactcagatagttaacagtaatatgagaggccagcatttacaagataggtatagtagggactgtgcctcactggggagtacaggctcagactcactaagacatttggactcaaatgttcttgaaacactggcccagccaaagaaaatgtggcactcattatgattagtatgggttatagaaggcatctggtaacatatttgctggtaatcatagatttttttcatttatccatgtaggaaaaaatgagttaaaataaatgaggaagtcactgtttctacagtaactgaagatataaacatttcaaggttttgtttgtttgtttgtttgtttgtttgcttgcttgcttttgagacggagtctcgctctgtcgcccaggctggagtgcagtggtgcaatctcggctcactgaagcctcctcctcccaggttcaagcgattctcctgcctcagcctcccaagtagctgggattacaagctcccaccaccaaacctggctaatttttttgtatttttagtagagacagggtttcactatgttggccaggctcgtcttgaactcctgaccttgtgatctacccacctcagcctcccaaagtgctgggattacaggcgtgagccaccacgcccagcccatttcagggtttttatgctaatctgtgtaatgtgtatttcctttggcagagcttttccttttgtgcctcacatgtgctcctctaattttatatagtgttaagtaaataatacaggtaaacagacggagcctaaataaattaggcaatgtgactacaaactgtagttttgcaagcatgtagttcttcatgctgtgaacagttgaatccatgagctcttaaaagataggtagcttttcttccaattttactatattctatgctttagcaatttgttctttctattctgtcaccctagcatgataggaaaatgttagcaaattaaagcctcttgatatgttaataaattactcgtgcattgttcccatgcttcattgaatttcttaataggagcttcttacaaatgagctagaaacctgagactatcctgtataaaatccatcaataaacaagattttaatgtatgaaaatatatctttttatatgcctaatgggaaaatgacatttgaagtataataatataattggaaggaaaaactactatagtgcaatattatcacaatgaagagatgtccactaagaagcacatgaagttcttgtagttataatcaataccgcaaatgaaaattttaatggagagtttcttactcttcagaagctcaaggaaaaattgaaatacttgaatgatatgaccaagaacattctaaaagatctctaacaacaaaagtagttgtttctaaacaaacactgggagtcctgatcccagtaataattcttagcagtgaataattctagaatttgtttcaataaacatgtggtaccccaaatactttttatattccttactatatgaaagaattaagaaactatgaaatgtacaatgccaaaaaaataaatatttattttctttctttataccaccacattacacagccttcatgaaattctgtgttgtatcagttgggaaacttctgaatgaaagtttcagaaaacacagctgaaagtggcttgaacaatagtgggaattgggagaaaaagtcaagaggttgtaactggaacatgaaaagaatgtaggcttcgctcaaatatttgtttctgtgtcacatattgtgcaaatttaagatgttttctaaattctctgaacttgttttctcatctttaaaatgaacacaatcatacttacataatagggttgttgaaagattttaacaccgtaaagtagttaaggcacctagtataatgcctgacacagaagtggcattcagtgagtggcagtgacaaagcaaatttccataattgtcatttgagagttcactatctttggtatgattgacaaaaacctactgaaggttatttgattcctctgatttattttttattctagtaagattaaaaattaatgccatttaataaaatatttttaattcaataaataattctgttttatcatctatttgagttatcaaattatcaaaactgtaacatcaaaacactaaggttatattaaatgtttattagaactttaggtgcacatttatttagactgaaatattttatatttataatattcttacttgttctttggcccacttaattgaacattcgaagagcacaggagcaaaaaaaaagttctttatcagtaagattttttagacctctcatttgattagacatcacaggttcaagttttatttattatgtgtacaggttaggggctatgtttattgtttgacatgagggtcaacagatgaaacaatctgcctttgacctatcttttcaacaccaaccaacagtaggtttagagatttcctccccaccccatttatataggtattccttatggagatgtaaccttatggtgaaatctatcttacaacatgatatatgctagggcttcagttatttacatatactcatatgaactcgactcttaaattacagtggttacatgactttgatgtgaagcacagtctctgctcattaaagtgtaaatagaattttcctatttcccagtcatgccctctgataagtgaaatagtttcatcacaaaaccaagtcctactaatattgacatgaacataagacatcacatacacacacccattcatcgagtggaaaaaatatattttgttaacacaggagttgtttgactgacagatgatgataagcataaccattttcccaaattattatgccacttaataaaaggaagtgataatgccttgaggctttgaaatgtgataatgcaaatggatgcactgaagtgtgaatactcttcaaccatccaccctcaatacttccaaatgtctatctaccacacagaaaagagtttatattggtaaggtggggaatgcatgactcagcaatctagagcaagttgggtttgttgttgttgttgttgttgttgttgtttttgagatggagtctccctctgtcacccaggctggagtgcagtggcatgatcttggctcactacaatctcaactagagcaagtttctgtggttattttatctttctttttcactgtaagttaacaacatctaaaatgaaattaattccatttacttgatcataatctacctaatgcttaattttaaacaacaaaatatgaagtatgggcaaaactactaggtgtgttagtggtaggatgatacaaaactaaaagataaaagtgtaaatgtgtaaatataattatataccatctgccaaataaccctgctgccaaatttgaaataacttgtttcaatgtatgttgaatgctgccttaacatataatccacactatgttgaaaattgttttcattagacttgctaatatggcagtgctgagggacaaggtattgactggcagtgtttggatactgttttaaactcatgagatattcatttatttaaattaatacttttattcattcactcattctttcattacacaagcatttattgccaacctactctgtgccagacactggagatacaaaggcaataagacttagttcatacctttaagaagttacagtcattgtttacccagtgacatattaagctgttctccttctaattgaaaaaatggaagaaccaagaaaagtgcaactaaaaaggtagacttcacagacactggtaaccagaaacagtgaagtgtttttgtgtttgtttgtttatatctccagtgttgcttgttggagacataatagggtgacagggagctttatagatttatacagaacttccaaagcagtcctaggctctgtttgcttatactaaatgtctctttatcctcttttcttgttccttcccacgtagccagctgaatcaccctttcagaaaaagagagggaaaaaaatcctatagagcctgttttgctttgaaaattttaggctgttaaagaagaaactgaaaacagcaggaacactgtttagtgtatgctcttagaagaatcctacctatggaaaggaaaagagagcctgctttatgcactttaatttcaccagccacatgtcacctctgtgtctaaaccacagcattatcatgcaaaactaggccaaattcagtctcctttaacctttctttccagctgaaacagaatattaagcagttagaagtgatcttgaaactaatttgtagccccatcattatccttctacttaatacctggaaaacttctagaactaacacatgaagatttaagatgctctactgtttgtaggtgaaagtatttacttttcactaagatatataaaactaactttcttaggaactatcttgggataatgataataataatagccaatattttgcatgtgtttattatatgccaggcattgtgctaagcatcttacatggattttcttgctttaccctcacaacgctatgatgagttgcactggttatatagattgcattttcttccattcgttacctattatttctccataatacatagataggatattctttaaaaaaaaaaaaaaaagctagtgattaatttctcttctagatgccctctaccttttctaagtgccctggcagtttttatacactatcaaaaaaaaagaaaaacaaaagaaaaaaaacaaggaaagaaaaagaaaaaagaaaaactctccctattatccagtaagaatgagttcttttaaaatatcctgcacaatgctcagtcatgtcagatatgaggagaggagtcaaaagaaatgcggtcagtgagccattccacacctccaaagttttcagtcctatgtgggactagcattcctgtgaaagtgcctaaagctggatgtggtggctcacgtctgtaatcctagcactttggaaggcagagtcaggaggattgcttgaggccaggagtttgagaccaacctgagcaacatagccaaaccctgtctctacaaaaaattaaattaaaaaaataaagtgctaatagatttttttttttttttgagtttcgctcttgttgcccaggctgaagtgcaatggtgcaatcttggctccctgcaacctccgcctcccgggctcaagcaattctcctgcctcagcctccccagtagctgggattaaaggcgtgcaccaccacgcctggctaatttttgtatttttagtaaagatggggtttcaccatgtgggccaggctgctctcaaactcctgatccacccgcctcggcctctcaaagtgtggggattatcggcgtgagccaccatgcggccaagtgctaatagattttgctaatcaaattgcaactttagatcaaagatgatctttcttcataatatactcaattccaccctatgaaaaactataaaaagaaacacatttaattaatagaaaaatgtaatcttaacacttctctttattatcgtttcatgacttcaggttctgttccttaataatgtatttgaaaattgtgtactgatttgctgaagttcatctgatgacaaaaggccatattaagccaattaacagtataaaattgcaaagggaatgtttaatccacacttacaagaacgtaattttaacatattttagagaaacaaattttcaagtcatttaaagcattcttatttagaacaacccaaaacataggaaagacttggattgattggaaaggttttgtttgtttttgtactctattttaattgattttgactttactatgaaaatttttaagcaaagaaaaagtaccaattcctaataacaatacccattaaccaatacctacatgttataattattgacagtttagcttttattggtttactgaagtatttttaaataaattaaatatatcatactttacccctaaatatttcagtgtgaaaaatagtattttcccatataatcagatcaccatgattatatctaacaaaacttatgacagttccctaatattatctaacactgtgcctataatcaaggttttctaattatctcccatgtgtcttaaaaattgttttgcttaagccaggattcagtcagcgaccacacagtacatctgattcttctgtcttatctgtctaaaggttagaatagctcccagccaccctaacacccccaccttttttttcatgatattgactcatttaagagagcatgccagttatcttatagaacataacaataacagccaatattttgcatgtatttattatatgccaatgctaggcttctgaatttgtctttttgttcctcgtgttgtcatttaactcgctgtaactagtaaggttttgatgtacgctgattcaaatatcaatgaagattgataatagaagttttttgttttgttttggtttggttttttttttttgagacgttgtctcactttgtcacccaggctggagtgcggtggtgcaatcttggctcactacaacttccgcctccgagattcaggcaattctcctgcctcagcctcccaagtagctgagattacatgtgcccacctccatgcttggataatttttgtatttttagtagagatggggtttcatcatgttggccagactgatcttgacctcctggcctcaaagagatctacccaccttggtctcccaaagtgctgggattacaggcatgagccactgccctggccaataatagaaatttatatttggaaatatttggtcaataacactagccaaaatataaagttactatagttaatttaaatttatcaaagttaaaatgttcacatgtgaaatatatttctgggtcatataattctaaaagccgactaaaattatctctatgagataaaccaaattcatgattaaacagcaaaaaaagagtatacagggaagactaaagtctccacattctcactgcccagagacaactgttgatatactgtcatatatattcttcaaaaaataaattatacaaagtagaattacttgatcaaaactatatgattttttaaatgttaccaattttccccacaagaaatttatactgatttatttgccaatagcattatgagatatcatgttttccaatactgagtattataaaacttaataatttttgacaatctagttaataaaaatagtttttgtttgacattttaacaattgtgagtgtacttacgacttttgattacatatagtagaaagtcaacttatactggctttaatttaaaataaaaatttgattagcccatataactgagaaatccagggatgggtcagttcaggaaaactggatccaagtgcccaccagaattatcaggatccacacctctgttacttttctacattggcttcattctcaaacaggcttccctgtgttacagtaatgatgtctttgtaaccccgctagaaaaagagagcttttcccagatagttgcagcaaagtttcatccgatcaagttgaattacctgtccatttctgctgcagtcatagtgccaatgtggataaaatattatgattgacaggtctagatcccatgcccacccagggagtcaggtagcgaggtcagctcacctgcaccaggtagaccaagagtggggaaggaatggttcacaaaggttgaaggcataatgaatgctaaacagaaaaaaagaatatatatccattacattgtaggaactggtactattttttcttatatatattggaaattggcatttattattctgtgaattgcctattcatcatatcatttcctcatttatttaattagattgttcattagcttcttattgatttgtaagagcacatttttaaggaaactagctcttatgtgctatgaatatttttcactttgttatgtctttcgatttttgcataaaatttttttctaaaatttccacatggaaattttatataatattatataattgggtcaatcagtcttcattcatttagcatttattgctcgcttaaaaaggttcaggtactgtaggtgtgagaataaagagatgaataaaagacagggagtttcttcgaagggctacactactgggttaaaaagatgagaaagttgcctattaccagatggtgtcatgtaaggctttacagatgcaatttgaaaaacctccaaaataatgagttgaagttccttagataaaaagggagcccgggaatttacttgagcacagaagtgtctgtaggtatgatttctatgttgtcataacagaattttcagaatgatgacaggtagttcatgactaaaaaacaaaaaaggtaagaactctcaaagcctcttctaaggattttcaagcccttgattacaaaagataacacgataacttagatatgttagcagttcaatgtcttaaaagtattgagataactaaaagctatcgttagaagccagacaaatgagtcaaatatacccagcttcaagctgtatctagcacagagctgcagctggttctgtaaaacgtctagccactgactagcaacatgatcttcatttgacttttcttcagtgtactcatttgtaagagatttggtcaagtttacctgaatgtttccttccatttctgtggatctgtgaggaatgaggaattaagtaggaaattatgaaagaaaaaagtcacatcaagggccgggcatactggcttatacctgtaataccagcactttggggaggccaaggcagaaggatcacttgaggacaggagttcgagaccagcctgggtagcatagtgagattccatatctattgaaaaataaagtcacattaagatcagaatttcatatttagcaatgaaaaagcagtgcagtagtgtggaatgtggagacccaggtacctgtttcctcctcatgaaattaggttcgtattgaatgccttgctgacctcagatacttatgaaaatcagtctagaaaatggatgtgaagacaatatgttatacaaatatatagtatcatcagcagttgtaatagcagtagtgaactcttgaacattttatgtgtgcaggtttgagtattccttatccataatgcttgggaccagaagtgtttcagacttcagattgtttcagatttcagaatatttgcatatacacaatgagatagcttgggaacagatccaagcctaaacaaaaaattatttcatttcatatacaccatattccatatagcctacaggtcatcttaaacttttttttttttttaacaattttgtacatgaaatgaagtttgtgttaagtacgtatgtgtggaattttccacttatggtgtcatgttggcatgcaaaaggttttggaatttggagcattccagatgtcaaacttttggattagggatgctcaacctatgtaacagtagaatcctagtaccatgaacatcattaccattttcagttttttatgatatattagaattcagtgttattgacattgctttaactaggcctctgatttgtccttgacaaacttttttttcttgaaaattataatgtagtttggtgacattgaccattcatcagatcaatccacatttatttatttgtatttgtttaaatcaataactctgtgctcagacttttatgttctctaaaagttcttctgatgtctcatataataccatttatccaatatgttttatttatataatttttgtggtcatttttacttactaaatttatatattttatacctgtcctaagaaaagggcttggtacaatatgcaggtttaaaagatagaaaaatattggtaaatcaaggctaagatgacagaaagaggaaacagcaaaatgaaactaaagaaaaagttagcatgcagaaatacacatcaaatacataccagaatgtttcaaggtacaatctaaggtattgcatctaaacagttgttttaaaaacaaaagaagtatgtatttcccattaaaaattttaaaaaataagcactggaataaacacatttaaacaattatatttactatagtatttatcagagccttaagatcacgtaaatccccacaaacatctggtaggatttttgtttcatgtaataaagtcacaaaggtttttatttttaggaaaaccaagctttttgtggcactgaagtttgagacagatttctctctttggtcttcaaaacagggaaactgagtgataagagtagagaaaattctcagcattatttcttcactaactacagtagtgtttcatgtgaacatcctaatgctacacatgtaatttcccgtagattttataaggaatgtgaatttttttacattagtcacttctttgattcttcaatattggaaacagtgcctttttgcaagctatgtaggctttttagcagttttaaaaactgaattataataataaagttttatagggatagaaattttatttttcatttttgcattttttgcaccattttttcctatttgttaaagtgttcacctgtaacataaaagctaaaaaagacaaaacagcaataaatctaaaaacaggctttaaactttcagttaaacttttgtatatggtaacacttaaaaagtgcggaagtcgctgtatccaaatgcccactgtttgacagaaaaggacactatttattgatgtagtaactataatgaaaattgaaaaatattgcaaagtaaatttataaattttattaagtgtagccttaccttttgaccagaattcttaccatattcatctgccaaaatcagatgatattgacattgcagtatttgctaaaatttttgaagtatagcaaacttacaaccttgtcagtatgtaggtaagtaggtaattgattgatagatggataaatatgatatgataggtatctattaggatctcttaagcaaatgtcatctatgacaaaattcttatttccccaaacatttggaagctttttgctttctaattatttattgctgtttgactgttagaagcaaaatgatagaaaaatattaagtacaaagcaaatcacttgcattatgtttcataaaagtaatttctaaccttattaggtaaaaattcaaaattagaaatacattttaagaagttactaatggaggcatatacagactttaatactgtgcagctgtttcctacaaagcattactctgtaaaacactgcaataacatgactttgatgaaacttgtgtaaaataaaaaatataagtatttacttttccttttccagaagtgtaagagaagattgaaaaagattagaggaagagacatgctcctttttaaagaatgttttgtgagattttacaggacaaacagtatcagttaagatcaaaccttagggattgcacagacattttatgcacgtgagaggtctattagcatattcacgacagaacaaagtattaaacattttcagtgctttgaaaaatatactcagtaatgggatggctgggtcaaatggtatttccagttctagatccttgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgcggttttgatttgcatttctctgatggccagtgatgatgagcattttttcatgtgttttttggctgcataaatgtcttcttttgagaagtgtctgttcatgtccttcgcccactttttgatggtgttgtttgtttttttcttgtaaatttgtttgagttcattgtagattctggatattagccctttgtcagatgagtaggttgcggagccataaaaaatgatgagttcatgtcctttgtagggacatggatgaaattggaaatcatcattctcagtaaactatcgcaaggagaaaaaaccaaacaccacatattctcactcataggtgggaattgaacaatgagaacacatggacacaggaaggggaacatcacactctggggactgttgtggggtggggggaggggggagggatagcatcgggagatatacctaatgctagatgatgagttagtgggtgcagcgcaccagcatggcacatgtatacatatgtaactaacctgcacaatgtgcacatgtaccctaaaacttaaagtataattaaaaaaaaaaaaaaagaaaagaaaaaaaaagaaaaatatactgagttagaaaaacatatctgaacatctagtaaagtataaaatatgtgggtaattttaaatgaaaaactcattactttcggccaggcatggtggctcacgcctattatcccagcactttgggaggcccaggcgggcgaatcatgaggtcaggagattgagaccatcctggataacacagtgaaaccccatctctactaaaaatacaaaaaattagctgggcatggtggcgggcgcctgtagtcgcagctactcgggaggctgaggcaggagaatggcgtgaacccaggaggcggagcttgcagcgagcccagatcgcgccactgcactccagcctaggcaacagtgcgagactccatctcaaaaaaataaacaaataaataaaataaaaaaataaaaaactcattacttcaattccgtaacagaccttacattcatttcactttatagcaattacttttaccaataatgtaattatgttgttttaaatattaagattttatgtaatgtttaacaaaattacattcccttttttacatctatctaaagagatttgagagataatgaaatttaacacaataaaatttaaaccttagaactttttaaaaaatctaaatttttatactgtcatactttgttttacaaaatgaggacaaaaaagtttaggaaccttaaaatattaacacttttgtgcgtgaaaaatacagcttttatataaattgttgagtctttgttaatcataattaaagttaacaaaaaatgaacataatttacaagtaatttaaatattcaggataagcacccttgcaaataagagtttattatggaaattctaacagactttttactgctgatgacctcattgtgttatttgaattagtctcctgaggccaaaagaaaaggctcataacaatttataaatgaatcttcctctcttgtgtaacattatgtgtccctttgaaacactaattttctactacttctcttgttaaaattaagccttcgagggatcttcatagttaattataaatattaaattttgaaataaagtagacattgtacttagtactcttgttttctctgtaaacatacttaatttatagtatgcaacttaaatcaaaataatgtgcttatttgataccataagcacggactctgtataccattaatccaaaatcagacaaaaactgaagctaaggcagtttgctatttgaaatcatgaagatggtatgctggaaattcctaatgattagatgtgctaaaattttgagactgtgatgcaattaagcacatgctttttgaagaaatcagtatagggattagcatcataatcagtaaatagggtggtggtactgataggagaggtcttagtggcctcagcaaaatgctttccaaggaatccgaatttcctggattattccatcacccttaggtgtgtagtttaacagtaaaaaggatagttgttccatctatatactaacagaatgagactaacattctatcaggcttccatatggagggttgtctttcacactctgggtaactggctgttaagacaaggttttcactaatatggttgtcaaatggtcaatctcttcaccttccctccattgggtttcctgtattccaagctaaattttcattatgtagcttattaagtagaaggaaaataacgaaactgttggtgtggccttaacagtttaaactagatcacctctgataatctagttaacaaaaacttggtaaagtctagatactttgtactatgaattatcctcttgggcagtttataacaagtgtaatgatttgtaattaatatcaaaatccagtatggttaaaaatgtaatacaaaataatgtatttatgctgtatggctaaaatgaattaacagtgaaatactgaaagtataaagatttattatctaggatatctaatatgactgtattaaacaaaatattttttttcttttaatagccaattggtgctttgaaccccaagagagctgtgttttatgcagagcgttatgagacatgggaagatgatcaaagcccaccctaccattataatacccattattcaacagcaacatctactttatcctggcttgttcgaattgtgagtatcttcattgagttagcttgcctttggtaccttaaaattttaacataagtaaattaaataaaaatcaaatcagttgtaatttgattaacaaagattagagacgagtgaagtagaaattaaagatttcaaagtagcaaaatatgaattttttttattgagttgtctcatttgcaaaattggattaggaagatagttatctgttgctaggtattatgagcttaaaccaaaccagttgtccagttataaaggagccaaaattgagtacatacctttttttttttttttttcagtgagagggtctctcactctgccactgaggctagagttgcagtagcactatcatagctcacagcagccttgaacccctgggctcaaaggatcttcctgcctcagcctcccgagtaactagaactacaggcatgtaacaccttgcgcatctattatttttttatttctcttctttttttttttttgagacagagtctcgctctgttgcccaggctggagtgcaatggcatgacctcggcttactgcaatctccgcctcccaggttcaagtgattctcctccctcagcctccagagtagttgggattacagatgcccaccaccacgcccagctaatttttgtatttttagtagagacagcgtttcaccatgttggccaggctggtcttgaactcctgacctcaggtgatccacctgtcttggcctcccaaagtactgggattacaggcgtgagccaccacgcccggcccagctattatttttaaacatgggatctcactttgttccccacgctggtctctcacttttgttctcctgggctcaggtgatcctcctgccttacctccctaagcactgggattacaggtgtgagccaccacacctagccctggagtgcattcttaatacccactgcctcctttctcacaaatgaggcacactggcacttgctctccccccctccctcattctttcttcttgggcagcatgttttaaaaccagtttccaaatgttttgaaaacctctttctgttacttttctctttctcctaggacataaatatatttaagtctcactgaccttaaaaaaaaaaaaaaaaaaaaaaaagcctcctgccagcctccgcccactctgaagttctttcccatctctctccctgcacagtcagattcctgaaagcacaacctctgctgtcctgcagtgcactgtggtacctgttgcctctactttatcacctcccattcagtctttagcctggttgatttcagttccacatccatcactttactgaactgttttggggaggtcacatattatgcagatagagcatcccattttttacctatcatgtctcttgaagcatttcacgctattgctaatctctccttgaaattttctttcaagttccttttacaataccctctcctggtttgcctcctgtcatcctaactgttctgctcagtctcctgttcagattgtttttccttaatgttcctcttctacaggatttttctttatatttcagctgagctgtgtcattcagttacaagctagtgatttccagcttctctcttctttgcaaacatttctcatgggttcctgacccatatttccaagtgcctactagatatttctacctgaacatctcacagtaccataagcagcatttcaataaatgaactcctcatctccctcatgtacctgctgtggttaaatgccgtgattattcactcagctgcccaatctagaaattgggaagctttttcctagatattttctctgtctttccaacctcttacatccagtcagacatccacagattctaccaactaaatatctctatctccttttctgtatactgtggcactttctttaatttagattcccattctctctcgcctagagtattgccaaagctcttaacaaacctcttttcctttattcttgccttctccattctggtctagataggagcactataagtgactgaggagtattgtagaatgctaaattaaatctcttaatcaataatttttccccttattaagatatacctcagaccactctattgtatggggctgatgtgtccaagaaacacattggtaaagcagagtatatgaaactgcatctcctgtcttcgaaaatattttttcccttcacctaaatgacagctctagtttgtaggtcttccttaggcattctctccattatggggaaaaaattaactttctacagaaatttagtatgaatacattttaagtaacttggaaaccactgataggtgacaaactacaattatttttgttaagaaaaatgttgtcagaattatgattctgtttgagcacagattttatccctttcataattctacaccagcataagaagttaaggaagtctggactaactagtcttttgagaaaacaaacccaaatcttacttttaaaaatgaactctgtaatgataaactaaaggaaaagacataaaactatttttagaccaaagttattaaatcagtctagtttatccaaacattcaccttaattctgtgaacttggattcttttataaaaaatgtttctgagttagaagtttcttgagaaatactttttaaatccggcacttttaaagtatagatgttctcttttttattttctgttaattttgagaatattagatttatgtcattgcctatttatctctataaagcaatcagaacagagcatctttagtttctgggtgataataataattccagaagtaggaaaatacttcacactcacaagaggcaaatgcttttcaaattccagatacatggacacataaagagcttataacttccaacctgcagtttcagccacaagtcaaaactaaacaaagtcacaaaaatttaccagtcaagatctcaaaagagctggctttctttataatagatataaaatatgctcttaattgatttgaactctcaaatagacaagaatacaaaaaaactaattaattggattcgctgatcaccaaatgatcagaccataaaaccaaaactacattctcaatcattactgccgccagtggaaaattacctattagctgtgcggaaaccagaaacaaacaaaaaaatcagtagaaggagtaaattttaaaacctagaaaaaaaaagtcactggagttcaaattctgtttgctgcctagggtccaccctggaagctaagaaaagatgtacctgggcttaagtagcccatgagatatatttcttaagctacacagtcaatttgagttcatcaggttagtccacatggaactctcaaggggaccaccaaaactgttagcaaaggaaatttttggaaaacactgaaactagagattttcaccctgggaggccttttcataccacctcaggtcccgtcaatgacaatcattgccttagtgagccaccaccatggagggagcaggacacctcttgcaggtactttggggatgaggaaaaaggtcaggagtccttcctgagaaaatgttatcaactgggttgtttggagaattaaatgagagtatatatatgatagtattttgaaatacataaagtggtattcactgtttttttacctaatcaagttagtctgaagccagatttacaagacttcttcaagtgtgactccataagaatacttgttatgaacagcctaagttaacctcatctatccctaatcagctaaacactttctcaaatcataactcagaatttattcttaagtagatttattattccagcgaaatggaattcaaacttgaatctatgcaagggtatgccagaatattctgcacatttatcctacacatgcccttgtctatagcagtgctgcacaacagaaatataatgtaaactaccatgtgacttaaaatttctagtagccacatttataagtaaaaaaagaaacaggtaaaattaattttaataaatatatttgttaatctactatttccaaaatgttatcatttaaacatgtaaccaatataaaaatgtaaaataaggcattttacattttacatttttggagggagggtactgagtctttgaaattcagagtgtattttatatttacagtgcatctcaatttgaactagccacacttcaagtgctcaatagtgacatgtggctagtggctactgttttggacagatctataaaactgcttttttggagactcagcccaaatatcttatgtcacgtggttataaataaaagtatcagtctaatggtttactaagtatttatccttatggtccagggaattgtaatgtcctcactcccattccaaggagtttatgaaatagaaaatgcattaaaatttgggtcactaagaatttgttcacaaaaataaaatacacattaaaataagtgtctgtcctttaccttagaccttttagacctagtcattaaacttgttatttgtttcaatgtacttagtataacaacaataataattgcttaaaaatgctaattaactacatacttcattactttaaattaaaaatattattttaaacaaactaccagtgaaatcacttgtctacaatatgagaccctgaaaagactgttttcctgacagctgccattgggcaaatcatgaataaacttatagcagtgtttggagtttcttcagatattaatattaaaagacacattttacttggaatgtttttactttacaacttaccctagacatataacatgtatacagaagtaattaaatctttttccctggcttgctgaccactcagtaactcgttcaccttccaaattcagtatattcaaccctcctattcaaaactcattcgtcaaacatttcataatttccaaggaagtgatgtttagaatttgacactttctgtgtaaattatggcttgttttgaaagcttaccctaaagcctctttaaaccataatgtgtctttaaaagtatatatgtatagtagaaacatttttgcaagtgttgtaactaaaaccaaaagatagtgctactgaataaaatattgttgtttatcttgaatactgaggcattaaggacaatgcatatttactcagaggaagatgagaaatacttaaccaagagcctagtgcatggtaggtacataggttaattagtgaaaacttttggaagattctaaaagatacttcttggctcttggaagagaaataggagaaaataaacttctggaattagacaaaggccattagaaataatggttcctccatttgttagaatgtgaccttgaattttctcagatataaaaggggaataattacacctactctgaagggcgatagtagggattcagttaacttagataatacagagcctggcacagaaaaatgctttgtagctgttatttcccttccctttgtattttattatgcttccaatcacttcaaatatacatcttttctttgctatagttatgtcccaggcactacctattacccataaacgagatttgttttggcttttaaatggaatgaagagaaggaaaagaagaacagaacagaactacaagaagcgaaggatgtaaaagattattatgagatgactaagcgaaaatcgtgtaagacagaagaatgaagaagttgagtaaagagaagaggcaacagggaaacggcattagatgcccacgatggaattagttgatctgtaatcatccaaaagcaagaaaggctgttagtgtcttcagaggggactaaggggtatgatagaatacagaaggacaggtactttccagtgcaggcaaggtgagttttccatcactgaaaaagggttggaagatatgaaatgatgttggagtggatgtaattaggagaagaaagtctgccattggccatttatattgcaggacctaacctgaactttgtaaagactaacgagttccagaattgtaattcctgaaattaccgtttaatatgtattcatttatacatcttatctcccatgcctaaaacttttctaatataatggtgaaatgtccaatctgttgatgtacacatggaaaatggcccaattgacaggtagtaggcaaataaatataaaagttttttaaggttaatatagcacctaatcctctatgttagtcagacatgagtcaaatgaaaaagaaaggctctgcattgtggcttgaaggtaaaagggaaacacatggaaaaagcaatctccacagtaatcagagcttgaaagatcaatacttacttataaacaaataggttatcaatttctattagtactctaccactgtagcaactggaggccttcaggtataatgagaatatatgtcagtaatgtaatatgtgaccttaagacagttgttaatcagatctttttaaaagctatttaaaacactgaaatgtggaattcaatattctctgcttttaggtgccaccagattcattcataactttgttaccggaaataaatataattctttaatttcagatttcttttcactaagcccatctgtgctattcttggcatgtctttgttaagagttgaaaactagacaggattttgtaatttaggttgaggtggagatcagcttttagcggctgatgataagaagtacggctttgcatgtataaatgggttttcactcacatctgtttaataggttaaaaaacctagagacaagcctgatccctctaaattaatctctgcccactacctacagtgaaaattaaatgccttacatcagcatcctgcaataataaagtgggttctgaagataaaactttttggtcaaacctactagtagttaagaactgaaaagaaaacccgtatcttactctcacccaccatactcccatctcccaacaataccttgtatgtttaggtgtatttaacacacatttgttaaacattgttagccatgtgctgtgcttggggctggggatagagagataaataaggccttaggaactggcagtctggtgggaagtccaacagtgaatacttggtacagtgcgtaaagctggtagtcattttcataactctgtgccaggtaagatacatcaagctttctctatgttatttcatttaatcttatttaatcccataattcccccaaggtattgtcattcccagtttacatagatgaaggaatggagacagttgcttgacacagttacttaaggttaagtaagcttgcccaagatagagaaatagttccaccaagattcaaacttaaatctgtcatattgcattcagtttaccattgctgcatctacaatttttatatccccattttatttaatataatttagtgacagatatgttattttcactaccttatttttaatagtgaattaaacatctaaaaagcaaataaattagtgaaagacatgtcatataatttttttctaacttaatttcactaacatttatttatttctcatatcacttaaaatcctaaacagcaatatggacttcttggatgcatatctgattttcaggtgaatcaatactgtcccccttacttgtatattgttttttcattgttgatcttatctctttcatcacccttttctctcatccaacactgaacatgaaatagtggcaacatattacaagtttacaaaattgatgacatctggccatactaaatttcagggagatattgaggaagatcagtatttgttgcttttactccaacagccagcccttaaggttagtggcaagaaagggagtttaagggggcaaagtatgtcccctttgtacatacatacaaaggaattgtaaagcatacaaaggaatgaacagagattacatattaaagaaagaggactaaaatattttggaaaatgtcatgtaggtttcttagcattattgaacctgggaatgacatgtcattcatcctagacttgagagagaagaattgaagcagggaaagggaaatatgtatctatctttgctataattgtagttaagaaatccttagcagaaatgaatgttatttaatccttttaaacttggaagcaaatttaatgacatcaaaaacataagaacaacctaagaactcccagtgtgagaactcccaacttaagaattacaggtaaagcattaaaattaaatgcattaggacattgcaataaagttattcctaggttttctgctataggaacatgtactggatggcagacactatgttatccaaagacaatagtcacagaatgcaaaaaggtctagttcatctactgtcatttgtacttactttattcttcgttcaacagattatatattgagcaacttctatgtaccaggagttgttctaagtgttggagataaaacaatgaataaggtagatacggaacctactcatagtggggaatatagacagattaacaatcaattaaaaccagtgtgataaatgtttcagtgctgtttgaggaaacacagattgctatttgagcatactggagagccgtggtagcgcaaggaaagtttttcaggagaaaatgacatcatggctgagtcttaaaggataaaaagaacttagtcaggtcagaatagtgaaataaatgggtaagtttatacccggcctagggaacatcacagacaaaggacaagaggtgagagtagtgtggcaagattttagagtgtgaagaggggaatggtgagagataagagttaagcaggttgcagatcattcagcctcttgtaaaacaaattaggtagtttagactctctcctaatcactcccaagagctattgaaggtttttaagcagggatttgcattttaaaaacattatcagaccataaggtagtactaatactttcgtagtctttcacaggtaatctaagatggacattctctacctaattccacactgcagtgatcagtatcagagtgatttttgtgatcagtatcagagtgatttttgtgatcagtatcagagtgatttttcttattgcaatgttagtgtatatatagccttaattattcgaaagaaaaatccaacttatgaattgtcattaatgcaaaattatttatcagaaaatcgtagagcactggaaccccatcatttcacagatgagaagaccagaagcaaaatgacctgccagagttgcagactgacaactgctgccttggcctagtcaagcccagacaggcatctcctactgccttaatttgggggcatctttctaggaccctgatctgcctccacatcttgaaggattttcaagatagccatgtttcacaaaggaacgagggcagctgtgtttaaagtggtcaaatttctgattctgtttttttgcttaggaacctttcacaaccttcttcctcaatgcaaatgatggaaaatttgatcatccagatcgaaccttctcatccgttgcaaggtcttggagaactagtcagagagatacttctgatgtaaaggtaggctcttttatttgttgatattcattaaatttcaaaatatgtggaaattttgatttttttaagtgggtatgtataagacattttatattgcagctttgttccatcatattaaaattatatggtacatctaaccttataggaaataattttgaacattatagaaaataactgaaaattctttcatattacccagtgaaggtgttttcgttatttcaaaaaattcctacctaatttagatcaaataatcaggagatgtgaaaagcctataaaatgcctttcctgctgttaactcaatatttggtccattccataaaacacagcaggaattggatttgaccttaatgtgtcatattgttatagcttgcctggcttggggtttgcgtagcctggggcaattaataaagcattaatgacaagacccatttaaaatgtaggcttttccgtatagccttagcttttacttgactgtgcctggggatactatgcaacaatacacattagattaaaccaacacacacacaatatccagaaacagccagagagcagagtaattttacagttggtactgcttaactattgttaaatacaaggatttgttattcatttatatgggctcctattttaaaaaagaaaaacattgtattcaaagcaataatatatatttgttctctcatttgtctcattttttttcctgataataaggttacatggccaggttattgcataggtaaatgtgtttcttattttaagctcattttcttcaaggcacatttttttcccattactgtcactcagtacaaaaatgttacggtatcattccatttagagccttaaaccaacaaaagttagtgagttaaaatcaaaattgtcattcacatatttatgcttctctattgcaaaacatttgtaaaaggcaatttcagtgttactgaactgtaattggatgaatacaagttttgttcagtatttttccaaagcagaaaataaaggaaatggagccaagtagattgtaacatatctgtgtgttttacttgttgttgtcaaactttacataaatgaatatttattcatacaacatatttacatttgtaaaaaaaataagagaatttaatatgcatccttactatattaagctttgaagttctaacggtcttacaactttgctgagacttaaactctaaaatatccataagccatcatttaaaatgatttgttaccagtgaagtcaaggagggagtctgtttcttatataataacactttgagaattaatacagaaaatgggagtccataggctcccattgaacagtagtatccagaattcacacaatgttcataaaaggcactcaaatattttgtatgtgaattaaatattcttatctgtaattgaaggcttcttatcgcagttaagattattgatattttaaatcagagctatatccatattatatcagcctatttcaaatgaaaatgcctgctcactgttgtttgacatcatcacacacacacacacacacacacacacacacacacacacacacaaattggcttttcaacttaattcagagatccaccctcacatatttgggggtcagtcattctaatttttatatacagttttagatttcacttcctagcctgagaatttcactgatgctttataccaccagtctctgataaccgatgccctgtaccgggctttttcctctaaattctcccaggaattttcctcttcaaaaccctttcagaaacatttacattttattactaattgtatttggggggctcctgggttcacatcatccaggacaaagaccaatgtggatatcactaacttgggagtttttttgttttttatcctcaagcagctgtactgaacacaaacatgcagctttttttttccccaaagacttaattagttcataagaagctcatttccccaggatgacattacacagattgctctcattttcagctctcttaccaccactcatgaacctttcatattatatgttaatacatcttagatatcttgccatgtagacttcccctttctttttaaaggcagcatgctacatatatacaataatttatatatgtgatctctggttgatggagaatctttctccctgattgttactatgaagcacaaggctgtagtgaacatctttgcacagacatcctgatggactccttctatatacataaaggctaattcttattaatgggactgatggctcaaagacaatatactttttttattttttaagatattgccaaaccatcatcctcaaagatgaaaattcactctctacagcagtgtgcaagggtacctccttccccgtgccccctacacccatcatcactattgtattaaacaatggaacttctgctagtctggcaagtgaaaaattaagttatgtttgttttagtttgcatttttttttgagtgacgtggaacatttttcatgtacttattgacctgtacactgactcctatctattgctcatttttcagttgggtcacatgtctttttcttactgatttgaaaaagatctttgaagttgcagaaggttccattgcaagtagggtttcttggtcgtcttagctttgttatggttcgtttaatgtgtgtgtgcgtgtgcgtgtgtgtgcatgtgtgtgtgtatgtgtgtgtgtgtccagtcaaatatatttatattcccctctatagcatcagaatttggggtcctcatgaccagagtgttaaagagaagataagacttttgggtaataactagtgctaacttgagaatcttctgaattcatgattaaacctgatttatcagagaaaaatatgttgctacgagtagtaattgttttgctacttgtgtgttaaaacctaaagtttttattcttatttctaagctgttaaagcacagcatgatatattttttaaggaagtgtgtttccatttccagagaagaaaagtatctctgcaatgtctactaacttagtcagttaatcacataggagagaactaggatgcagtagatggttttattctgtctgtctctattaatgtcagtctcttcctgtgctaatgaacgcaagctgggaagaaggagtgctgctgaagtgacctttcaggagagaggtctctggagttgagtcagactagttagtttttactttattattattttttaaatttctttccctctagcctagtcttggtaacaatgacattcaactcactgaagttcttacactaattttccttaatgccttcaaaagttgttatattacttttagaatagctatgtagatgtcagaaaaggtagctgtgacaaaatgtcattaaggtgacatagtgtaaattaatacagttaatggaggtgctcgccactgactcattgacccattatgagctcttgtggaattaatgaatgccagggcatcagtcttttgaaaaaaaaaaagaaagaaaagagatggcagctttaaaaccttgcaatgaattatattagaaaagtgaaaacgtctggatcggatttgatttcactaggaagccataaaatggtacgctctctcagcaaaatatattaaactgaaatgtcagatttgatgcaataggtatacaattatgatagtgttaatagtggtcttctatcattctaagacatactttcaggtccaatttctcagcagcttgaacttgtcataagcttataaattaggaatcgcatttgaggatatgttcttattttttgacagaatgtatataatactattaactataccgtggggttttagtgtagctgctaaaataaactagaaatcacatttatagacacaaaatgtctgctataatgttcattttgccatttctttaataatatttggtgttttcctgcactgtttttcatttaggaaattttaaactacttagactttttccttaaagagaagctgattaacagaaatttatcaatgggaagagagtcagcagaacagcagttatcttaagcatgcaatctagtgtctaatgtgcctctgtaggagtacacttacacattataaaaataagcccatcctttaaaataatactgaatagttttcaaacatgtttttgttggttgatacagtccttgaaacaatcctatgaggtagtagtcattaaccctattttgtaaaggaggttcatgaatattaagtgactcacctaagttcacacgcaggcaggtaaagaggaagccagtactagcacagagtctgtccagttatttaagatgcttcatatccaagaggattttaagaatgggagctgcaaggccacttcatgcctaggcccggaagtcacatcatgttacttccacagcgttgtattgctcaaagcaagtcatggggccctcccagaataaggaagagtagacacggactccacttcctgatgagatgagttgcaaagtcacatttcaagaggtcactgagggtggagggattactgtgcccaccttcggagacagtctaccacagtcctccgaatctggtcaaaattcacattcctcttacatgtaaaatatactcaacttgttccccacaagtcccatcccagtatttgtatcagactgaaaatctggtatcttgttgtctacataagccccaggtacagataaggcacagcaattcctaatttggagacctgggagctagaaagacaaattatctgtcccatgtacacacaacatgtggtggtaagacagaacagttaaacttcggtagaaactccattcagaagggggagaatgtggaaggtacatagcagtcaatgttcatagcagttctgaaacgcagccaggaataagttgtcgattacccagactgcagggacagggactgtccatggattagggcccaggtctgttatctgggcttggctccttaattcattattttccatggctcttggttacttcctctgggacattggctttgccctctgaatcgttcttttgtttccagaagaaataaacatggtttgcagctgagtatctttctctgcatgcttcctgaccatagaaagttagggccaaagcctcatattcccaagttggtacagcagctttaaaactgtgtagcctttctgtgtatcaaattagaaaaagctaatactcacaaatccttttggaacaggattctctctttcaagctgtgaattaggatactgtttataatgccctaagaatccctttctcgtgaatcactctgtgtagctgagcaagtctgaaaaacactacctgaaattttaacttttataaaagggttttacagacacacccttgattttagctttattctgtggccatattttacttgtagcaccttcgaattgatctccatcctgaacctatgtcttattttgagaatcttttgccaactgaagagagtgttctaggcccttctattgcttgaaatactgcttcaaaactgaacagtttcttcctgagttcatctctctcttgcatagcttatctcttttgcatagcttacaccattagatgaaaccattggtcactttcagcattctgcctggaaatcttctaagtcagaagcacatgcttattaggtacttgttctgtctttgaaattattgcagaagacgatgttaattttccaccactacttaagagggactgcttccaataacaacttccttgctgatcttccagaccccaccaggctcctcaccacccctcccacttctgcctgctgcctcatcccaagccagaatcatgtgttaaattctttttattactttagcactccactttgaggattcagtttctgttttggtcatttatgactttgtaacaaatcaccccaaaacctataggcttaaaacaactatttattcatcgacaattatgcaatcagagttaaggctcaaaaaggacagctaacctctaagccacacagtgacagtggggcagcttgactgggcggcagaatctacagtggctttgctcacatgtcttgtgcctcatctgagatggctggaacagccaggaactgcctgggcatgtctgtctctatcacatgtttctatagcaagggagccactctattgcatgtggtaactggcttctaagaggactaaaacaaaagctgccaggcctcttaaactcttaggctgccctaagaagccttgcagtgtcaccttgtcacgttctgtgtgttgaaacaagccaggccatattcagacaagggggaaatagactccacctctttatgggaggagtaaactggagatgccaaagggcttgctcttgggatgggaggactgttatagccatctatgagaaaactctgtgagttaccaatttaaaaaatactttaagtactagtttggtttgtaccattctctacagtctgagtgtgcatttagacataaaccaaaatctcatgagcaagcaatttataaaatacatctgattagtttaggtaatatatgttagtccatatatatgtcaactttaaataaccatattcagaaaatatgattaagtgtaaagtttgtttgagctcaaagcttgagaatggtcaccccgtaacataggttcaagtagccctgaatatacactctgattagtagcaatcataaataggtttttaagaaaaaaagaagaggcaggtcctaagttgcttaccaagaatttacattaaaataagataagccattggctatacattgttctttgtatcaccgatttcaggaactgaagataatgggtaaggcagctggtcagaaaccaaatgcctttttaaacagttgctccccaggcttgggttgaggaggcagcatgagtgactgatgtcccacacgcacgtctctctggacctgatgaatttttgcatgcctcacataactcagactgctgtgagctattcttttcctcatatttgctaaaaatacttgcatcatctgaactgtctacatagctattcattgaaacacaatccacagtgacagaacttttttactgaattacaggatgcactttggtactgggtaaactctagtctcagaagtaatatttttgatccgtgcccctaaaaaaaattgagaccaaatagcttctagaatatattttatataaagttatgaaatgtattgttttataaacattatttcatttaatcctcacatctaccctaagagttcattgctgacatcaccaccatgttacatatcaataaactttttgtcaaaaggttaagaaacctgcccaagctagcaagaagtctggattggactcagacctgtttgattctgatgtatgtaaggtagcatttccctggtagaagaagggacaatcccaatgctgctgcctgcccagcttccccctttatcttcaactcactggtagccatgaggttcctcttctttaagaaacacactttgagccgcgtacggtggttcatgcctgtaatcacagcacttggaaaggcagaggtggacagatcactcgagatcaagagttcgacactagcctggccaacatggcaaaaccccagctgtactaaaaatacaaaaattagtcagccatcatggcgcacacctgtaatcccagctactcgggatgctgaggctcaagaatcgcttgaacctgggaggcagaggttgtagtgagccgagatggcaccattgcactccagcctgggtgacagagcaaaactgcatctcaacaacaaaaaaaaaaagaaacacactttgaaaaccagggcctgcaaagtttttaatcaacatttcaatgcctgaaatttaggatatggtaaacatagtaatcttgattcatttttaatttcacaaatatttatggattacatattatatgttagcaccattcttagcaagatagacaaggtccctaccttttgggatttctattatgatgggacatgcaagcatacaacaataaatagagaaaataatcattgctatgcagaaaattaaaacagagtaacgtcatatagaatgactagatggtggccggatgttgtggctcatgcctgtaatcccagccctttgggaggctgaggtaggcagatcacgaggtcaagagttcaagaccagcctggccaatatggtgaaaccccatctctactaaaaatacaaaaattagccaggtgtggtggcacacgcctgtagtcccagctacttgggaggctgaggcagaagaatcgcttgaacctgggaggtggaggttgcaatgagctgagatcatgccattggactccagcctgggtggcagagcaggactccatcgcaaaaaaaaaaaaaaagaaaaaaaaaaaaagaatgactggattgttactttaaaaggcagaatacagaatataggagcaggaaacctggatttaaagtatctgggtttgatttttggccttactaccaatttgcagtgcagccattagcaaattacccacccaatctttacctcagtgttcatgtctataaagcgggaataatgagaacacctacttcacaaactttttgtgaagattaagaaaatatatgtaaagcacttagaacagtgccaagacatagaaaggtaccaaaataaatgttacctgctggtttaaaacagaatgaccacaggtaacatttaagttgattcctggccttggagcacaaatgtagtaattgccatcttcttgcacataaccagttaaatctcagagatgaaacgctcatattctttggtttatatttttgaaacaacaaatcttttcaataatggaattgtgaatataaattatactaatgtcttgtgtttacatacactaactttaaataaaacttgctatttgaaacaagattgtaaaacaataaaactgagaccaaaaaaaaatctcacctctgctgcttcagctacttctccctagacttcttgtgatttcacttcctctactatccccttcacaaaactccaaactatccccaactctggacttcgggttcagagagctttagtcactgatagctctggtgtttgaaacctctaggggctctgcaaacaagctgtgcttcagaagtttctttctatctgtgtttaaaacatgtctgtttagtgattgtttccattatgagaaatctgggagagtttctttgtcccttcaaacatcaagcctctaacagcttacatctacatcttagttaatgccctaatttatgaccacatttgggtggcctgataagaatggagccaaaaaaaccatccttacttagaagggtgtcctgaaggccctggtaacacgacttctttctatgactagccccagttagggcctccttgaatgatcctactggagtattcttcctcctgcccttctaaagaaccatcaagacagatctttctaggccttccttgttctttggtggaggccagctgttagtgcccttctttctagagtgcctaaatgaaaatgaaattagtcttctgccacttttgcagtttgagaacaattctgatggcaactttaaaatcaactttttctatatttaaattgagctattttatacttttgagccttttaaatgtaacttgaataagcaagataacattttttaaacagaaaagtttccccttaaaaggcagatttcatttcagggtttatatccttttccttttctttaataaagttcttcattcactctttccccatcttgaggcatttttctgactatctgtgtattccccagatttctagtcttattaaaataacttcatccaatatctttaatagcttaatatttaatgagcacctgctgcgtgcaaagtatagcactgagagctacgaaggatccaacaaaacataaacctcacaaaataggctcaaaactttgcgtttgcccagattttattcatactaaaattgcattttcccaaattttattcacattaataaatatgacatcctatgtttcttgcgcctttgtgaatctaatttaatgactttcagtgaaattgcattgtagtggtaagtaggttaataatgaccacatattttatacaggaaagaatgggaaataatatatgaaaaacattatagagtgccaagatggtataagataaattaagactattttagttgtttaaataaaactaaatatattttgctatgtacatgtagatatatacgttcctctctgccctcaaggaagcttctgtagcctcgttatagagatagggcatgagcacaaataactgacgaaaggcagtaagggaaacacctgatttatgtgagtctagtacatataaatcacactcccaaccgagcagctgcacaagcttacgttccttcccactttggaccctttagggtgttattgctattgtgtcacatgaagaccaggtcatatgcaaatagcaatagtctttgccttctctgcgccttttactaattcctcatgttttcccaaagagtgagagtaagagcagaagaaactatatattttacattcatacattgaagtcataagataataatatgcatttctgattggatgccaatacatgagaacagcagtgattctttacttctactctcctgtcagcgatcaaaccaaactgctccttccgtgactgataaacactgtcatgtttgcccagcctggaaatcaaactcatgatagtcattgctgatagaatagtcactgctgaagtgccctttagcctgtcttatccttcaattaaactgtatgatttttggcaaatgaacatgtgttttctacagtatggtttttctttcagcctcttctccatttccccgttcatattggagtcattgaaaaattatattaatttgtattaattccactagaattctcttttcctttttcgttgtggccttgaggtcttgtacatagtttattgttgatacacatttggcccctagtgtgagccatctaattccctctctttagctctgttgtagatttcccctctttgataaagttccacaatagggcccctttctctccacacttagcagttgcccttctctctttctcctccctatacatgcatatacaccacatcttcccattctccaatctctcctttactttgtcacccagtgtcttgctataaaacaaatttgactgtgttaaaaactcttttttaaaatttctaaaccactaagacaaaatccaaacagcgtatccttcattaaacttttctcatccatctggcctcatatacctcccaccatctcatccctcccttgtcttgatctacccacaatataccctgttctcctcttgtgctcagtttctcaccattccatataactccctgagggtgcccggccccctcttctggttttcatcttagccatgctccaactccaatggcccatctccaatgaagtctctcctgacttgcccagaatcccctgctctttcctccctgctcccttcttcctcagctgctattgtgtattataaccatctggttctacatctgccccacaggccagactatgaattacttgacagtaaggccatgtcttgttcattttttgtttcctgagtacacatcacagtttctggtactaaaaacctttactgtatgcataagtaaatgtcagagaaatatgtaaaggattttagaaagatttctatttaaatagaagaaaactgagattcttaaaaagcaaagctccatttatccagaaaaatcatttatatggacctgttgatgcacccataatgctggagaaaatgaacatttatatttttcttatggctcacagtgatcatcataagagtaatggtcagtttcacacagagtgttactaaaatgaatgcccacttaaaacagatatatcagttttagtgggagaactcgtgaagagaaagattttatatatgctttttctagaaagttagggatccagtttatttgaagacctcagtatgtggtggttttaattttttctatgcatccctagaaaagactacagtgagatttaaatttcagatgctatgccatcaatgttgatcatattacacaaataaatgtgtagcctcacaaccctatcttgatatttgaaaaaagatgatcaggatggtacacataaaaactacagcagtttgttttaattttctcccaattactttttaaaaaacaacaaaaactttcagggtattaaaatcagttcatttctacatcagatttattctaaagtaacagaaacctcaaattagatgctgtacatcacacacaagttctccttgaatccagttgtttatgctacagttacatacaagtaacacaagttgtctttgcatccaatttattgagaacctgtcatttctatggcatgcattaaatatttaaaactgtttatcatattgtgtatcatctcttttattgtgttcagtgattgatataaaaataatttactttatcaagtaaaaaaaactatgaatctctttataaaaatcacatattgtaattgtcagtatagttaaaaacaaaagtagaaaatatgtgatctattacaaatactggcaattagtttttaatttggatagttcataaattttcagatgaagattttacacaacatagacttgtttatatagctttacatatttgttttctaatgctattgtgaactgttgttaatttgtatactcatttctcttcattaatttatgggaggataagattgaaaataggtaacattttaaagtagctatcataaacataaattttcaagtgaatttttcacaagaaatgcttcatctcagatctttaaataaaattaaatgaagaatagaatagaattaattcataaaatattggttttaagaaattattttattccatttatagttaataagttataagttaatagttttattcaactgatttttataaagtggtttaatatgcttcatttttattcctgataggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggtaagagagattttgcttttgcttgggcagtcatcagggagttaacatattctgtagttttgttttgtcctgttctttactataatattaccaattatacttaacatctataaatacaagcttaaaattttaaatgaaaaagaaaacattttactgttgtcttgacagcattccttattgtagagtggattttccgttcatgaggactaataaagcaatggtaattcagttatgtttgctcctttaggagaagacaatcagatgagcatctgttgactaatataatgtattctaaagtgcttaaaataaatgcctatttcttagttttatctactgactaaatctgaacgcttttttcacttataaaaacactcagaacagaaaaaaatttatttagaacatatttatatgtgcgatatttatgctgtgaaacataccttatggtgtaaacattctgaaatagaaaacatctttttttgttttgttttacagacagtgtttcactctgttgcccaggctggagtgaagtggtgcaatcatagcacactaaagcctcaaactcctgggctcaagtagtcctcccacctcagcctcttgagtagctggggttataggcaaatgccaccatgccaagttaatttttaaaaaagattttttttggtaagataggatctcactatgttgcacgcactgatcttgaactccggggatcaagaaatcctcctacctaggcctcccagaagaaaacatcattattttaagctatattacagatatctgggtgtttaaatgagaaatgtataaacagaatgttcacatatgggaatttgatgggttttaatacatttcacacatatttaaggagattttaatcccaacatggttatagtaggtgacaataaaccactttacaaaacagcctctctagtgtactcttgaattacatcaataaaaccaatgacgccaaatatatttttaaccctgtttcattcactcccaagtttttccaactgtctgataaatatattttattttgtttttacagcttatttatttgaatcagaattcaaataaggtccacacattgtgagggaattcacatattccttaatcctcttttcttaaagagcttaattgaaatataattcatatcctgtgcaaattgttcatcatttaaagtaaaaaaaaaatgaatattagtccattcacaaagttgtgcaaccatcaccacaatcaatttaagagcatttttatcacctcatagagaaccccataccttttagcatcttccccgatttttcctgatttccccattctccccagctagcccaaggcaaacacaaatctactttatatctccattgatttgactattctagacatttcatgtaaacagaatcataaaatatggggttctcctcccctcctctcgattttctgtcacttttcttttggactttactgtcagtcacacattttcttctattttggagctgtatgttctgtctctaagaaatattttacttttaacgtactttattttagaaagttgctgatgtaatatacctatgcttaaaagcatcatctagataatctgcaatgtgttctcccccctttttttttaagaaaatttcatgttttgcataagtcttattgccaatctctctcacttctcaatctgttaaattggcactttcagatatatgcagttatttcatactattcccttgaacaatagcttatttcttcaatttatatttttaatgtgaatgacttatatttcagtaatatatacttctgaaaatttctgattctttttagaattggtatttcatcaccacattattctcacatacttgaatgttatctgtaaatatcagtgtaaggataccagcgctacaaatggaaccctaaaggctcattgtatatcaatatctctcagtcacatcattccattgtagctccagagctcagagccctgcttggcacatactagttgttcaggaaatatttctgagtgaatgaatgaattaatgaattatagaggtgtagtaatctcatagctgttagcatatagtctattaagtccaaaccagtcaaactgaatgaatccttcactccggcaagcaaagtagccaatagttgttggaccaatgcttttgttgatcatgctattgaacagaattctcatatgggtgctgataataagtgcctcttacctgtcaggcattaagcaaggcacttgatttttttttaacatttattttacagataagaaatatgaaggccagacatgtttcataatttatccatggcagagcccagattcaagtacagaaaagttttaactcctaagttatactctttccagtatgccagctacctctgatattatctcttctttgtgaaattctttgagattattcgatctctacttttaggtttataattgtcaatccagaccttatttatttcctttaacttcgtggacatggttaatgcagatcattcacagataaagactgcaagtatactaagcttaaatatgcattaaagaaaaatagagtggttatctttattatccactggacatttcacatttattaatttgctaatgtttactgataatgtaccaggaaatgtatatgacattttttagacttctaaacatgcagtaatgcagactggatgagcaggaggccactgttgtttcccagtcccaggactaggccacatttcctgctagaagagtactattttcagtggtacccattccattcagtgtacagataactttaggaaagggatttgccttcttaataaaagactgaaagtttgagaagaaagttttaggatgagcgaagatttactatgatacagggaaaggacgtatgttttttaaaaattggggaagtgggctctcatgtaaatgatctaaaccatcttgtcttaagtttctagtagaggcctaaattaacaaaattgtgttgtgaaaagcatagggcatttggcgttagcatttttgaaagcagttatgtaagatcagtttctcattatagttatttaagcagagacttttttgtattgaaaagaagccattggagagagagtatgatgtctcctttcagtttttgcagcagctcccttatcttgcgttaccaatagcaaatttcagtgagaacaggagtaactaagtatttaaactagtacttaattataatacaggtaaatacttctccagatagagaaagcctgcgcagaatgctgtttggaaataggaacacagctagtcagtggtcttggtgagaagctgcctgctctgtaaatgagccgaagtcataacaaagataggtggaagtaaaggtcctcagtgatatctcttcttaggagtacgtctgcactgatgcttccaaatgcagacataggaaacagtggactaagtgattggtcaaatgcctccagattcgtccactgaaaaataatttgtttgctatagaaattggtccccacagtttttcctcctttttgtcttcctctctgctcatagctcacgctgtcttcttagctgttctgctgtgtttattgctttacctgattaatagacatggcaaaacaggctttaaagataaattggtgaaaccttgtccctacaaaaaatacaaaacttagtcaggtgtggtgacacagtgtctgtgattccagctactcaggaggctgaggtgggaggatcgtttgagcctaggaggtcgaagctgcaatgagccgagattgcgctactgcactccagccgagatcgcgccactgcactccaccagagcaagaccctctctcaaaaaaataaaataaaataaagataaattggcattcaacaaatggtgctggaaaaattggtgctagaagagttggatatctatatccaaaaaaaaggaaggggaaggtttcagtccttacatcacaccatataaaaaaattaactcaaaatagatcatggacctaagtttgaaacctgaaactatcaaacatctaaaagaaacatataggaggaaatctttgtgactttatgttagcaaagatgttttagatatgacaacaaaagcacaacctataaaagaaaacattgatacactggactttattaaaacttagcttgtttgaacactactgtaagaaaattaaaagacaagccacaggctgagaaaaaatatttcaaaacacatctaataaaggactaggatctaaaatatataaagagcactcaaaaatcaataaaaataaaacaatatttagataattaatttttttaaaggaggggcaaaagaatcttcagcgaagaagatatgtagatggcaaataaacacatgaaaagatgcctcatatcaaaaattaatccacaaattaaaattaatcaaattgaaaccacagtaagctaccattacacattagaatgactttaaaaattaaaagggggaaaaaaaaaaaaacctctgacatcccaagccctggtagagatgcacaatagctgaaattcacatatcctgctggtacaaaacagtttggttgtttcttataaacacacaccaaccatataacccagcaaccctgcttcttggttttagccccccaaaaatgaaaacttatacaagtacatcaatgtttataatggctttatttgctttcatcaaaagctggaaactacccaaatatttctcacctggtaaagggataaacaaactaaaataaactatagtaactccatattatgaagtactagttagccataaaaaagaaccaagcactgatacatgtaacaaaatcactttcttgctgtcacttggatgatgccaaaacatttttaacggctttattaaaatataagttatatatcataaaattcacttgttttcagtgtacaatttaatgatttttagtaaattttaacagttatatgaccatcaccacagtctaatcttagaatattttcaccaccccagaaagattccctgcccacctccagcccaaggcaactgctaatcaactttttatctccaaaggtttgccttttctgtgtatttcatataaaaggaattatacaatatgtggtctttgagtttgacttctttgagtagtttttgagattcacccatgttgtagtatgtattggtactttgcccaactttttacataatactaccacattgtgtggaatatcacattttgttcacccattcatcagttgatgaacatttgatttgtttctactttttggcaattttgagtaatgctgctatgaacagtcatatacaaatttctatgtgaacatacatttttatttatttggggtatagacctaggagtagaattgctgggtcatatggtaaatttatgtttaacttcttaagaaactgcccagctgtttctcaaaatgaccttgcattccccagcaatgtatgacagttccagttcctccatagcctcactcccacttgttattacctgttttttttttttattacagccattctagtgaatgtgaggtaatatctcattacaatatttttttttcttttttttttgagacagagtctcgctctgtcgcccaggctggagtgcagtggcaccatctcggctcactacaagctctgcctcctgggttcacgccattctcctgccacagcctcctgagtagctgggactacaggcgctcgccaccacgcccggctaattttttgtatttttagtagagatggggtttcaccgtgttagccagagtggtctcgatctcctgacctcatgatctgcccacgttgacctcccaaagtgctgggattacaggcgtgagccacggcgcctggcctacaattttaatatatattccctagtgactaatgatattgagcatctcttcatgtatttattgaatgctaaaacatttttagatttattttaataaaacatttagtgattcattatagacacagaatttgtgttcttcatagtcaaagaagtttgtatgcccccagaattaataattttattactgatgtgcctaaatgaaatagaaaagccagtcttgcttttaaagacaaatcccctagacagtgttataccccaaattttttgaatgtaggaaaagctaataattattgttgatgagaaacctttaaataattaatgttggtataagctaaacaagcaagacctacctatatctgcagaaaatgctacattcaactagtgtgttgggtggtaatgcaatccaactaaataaactttccagataaatgaattttctagattttcctaagtgagaactttttagaagcattatggttatctgttaagttttattttatttttaattgacaattaataattgtttatatttatggggtatactgtgatcttttgatatatgtatacaagtcagaatagttagcatatccatcacctcaaatatttatcattgctttgtggtaagaacatttaaaatatattttaaaaatatatatatttacatatatatataaataattaactacagtcactttgctgtgcaatagaacaccagagtttattcctcctaactgtaactgcaccattgaccaacatttcccctttccctatccatatctcccatcagcctctggtaaccaccattctactcactacttctatgagtttgacttttttagattccatacataagtgagatcatacattatttgtatctctgtgcctggcctattttatttaacataatatcctccaggttcatccatgttgccacaaatgacagaatttcctgttatttcttaaagctgaatatcatttcattgtttatatataccatatttttaaaatccattcattcgttggtagacacttaggttgcttccatatcctggctattatgaataatgctgcagggaacatgagaatgcaaatatccctttagcatactgatttcagttactttgggtaaatacctagtgggatggctggattatatggtaattctatttttagttgtttttgtttgtttgtttgtttgtttgtttgttttgagacagtgtctcactcttgcccagactgaagtgcagtggtgcaatcagtgaccactgcagccttgaactcccgggctcaagtgatcctcccacctcagcctcccaagtagctgggagcacaggtgcatgccaccacacccagctaatttttaaatttgttatagagatggaagagtcttgaactcttgggctcaagtaatcctcccacctcagcctcccaaaatgctgggattacaggcatgagccaccaagccaggcctatttttagttttttgaggaatctccaaattgttttccaaaatggctttactaatttatgccactactaacagcgtagttgttccccttttctccacatctttgccaacacttatctttcatcttttttataatagccaatctaacaggtataaggttatatctcactgtggctttaacttgcatttttctgatgattagagatgttgaacattttctcatatgtccattggccatttgtatgtcttcttttgagaaatatttatttaaattctttgcccatttttaataggattatttgtttccttgttgagtagtttcggttccttgtattatggttatctttctaaaatttattactactttgttccctgcccttttatacaaggaatgatacttcattttttacttaaaaaagtcaagtttatcatcctgagtacccattgttattccatgaagtgatataattccatatctattattttctactttcttcttcaggttgtcagctatcagtacagttccctttaatagccctcagccataccaatgaaaattggttgtttacaatctcttctagactacaaaaccagataattcattgtatcaagcccttattataaggcttaagaatcagtcaagtgctcagtgaggccgtagaggaaatgtgaattttgtagctctgatagggagtgactttagcctctacctcaagtttcactggccactgctgatttggaagttgtgtatcaacagatgaagtgacaaaaccatccttagtaaattaatgtaactacaggcagcaccaggttaacacttcttcttacatgcaaacagctatctggctggcctaaggcattcttctcccctagtatagctgcttgcatttgtttctcctctttcctcattccaagacttaactgctgacaactgctgcaaatcagaatggataccctaatcttagccaccttaccccataccctagtgatagtcctgagtcatcctgatatgaaggttgaccaggatatcataatggcaatgatagtgcttgtaggacatgccatttgagtgtgtattctgtgccagatactgtgctagaacttcaggtgcatcattgttttaatccttaaaaaatcactttcagaggccaaggcagatcgatcgcttgagaccaggagttcaaggaccagcctgggcaacatgttgaaaccccatctctactaaaaatacaaaaaaaaaaaaaacaaaaaaaaattaacaaggcatggtggtacatagtcccagttactcgggaggctgagtgagagaatcacttgagcccaggtggacagtgaggcaacatcacaccattgcactccagcctaggtgacagaataagaccctgtctcaaaaaaaaaaaaaaaaaaaattagctgaggagttattgacctgaaacccattgaggtaaaaatatattttttttgagacagagtcttactctgttgccctggctggagtgcagtggcacgatctcagctcactgcaacctccgcctcctgggttcaagtgattctcctgcctcacccttccgagtagctgggattataggcatgcaccaccacgcccggctaattttttgtatttttaatagagacagggtctcaccatgttggccagcctggtcttgaactcctgacctcaggtgatccgcctgcctcagcctccaaaagtgctgggattacaggcctgagccaccatgctcggccccattgaggtaaatttacatgccaaataccaccaccttatcaaggtgtcagtgttcttattcacagtctccaggataggtaagtggtggtggcaggcaagaggagccgtggaggagaggagaaaggagaagagaaggaaatccgaagccagctccgtagggtgagcagaagatgggaagagatgagaattcagcatggtccagccccagcagcttttagggcctgactgtctatggtccctgtttctatatcttttaccctccacccttacccgtaaggcttcctttcactgccaggaaaccctgaacttacagctgaggaagtgccagctctctctgcccatctggtatgagaggaagtgtgtcctccttcaattctacaaatggaagaaatgatattcatttacattctaagctttgtagtcatgggattttagaactggaatacacctttatttgaatgaggagtctgaggcctaggaaggcaaagtggttcatggaaactctgaacccaagtgcttttctaactaaccatgcttggtgtcacaagttggaactctgaatgtagtgtccccttgttccgtcttaaagtctgtaaaattccacctgtattttgaattaaatttaatttatagattgacctgcgaacaaaaccatagtagaataatactgtttctactgcaatatatattccaatcaccaaattataaagaaactttggaatatcctgtttgttatttgcaaactgtctgtatctgtgcttagatggcctccaaacacctaattgtgacccagacttaaaattcagttttcctcagtgacactctggtctgtctcagtacacatgtgatcaatacacaggttttcttttaaaaagtctctttaaaaaacctgattctcaccagatggtttcatgacatttgggttttagagaattaacagattattcattgaaaggaatagcctgaaaaattgtataatactataaagacaatttaaactctgaagtaggttttccctcttactgtaagagagaataaaacacatgaatacaaattctgagtaacaatttttaaaatttataattgctcagagtacttatattgcacataaattaaatataacaaataatttactcctgatactaatatgaccagtttaagaactgacttctgtttatatatacttcttacctgttataacttgtctttttaacatctaaagtgctgataagcagactttattcaaagtgtgcttctttaaaataagcctcacggtgtagcatccctgtaaatacatattaatccagccagctgtgtgcaatgcactaggaactgtaaggattcatatgtaattcagtgaagccactgttcctcaaatatttactctcgcagattcagaagaattaagttttacaactaatatatgaaggatacatattgtgcatctctggaaatataaaacattctcagaaatgaatagtccattttaattgtaagtagtaagttccaacttgtgttcatgaaggaatgaaagaagcaaggcactgcagtttccctatgttctaaaccaaattcctgttatttcatcataggaattaatggatctggtaagacttgtgaactgaaactttattctatggagcgaaaggctttatacaaaattctgcatattcaggataattaaactgccccagtctgtgttctctgcatcacctggaagcagtgccgggtgaaatggatcacgtgtaggagtgcctcacttgaaaagtgcttattgtttctgtgttgtgcttctgggttttccttgaaggaagcctacagaatagaaagggaaagctaccttgtgtatcaacaaaaagctgtatccataacagctatagcagccattcttagttgcttcagaattagagctaaaggaaaagcccacactgctgcctctgagaactgtcttaagcatcaacgctacgcaaagacatctcgtgaaatgtggctgcgtgattctgcagctgctcgtctctcagtgtctcctgtgctgcttcaacttgaagttttccttcatagcacctttttcatagtttctgttgctccaactcctggtcggttttctcatcctactactaggaaatgatcatactgatctcttgcagaaataatgtcagatatctgtgttaaaactaaaaagtttaaccagttatctacatatgttcatacttgctgaaggaatgtttatttggtgagtatttatgtaatatacaaagtctaggcactcatataaaatatcaagtatttaaattttccataaattccttgaatataggctgtattttttatgttgttttgtaactttaaaagtttctaactttatattggctgggtaattcatacaggatttagttcttatgaaatagctttagagaaaatgtgctctagtatatttataattttgactaggattatcttcagttatttgaaagagttctttgtaatgagcctaaagtataaaatgaaaatgtcatatattccaaagagatgacattcacagtggtaaaaaacctccatttctttgtatggattagtattctgtacctatgagtattccctccttctttcaaactgtcattaagaaattcaaggcaaagatgacaaaatattataaaaagtgatatcattgatgattaaatgcccagctttattactgcatgccagcaattgaacagcaggtatttgatgcatttgtagcagactttacatgtctacaacctaatttcattttttatttttttaaaaaatgaagcagtactttgttgtttaagttatggacaataacatgtatgtaattggttagaattgtttgttttgtaaatacagtgccaagagttatgtttcactgaagagctgtgaaatacaaagtttactctcactagaaaacctggaaaagcgatacagacacatttagtagacatttcaatgcattctaaggtcattaagtttatacgtcaagaattggtttaatttatccacatgaagctaggcttattagactgacttactcatgaaacattaataaagcattgtgtttagttctaacctgattataatctgaccttctgacaaaggacagaaatagaaagtatctgataacattaccctaatgctgggttcatccatcataatctacccttttaaaaatttgttttagaaaaaggccctttcacggatgtgcattgataatctcatctcgccctcagcccagcagattcctggtgctgctgggccaagtacaggctgtctgcagtcagcagagcatgcacagcaactgaggcaggggaagccaagctccagtgtggctctgctcatattgtattataacctttacagaatgtccgtatttcaaagaaaatgtttcctttttaagctgggttttttttttaagtagattataccccaaatgcaaatgtaaaaatttgcatttggggtataatctacttttaaaaaccccagcttaaaaaagaattttaagcaaataacataagaatttttggaagtcttatgtaggaattcaaaatatcaagatagacatcttgtgtttgagtgccatctctggaacacctgttagccatgtgttgtgctgaacccctattaacttcaacagggatggcaccaggttctagaggccaaagaagagacccagagccagtgagcatgacatagagttttactggggacttacctatcggggaaagtccagtggtagcaggctggacaggagacccatatggctcagtggcagcagactggacagcagaactgcaaccgcttgcaaaaaacctgctgtttatatcacatttttatttaacactcccccacccaaccacaacatcctgtatctggcaaccttcatttaacccaaaacaaagggccttgattcccattatggcctgagttccaagagatgggccagagggggctcagatattcttcacagataaggaatggatctccaggttggccaccccaattccctagcttgagactctcaactgcattcaggtgtgtctgccatacagggtctttctcaaggtttgttcaagtcatcactgtcaggtgcagcttaccgcacaccatgacacttggaagtaagacaccctatctcttggaactgcagtgtcctccttatttctcaaattgaggacttgttcattccataagtctttactgagagctagttatgagcaaagcattatggaaaatacaaagaatggccatggatcctactctaagtgaagttagagtagagaaattccttcgttcattccgtaattatgaaggggctatcatgcacttcatcctgctctgggctctgggaacacaaggatgagcaactcagtgagtggcttcagaaggtgcactctagttagggacacagacaaataaacaaacagtcccagtaaacactgatagtgtttattcaacagatacctgttgagtgttccgggtgatgttttatgtgtttgcaaggatccctgccgtcctggagctcacttttgatcaaagggagacaggcgatagacaattttttaaaagtgaaatatctagtatcttagaaggtgaccggtggtagaaaataccactgcaagaaaaggagactgtgagtacctgcaggggagagaggtcaggacagcctccctatgaagggagattagaggtaggcctggaggagcagagggagggagccaagtgactctattggggaaagagcatggtgggcaaagggaacattagagcaaaggccttatggcagggatgtggttggcaaggaggccagtgggccaggaaagggtgggcaagtgggcacacagtaggacaagaggactgagtagtagtgggggagcatcacacagggtcttgaaggccatcataagtactttcctttttaccctgagtaaaatgtaaagtccttgcaatcttttgagtggaagtgtgactgatcttccttatgttttgaagggatcactctggctgcagtgttgggaatgaatgattctgcaagggtagaatcagggagatctgctagaaggtaatttgagagatgatggtggcttggaccaggggtagcagtaaaagtagtaagaaattattgattctgggtgtattttaaaatttgagcctatagtctccctgggacttcctaccagtggccattttccctcaggtatctctagtcttacagaggcaggtgaagggctggggatgagcatgcggagtagtgatggctacagcagcagagatagataaatccatcttagcagaacattttagagagttcagctaaaatgaaagcgtgggtgtttagtgcctgttgtcaacttggccctttagcagaaattctaagcagcggaaaaagccagagtcaacatgtttatcctccgctagactgtaatctttttcaggacatcgaatgcttattcatctatgtgtcctctaaggctaatgtctgacatatggttggtggtcagtaatctggggcaggagagagattagactatattcaccttgtttatttgcatttcagtgggatctgctcccaaagatcagaggttttgtcttgtttgtcacagcatcccagggcctagaacactgcctggcacataacaggtgctccatgttgaatgaatgaatgctccctctgtttgaaatgcccttctcccagatgtctttatagttcatttcttcactggggtccttaattgtcacaaactcagagaagccttccctgacctcctcccctaaactagcaatcctcccccactacacatacaccctactccccatcctgcttttctgtttccttcgcacttgtcacctgctgacacaccctgtatcttactaattatgttagtttttgttggtctcctcccagtacaatgtaaactctcttgcagggactttgggtttttttgttcactgctataatcttacaatctagaagagggtctgtcacaaagcagatggccaatcaatatttgctgagtgaatgaatgagcttcttccccagccccgccctcattactgacatttcctttattccttcctcttgtgatcatcacatcttttccactgctttaattaataaacctataaatatttattaaacagttattatccaatgataggttaagagttgtgggaaatgcaagataagaattagataaagtccctatcttcaaaaggcttacattctaattgaggatatagtattaactttggaaacaatgaagtgctaattggcaatcatcccattcatttgtacagtacctcacagtttgttgtaaaatgatttcacaagtaaatttgcatgtgttatcttactctattaagtaacaagaggatactgatgaaaagtgttgggtagaaattcatagaaaaaaacaagtgagagctgagaacacaggaagcaaacactgaacttgagtaagaaggatgagtaggtcttcaaaaagcaggaagacaatgctttcaagctagagagaaagaaagcaaaagctctgaggtcataccagctgctgtgtgcccaagggctgtgaagtgtctgtgctggggaagctaaggatttatatcaggaagtcctgagaaacagtggggaaaggtgggatggaggtttgaaaggcctgagtcacataggttatgctgggaggagcagtggcagctttgaaaaagagaatggcaatgtggacatgatggcttgacaagtctgtcccacaagcaggacaccagacagactggattcagaagaagtttgaagtatgttgtagtaacccatgtggagagctgtgagggttagaaataatcttctgtcttatacatccagaaacagtcaagtactggaataatttaagccccttaaaataaacatcaaagacaactatattgtctctacttaaaacagttgaattattgaagttgtaatagctacaacttcagtcaaattatgaaaagaagatggcatagacactacagaagtgacaatatggctttctgattatctacttgaatatatgcaactctatttagagaattttttaatctcaaaagcagatttttgacgtaatgagaaaaagggatgggaaatatttttgctctgatctagaagaagacatgggtatttaatattcttaaattttaaaattcaggagaaatattgtctcctcacagttaaatttggtagtctactttcttttttttcataaatttcggagaagctttaccccaaacctgctagagaaagaattctgtaccatccaatactcatgggagaaaatagaaattagaatgagggaaatattatccatctaagagatatcctctctagtttaaatatcactctttatttccttctttccagatccccagggtagagctctggattgggaattggtttatctaggcttaacgcaattgcttctgcctttagatatgcaagtagagggtaaagaaagctattaagaccattatgacactaatagcttagtaatcaagtatttctttacatttttccaatgtaagtattgtactaaaaatcccgtttcaaagtgccaaataggtttgtatataaaaatggttctgaaaagaacaaaataaacagataccaatgaccggtcaatactgtttatagtaaagagtcttaatgtcaggcttcagctttagacaagttgttatattttaattattgatagctaatgttccattcttagatattcatttaattttgaactagatttagcttttaaatgtgtaaactgtatcttcttttctttctgcacagtaagtggcaagataaaaaatcgacaagactttgtttaacctcttacctcattgttcctttgccatttaattttataataaaaaagacaaaattatttaactataattaattatttattgattcactatgctgcctctctaagatatagaatagggtaaataactatagacataaatattttttaatttaattaaagactattatgagcatctatgagctaataaatcttaaaactgagatgaaatggatgaatactgagaaaaatatttaaaatgtcaaaattgagacttacaaggcttatggaaatttaaatggtaaaatcttcccatcccctcctcaaaattcaaggcccatattacattacacgtaaattctaccaaattttcaacagataatgaattcattttcttatacaaattgttccaggaaacatggaaagctatccagctaattttatgaggctagaattccaaaaacagtgaaggggaggaaaaagaaataaggcttatttcatgtacggctataaatataaaaattctaaatgaattcttatcaatgttattaaatgtgtgtgtatatgcctgtgtgtgtgtgggtgtgtgtgtgtgtgtgtgtgtgtgagaattgcatcaggactaagtagagtttaacccttaagatcaggaaaaagatagggattttccacatcaccactgctgttttacatagttcttaaggctaagaacaattctataagaaaacaaaaagttgtaggtgtaactactaagagtggctacaaacacaatcaacttctagaaatcagtatcattgttctacatcattaataaccaagtataaaatatagtttcaaagtattacagttgcatcaaaatttatgaagtatctgggaataaacttaaccaagaacactaagataaaacttttatggagaaaattttattttttaactctaataaaggacatagaaaatgatctgtataaatcaagatatttggggaccttggatagtaaaacctagtgtcagtgttcacaaattaatgtataaattgattggcattccaatcaaattcttttgatatatctatgcacttaatgtaaaagttacaaagaagaataaatgttcctgaatagcctagtttatcctgaaaaaaagaataaattctagcacatattgagatatgtaagaaataagataattaagataaggtaataatagaaatgaaaaatatagaaagctggacacacatacgttgacatgataggtacatagaagagagagcaaaagaatataaagataaaataaattaagataataatagaaatgaaaaatatagaaagctgggcacacacatatctagacatgataaatacataggagagagagcaaaagaaaaggaggaaggagactgggcttctatgtagattatgatattatctgtaaataacggcagctttatgtcttcgtttcaaatatatatttacacagtaaagataataccatacatctctgagaaaaggaatttttgtttaatagatggtattggaaaaactcactcactttataaacaaaaataagactggacccatatctaatatcatatatgaatgaaagtagatgtagattaattaaagatcaaaatatgaaaagtaaaaccataaatataaagctaaatgatacaaatatatttatctctataattcaagacaaaacctcaaagcataaacatttttaaaacatgatttgatgatctcaaaattaagaaaatatatccaacaaagaacatggataaagttaatagatatatgacatttgggagaatgcatttgcagtgtttcaaaccaacaaggaactcttatctaaaatatataaatcaggccaggtgcagttgctcacatttgtaattccagcactttgggaggccgaggcaggcggatcacgtgagctcaggagtttgagaccagcctgggcaacatggcgaaaccctgtccctgcaatacaaaaatacaaaaattagccaggcacggtggcgcatgtctgtagtcccacccagctactcgggaggctgagatggaaggatcactggagcccaggagacggaggttgtagtgagctgagatcgcaacactgcactccaccctgggccatagagtgagatcctgtctaaaaaataataataataaaattaaatatataaatcaacaatataaagacaagaacctccagtgtttaaatgggtaagggatatgaacaggaaatttacagaagaggaaacccaaaagaccaacaagcatattaaaaagatgtcaaatctgttagtaatttgaggaatacaaattaaaacaatgagatattattttgtatctcttatactggccaaaattagaaacctggataatactaacagttgatggagataaggacgtatagaaactgtcatgcattgctagagagtgggcacggatgactcacattaagtatgcactcccagttctactccagattataaatcccaaagaaattctcagaaagatccaaaaggggcatttatcacaggcttgtgtcatggggattagaggtagcctggtgtttgttaccaggggagttttgtgcagccatgagaagcaatgggctagtcacacagtgacacaggtagatttttaaaataatactaagtgagaaaagtaaggaacaaaatgaaatttttaaccctatatatttttatagttcaaaagtatatccacaaaagaatgagtaatattttataagggcacatgcaaacaaaaggagaaacattaaatacattatagttattgcccatggtggtggaaggaaatgaaaataggagatggagataaaagagaaaaaacacattttaaaagctcaaattattgaaaagtcatcattcccactaccactcatgattccattaggtattttattcaataatggttttactctaatagagataatagtaaatttcatcaaacctttctttagtggtatctataagatatatttgtaatgaatgcgcttagctgatcatgttggtaaaatcttcctttaaattatttatctgattccataactaaattgaattcctgtgaatagacttgagcagtagttactcaataatgaacctctatttactcattttttaaatcccttcatttattgcatcagacactgaaaatattactaaataattagactgacattttttcttaattgaatagttatagagaattgacaaaatcatttatacaaattgaccaaactaatatagacataatacagaattttaaccatctcttctttcagactcatttcctgtgttctactctgaactgttatttcaagatcgatgagatagacaatatagaaattctgtttgcctttagtatggaaactgttctttcataaaatgtcattgtttacattgctgaatgagaaacatccacactaattggtgtagatgaaatacaaaaaattttgaaaggagtaaatcaggaaagggattgaagggaataaattactagttaaatgtgatcacaggaaaagttgaaaagtattatttataatattttatatacttaaaaaatgaaaagcagtttttggcaatcttaattcaagaaatcatttattcattaagtgaattccaaattggtttcaacaccatggaaatcacagagaatgactttgttcacatatttagtgaccgccgtaatttagaaaattgtcttacatggctctgcaatagctgaaatttacaaagctagatgtacagctcttttccatgttgttgaaatcagtgtcctctttaaatcactaggaagttgatgataaatgactgcagtaagtgagaggcgtagtgagccatgcaccatcactacttatttcacggacctgagcaagactccctacctacctgtcaagacacctctaggaagcttctgatggcttcttaggaaataaaaaggccttttttttttcttttttctgtttatggaaacttagtatgggccttgactctcagtaatttatatttctttcccattagctagcaaacatccaaaattgcccagtgattcccaaactgtgtaatagctgagttaattcatagtggaagaaagatattcccttctagtcatctcagaggtaagctggaggacttcaggcaggaaaataaatgtatatcagagtttctcataaaattgcttaatttcaaactaatatttaaaaatgagaaatgaaactgtaacatggtattaaaaaaggtaatttaaattatttttcttttaaacatgagtgtgttttaataagaaatttatttatgttaaatcatattatgtacctaatggagccaagagaaagtttagcattttagaaagggaaaattttcatttaggtctctgtactttcatttaggtgtctgtaaaatactactgaggtagtatttttccatttctaggaactgaagatctgatacatataaatcaagtacagaaatttaaagagcatattctcctttttatatatatttcaaagtaaaaaaaaataaaaggatatgaaggtgtactaagttttgatggtctctcatttctttcttgactcatttcaggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggtaggtgttaaatcccatattattccaaaaatttctgtcatctctcaaacacaaatttgacatttcatctctttctgtataattttgttttcaacataacttcttacaaaacagatttcaggttcttgacatatgtggaaaaattgaaaagtcccaaaacaagtaatgcaaccagtatgtggttcctttttaaatttcagacactttaaatatacttctatatctgtatatttgtttttcttacttcaaaatttacattaaaatatgtaatgctttacgtattttagtaataagtgaaacctagctgaatatttaaataggaatattccacattaacataatctgccactgtggctattcttaaaaataacagcacaagtgctaggattacaggttcagtggctcttgcctgtaattccagcactttgggaggccaaggtgagtgaatggcttgagcccaggagttcgagaccagcctggccaatatgctgaaaccccatctctacaaaaaatacaaaaattagcagggtgtggtggcgcagctgtgtggtcccagctactgtgggggctgaggtgagaagatcacttgaacccaggaggcagaggttgccatgagccaagattgcaccactgcactccagcctgggtgacagagcgagaccctatctcaaaaaaataataaatataaataaaaggaatatttctaccttttagacagaatactcaaaaacatgcatgaatgaaatagatgcagttatgctattttattcttatgtgttttcaatctgaaatgtttatagctaacagttgggaattatgtgctgtagtatgtatatagtatttttagtgaaaatattcatataaaatattacttaaatcatttctacattgcacaaaatgatttcagataagtggaaagagtgaagatgcaacagctgctacataagtgttgcttcaaggaagtgatatcccagtcttccattctaccagatatctgccatctgtcgtatgcaaaacaagtaatcatttctgcatctccagccagtggaatgcttttcttattttttattttaaaggtggaaaacttggagatgggcgcaatgaagctctacagaaaaatttgcattcataagtttatttcttatatacctctataaaattaaaatgactccatttgtatggttcaagcaaagaagaggaaaaggaagggaagagcctcataatcattgatccttggacccttagggcaaaatattctgagaacacgttgcaagcgtattattaggggcaatattgtaccatattgtgtgcacacaagataaaattattgcctgaagccaagagaaaaacatagagacagaatgaatgaatgagagagaaggcaggtgttatgaaatggctggtgaaataaggaattttctctacaaatcattacactcacccaactgagtatccccagttgtgtataaattgtaatcagattatttggtaggagataattctgagcttaattagtctcaactgtacacccttgcttattacatgcctgttttattaaatactttataaactattcttttaaggctaataccttttagaatcagaaaaaaagaaaacagttgtaatagttcatccttatattctaagatcaactgaattgtcttttgacttctaaatgtcataggcatttttgcttttggatattttgttatacatttttacccattataataaagtcctgttcttataaagaaagttgcaagttaatcctgttgggcaaaacaaattaaatacattaaacacaaaataaaataaattaaataaattaaatacaaaataaaatacattaagcatcttatatgtgatgaaagtgcaaggcagcattaaaattgacagaaaaatagcaggtttgtccaatttaaatgagggtttaaaaagagataactgaaagaatttgaaaatgaaattaaaatggaaattttctttacatggatacagtgttcattatttgaatcttatcaaaatacctgtttctacaaaataacatcattgctttggacagtgaaagaattgtgtataaggctttgttaatgtagaacttcttaatgaaacattacatagaaatgtaaaatttaaaatgtaaaaattaaaaattaaaaattgtcttctgttgaatgggaatgattcaagcatatgttggcatattatatagatggtctgaacaatatcttgtattacagcttcatgaccttctagtgatgcagactctctgctactagggtgcctcagctcaggactctgtctcctttcagcatgctcattcgaagcacataattgccagacactcaggtttcattagagagacccagagtcatactgtgaaatgttatgttctttctccccagaccccttgcccacttcctcaaccctgtaattctgtgtcagttcttagaacacgatacatgtgaaggagcgcatacctggaatactcttacttcccttcccccagcccccagaggcctgagcacacatcagcagagaggtttaccatgaccctgtggacctgtgtggactcaagattgcttaggaagagcctctatctccttgtgaccactagggggccatttagtacagtgtagacataacagattaaatgatttcaaggaatgctagttaatttcccctttcccacttcccaccattcccccctctaacatattcccattgctgttaatgccagttagccaagtagaagctaacagattcccacaaagacagttctgcactaacatttaagaatgtgaggaatagtgtcctccaaaggacgagagcccacctgaatcctgtgagctgggtaagtgaggccgagtcattcaatctcactttacctcagttgctctctctgtaaatacatctattgttataagaaagaacccagataaaatggagtgaagtacagcatattcattatttagtggtcatttatgcacccttacctatatacaacccctatgagtagaccatgtgggaggcacaatacctttttttaaaacattcttgttgagttcctggaggtcttgtactgctgtgttgcgacttgagagagttgattcccacctaagtggttggacacagactcttggaaaaagcagagtttaagatattaacccttttattgagctcaatacatttattttatttgataatgtttatcttagtatttttaaaatacaaagattgtacatttcatatagataaaaccaaaggaaggctaattatggctacactaaactccatctagcctaagatggattttttcatgcttaaattaaacactaatttaaaaagagaaatatttaatatatgaatatctatatatgtctcctttgtaaaaaaaaaaaaaaaaaaaaaaattctactacttgcctataactttgagttttgaagttagtgctaaagtttgagaaatggcttaaggttattgattcattctttcttgacaggtgaaatcatgaagcagcactaaccacagcaattatggcattaaaatgtcaagaaattagaggtcagaataacagataattttcttctctatgtcagattgaaaattgacattctttgacagtttaggaactctggctgagaaaattatgacagcttaacttattttatacttgtaaagcagtaattgataataaactttatcatgacagcctctgggcagaaacatgacagtacagttctggtacaaagctcttcttaatatgtaaacactagatctgttggatagtagatattatttaaattgtctaaagtcttggcttacatcgtaatcttctatgcactttttttcatagatgagctgtactatttgagcagtttttcaagcattataaagaatattttttcttatcggtttttatatattaataaaaagtatatgatctgatttatatttttacttactaaatgatgaccaagaaacttcatcctatgacctgcttaggaaagagaatattctggttggtaatcatttagtcccatggttttctaacaccttgatgctcaaatgtggcccataacccagcagaatcagcatcacctgggaacttgctagaacttcagcctctcagccttccccaacctactaaatacatgtaatgagatccctaggcaacttgtttgagacattaacttttaagaagcactgctctactaaaggtgtgttagaatcatttggaaagctttttttttttcccctacaaaagtacagagaatggtataatgaacctccatgtacctatcacccaatttcaaaaatttaaaaccatttcatcaaaacctcacccctccccttgtattttttttctttctttcagagacagtctcactctgtcaccaaggctgaagtgcagcggcttactgcaccccacctcccaggttcaagcaattctcccacctcagcctcccaagtaactgagattatagacacccacaaccgcacctggctaatttttgtatttttagtagagacagggtttcaccatgttggccaggatggtcttgaactcctgacctcaggtgatctgcctgcctcagcctacaaaagtgctgggattacaggcatgagccactgtgcacggcccccctgtactatttttaatacacatgtcatacccatctaactccccatccactctatcctccccatcacatgggcatctcagaatatccagggaaaggcttcaatgaagcaagtcttattttgaaaaaaaaaaaaaaaaattatctgggaatttcacacacattcccaattaaaaaccattaatctagctaacactctcattaaataattttttgtttgtttgttttgagacagagtctcgctctgtcgcccaggctgaagtgcagtggcgcaatctgggctcactgcaagctctgcctcccgggttcacgccattctcctgcctcagcctcccaagtagctgggactacaggcgcctgctgccacgcccggctaattttttgtatttttagtagagatggggtttcaccatgttagccaggatggtctcaatttcctgatcttgtgatccgcccgcctcggccttccaaagtgctgggattacaggnnnnnnnnnnnnnnnnnnnntccctcagcgcgtacagctgcggcgcccccgtctcctatccggtcacaaaattaatcaaatcgcgtcggcaagttgctgaggacgcccgccacggacgcgcccaggacgcgacacccgggcagcgcaaacaacgcgggggaatcaatcagctccgcgctgcgcttactaaacctcacagtggacggggccccacgggggcgctgaacacggccgaaaaaagcgaacggtgcggccgggtactaacagaccctggcgggtacaggcacaacagcgcggatcgggttaggggtgcgtccacagacggacggggaggtacaatcgtcgaatgatagacccatgccggtccgtgtcctaccggtacagtactgatatgacgtgcgtgcgcctgacaacggtgcgaaacgagaccgcgcgtgggcgcggcggccgtggagaaacagcgggcgacgcgggggaggaaatcctcgcgcgaggaacaggggccgaactgagtgacaaggtcgtgcactgcggacgagcagggatgtatgtgcgcggcgcggggtaggcggagtgggcggaacccggggatagagggattcgtcaaaaacggtggggcgtcccaataaacgcccgcctcggggaggtttataaactaaagtcgagggcggggtcgtgggagcccatataacggcaccactccccctaggaggatcgcatcgccccgacttggaaaaaatgctctaacatctccccctgtaaaatgaaaatgacgacgcgagcacgggtactcaacgcgcttcatctgtaatccccacactttgggagaccgaggcgggtggatcactaggtcaggagttcaagacctgtctgcctcagagtatgattatattgtatgccataggcaacaaaaatggatagaaagatgggaatgatattataagttgtatcacagctcaaccattagtatttgagtgacattaagtcagtcacttgaattttatgtacctgtattttctcacctaaaaaattgatgacagagatgatacctaattcatgggagaaaaatatgtgaaaatacttaaactataaagcactacacaggcattattacctaaaggcataattaaatgaagttatcttagaagaacttttgttttaataatttcattatatatgacaccaaaactatcaatttaattttaaaaaatctgttagcaacagagaaaataagttaatttgtttttaatattatttagtaaaaagaagcagttgtggcttttaaatttattttcaatactgtctccaaaattttataaagatggcctaattgcagcccacttattgcctgtaacattctttcttgatctaaattagtattagcatttatatcctttattatcctttatatttttaaaagttttacattaggccaggcgctgtggctcatgcctgtaatcccagcactttggaaagccgaggcaggcagatcacgaggtcaggagattgagactatcctggctaacacggtgaaaccccatctctactaaaaatacaaaaaatagctgggcgtggtggcgggcacctgtagtcccagctactcgggaggctgaggcaggagaatggtgtgaacccgggaggcgcagcttgtagtgagccaagatcataccactgcactccagcctgggcgacagagtgagactatctgaaaaaaaagttttactttagtgtcattagttttgtattcatattatcaaatgaattagcaacactattactggcattaaagttgtactggttcagcaagagaaaaaaattgagtcagtatttcaacagaagctgtaagcatataccagacaagttattaacaagatactaagttctgaacttgtcataatacttgtcatcattctatagttgacgttgccagactgaaaatgatttcaatggctcctttttaacggtgagaggtatgcacataagtctatcataaaaggctgtttcgctggcacctattagaacatgtgagccatggcaatatacatttttagatttacacatttatttatgctggaaatatgaaaaatttaaggggtttttaatattaccaacagtcttcaaaagggggcattttagcctaaatttctgtaaatattgcctggcttcctaagctaataggttcttttcaatcttttccccaatcggacaggtttaacactgcctccctttggatcggttttggtgaaaatttgcccataggaagtgggctagattacttcagtttttactttattttcttgctgaaatattccttgctactacagagaattgacatgatagggctgtcaagaaccagaagatagatgtgtctttaaccaaaacagctgcaatgctggcttttctgagaagatgaattcataaaatttataagacaaaaaattaacacactttttcatcctgatgatgtaaatgaagggtaatttaagggcccataatgacaacattgaggacctctacaatcattgtcttccttgaattctttctattattctttattctttctatgaatcctttattcctcagcctttcctccccccatttctgattctctttgatatgacaaggaatatcaacaccacctgcccgatctgcgtgaatgagttgtagcacaaggttatccatttacaactgccatgatgcctaattgtcttcatatgggggatatccagggttcttctcctgggcagttattctgagaagtgattgcaacaaatgatcacaaagtgggtgattaagatttcttaaaaccatcttaatttccccctataattactgcatgttttactgggatgaaaattttaacagattcaaaagccaaattaaaatggaaagaaaacccctacattttaattagtggagtgaaaatacgtatttggtgttctttaaagctaaaggatcattttgggaacatgaaaaataccatgattcctaaaactaataaggatataggttcaaatatatttgttatgtgtttctcactgcaaaggttttcattgagagccataaggcttgcattgcaaaggtttgatgaataaggttttaatatagaaattagtatcaaggaaattaatgacacacatttaattttgattagtgaataaatctttaatttaggtctatcttacctgctcataattactgcagtacttcactaggccatggtcatcaatcgtccactagaaaagcataaataatgcagctagtcaaagttggatgtatgtcatttatgtgacttgtgcttctttcttcgctttgtgttatttttattgtgtggtgttgagaagtgctaattattgattttcagaaattaacagcaagtactttcacaagcatctaaagccatattttactcaagggaagaagggtgaaaattgcagcctgctgtttataatagaaatagctggaagggatttccttatcttctattaacatagatttcacttctataacacagttgttacctcagcataaattaacaattattcaaaacatattgcatacttcaatttgttgaaatagatattactcaatctaagtacctagacatttcagttagatatttagaactcatttttaaacattttaaacatattgataatgagcctatttaaagccatttgaagtctcagtacagtatatctaaattactgttgcccatttatgtcaaaatcaagaatattttgttctgctgaatacgtccaataatactttattctcactttagtatactaaaagtatatgatttcaatttggaatatttataccagcacctggtaaacctgtgtctcaatgtcattccacataccaaacaaatctatttcagctttttaaaaaaatattttcccatgattaaacacttctagtgaacttataaaggccaccacttctctctcgttcctgctcctacaccaccacctccccctcaacttgttttcctcctccttcacctcctgaatcagccagcatagagtttagtttatataaacttattcaaccagggaaaatttggcagggatgtcatactgattgttctcacctgtggtaaaggatttgtggattgagtcctctacttaggtaccatttaatgattaaccccaaagtgggcaaagaaccagaaacctggaagaatccttaagcgatcatctgctaaaatcttcgcttccaggtaggcgaatccctaagtcatctagaaaagagtatttcagttctcttcctgagtatcaacaaatatttattgcaatgagactctacagcctttcctatctgcttacaatgtttatctctgaaatatttaaaatcctcagtgaaaatgccccttgcttggatataatctttttttggtcattcctaccccaacatgtagcaaaaggtaaccagcatttctctcatttgttgtgcctgaataacaatcctatttgtatcagtcaggatctcagcacattacctttcaaagcgataatgaagactccaaagaagacatacacatgaccaacaagtatgtgccagcatcattcatctttagggaaatgcaaatcaaagctgcagtgagataccacctcacacccattaggttagctactatcaaaatagaaaataacaagtgttagtgaggatgtagagaaactggaaactttgtgcaccattgataggaatataaaatgctaccactggcgtagctgctaggaaaaacaatatggcaatcgttcaaaaattaaaaatagaattccctatgacccagcaaattctacttccggatatatatccaaaagaattgagagaaagggcttcaaagagacatttgtatacctatgtccacaggagcacttttcacaatagtcaaaagtcgaggccaggcgcagtggctcacacctgtaatcccagcactttgggaggctgaggcaggcggatcacaaggtcagggatttgaaaccagcttggccaatatggtgaaactccgtctctactaaaaatacaaaaattagccgggcatggtggcaggcacctgtagtcccagctactcgggaggctgaggcaggagaatcacttgaacccgggaggcggaggttgcagtgagctgagattgcgccactgcactccagcctgggttacagagcaagactccatctcaaaaaagaaaaaaaaaaaaagttgaaagcaacccaagtgtccgtggatagatgaatggataaacaaaatgtggggtggtgtatgtgtgtgtaatgcattattagtcaaccttaaaaaggaaggaaattctgacacatgctacaacatggatgaaccttaaggacattaatactaagtgaaacaagccagtcacaaaaagacaaatcctgtatgattccacttctatgaggtatcttaacgagtcaaaatcatagagaaagaaagtggaatagtgacccccagggactagagggagtggcgagtttttgtttaataaatatagcgttttagttttagaagatgaaaagagttctggagattggttacacaatagtgtgaatgtacttaacactactgaactgtactcttaaaaatggttaagatggtaaattttgtgttatatatattctaccacaattaactttttttaaaggataatgaagagagtttaataatggttctatttacaaaggtatagacatggtaaagtggatgaacaagggaaagcgacaaggaaagggagccattcccagaatctggcaataaaagtgctcacccaacaagagctgtggccttaggtagaggagtactggccaggcactgccaaaacgggacttggcagagaggggccatataatcctgtctctgctcctgagctctgtcattggctgaacccactgggaaggtagagagcaagggagcacaggtctatggaggcgcatcttccagagccaaagaaggtgtccagctcactggtctgttccccctgggttgttcatttctctaggccaagaagacttatttaaggcttccaggcttgctcagccacaatcagctacattaaaatgcactcactcttcctacctgagttgacttatacttattttaagtggagaaattgagtgagcttgtcattgatggcactgatctgatttggacagaaaatattctggatggagcattttctctccggaggaaatgatgcttactttttcacattcatttgttaagtcagttatgtaatatcaccattataattcaacatgccaaggaggaaacagggatcagcaagaggataagtcacatcttaattctacttagatttacgctaaaagaaagaaaccaagaattaaggcaggtaactggacaaatcagaatctctctctcaaatattgtctaagtgcatctactaattaaggcaattgtggtccctttttactcggattaccaaatatttgcttaaatattctaataattttgccaggataattttagccttaatgcagttgaaggttaaaacaaaaggaaaaatatttattctcctattttgtggtttctatgaaaaactagaagcagttgaatataaaatagcattttaattttttatatagtttaatatttataaagcaagaaacaacaaagtgcagatattatttgcttgatttattttgctcctgtttttccagcattaaaaagtaatgctttatatgatcttgttttattacaacaataaaccagaagcaaaagcttatcagttaaaatgtagtctgccattaagtaacctttccttttatcatttcagacttaaaattccattgtttttgtttatttttttcctatttggcattggtagaattgcaggtggaacagaaagatgatatcaatcacatgtatttttttattttgtgtcaagcttgtattttttggtttaaaaaagagcacttttaagtattaaaagccttgtaagtaagagctatacagtgagataaacaaaatgctaaggaaactttgaaaatctttttctgttttctcaagcaaccacttttactacttttttcttgaattttctgaaaattgttagtgaatttactggtatttggacgtagtttgatattttgcattgtgggtaccataacctatagtactttataaaatgctgatttttctgaaaaacaatttaaaagtttatacagaccagggagatggatgaataggtcatttgagagcctgtattattagctccttcatgctgtttgtcatggctctgtagacctgacggcatttcatctgaaagataatactgaattacatttaccaaaaaaaaaaaaaaaaaaagcagttgtaatcattctatggagaaaaatgtaaatgggttaaatctacctgcaatgtggaaaagacaagattaacgaaagtttttgcctaccacacaccagagaaggtatggcttctgaattctggcttacttggttgccacatttaattttaccttagtaggaagtcttttatatgaataagcaaatgtgcaacacataagcacacattatatttatcgatttccttttctgaggattcaattccaggtatgtatctttattcatagaggaggtagaacttccttggaaggaaagccaaaaaggaaagaaaacaattaagagatacggaggtcaaagaaagaaggcatgtgtcacatcatagctaacacacatgcccctttgtgcacactttagaggacaccttctctaaatggatgaattacaaaaggcactcctttctctggctctccaggtagattctattacttatttgccttccaactgggcatctttgtacagggcataaacagcatacccatgcacggtggccctgacctatgagaaagaagaaagactcaagagaacttgttaagtaaggaaaaaggggactcccatgaagatgtcataatttcgtaacttagtaggtgggtcctgcagaattgtataaaggagagcctcatcagactaaggaatgggataatcaggaagtagggaggggacaaaagagaaagtgtccctaatcgaaacttttccttaatgggagctctatatacagataagcaggtaaaactgagttatgtgtcatatatgtgtttgtaacctgaaaatcatttatgctgttcagattttcttattttgttcatttgtgcataactcacttcacatttatctttacttctctgcctatacctacaaaattccatgttttagaacttcctcaaggtgttcaacctacctatttctcggtgagtcttagctggagagaaaaataaatgctaagtgcatgatgtcagttcaataaatattcagcaaacaattttataatcagtaagaatccatataacaattaaaatttaacactctttaacttaattttcatttctactttaacaattccaggtaaagaaataattattataattattttatgagacaattgagttttgatatatacaagttttattaataagttatcagtaccctaaaagattacataatgtaaatcattactttatttacagcttcgaccattacattttgggttcacaaatacttacagaaaataaatacacaaaaccattttggagaaacactttggcagtaaaactaaacttactcctaccctatgactcaccaatcccatatctaggtatagaccctccaaaaactggctgctaacctccatcaaaagacatgtacaagaatcttctaagcaactttattcacagtaacctgaaactgttaacaacccaaatatccatcaacagaattgataaattgtgttaggttaatacaggggaatactatacagcaaaagaaaaatgaacaaactaccgatacatacaacaaggttgaatcttgcagacataaagttgatcaaaaaaggcagaaacaggaaatatgtagtgtataactcaatttatcaaaaattcaagaataaaaaataattgatgataaacatcagaataattattagcttgacagggtgatggggctagatagggggaataattggctggggaggcacacaaggttaccagtatctatgtattctctcatgtacccaccacccagaccaagatatggaaccttctagttccattccaaagtcctctgtcttaatgtagatggtggttagaagaactgaaaaaatgtatatacatacatatatacattcatcaagctgtacacttaagattagtgtaccttatacacttttatcttaaaccttaaaaaatgagtaatttgaataaataaataaaagtgaatgcacataataagcttaacttcaggataccaaaatcagtgatttcttaataacattaagaaagaatattatttaagtacaagcaaatctatattttcatgttattctaccaaagtgttgtctaccaatggctgcatggtcttttgtatttgtgaaacatcaaacgttttgttagccacatttgttttaaaaaatctagtggtttaagcctattacctatgctggctttgtatgaaatatgtaagactcatgataccactgtttaagtaaaaagtcactatgatttattgattctaagatgcacaccattttcatatctcaatactccaaaatcataatgtgtcttacaatcaatcaatcatagcatattttaattgatagcatattttacttattaatagtatataaaataatggagcttctaataatggataacatagatttaatgaagttggattgatggacatttccaaagttttagtctctttccatatacattatacatgctcatgagctcacgtgttcaatgttaactcattttgggtttactggaaagtacaacagatacacaaagcaactgatatcttgtaatacaaattaaagttttcattattatattttaaaaggattcacaagccccaaagcatataagaaccagacagggaatagatgagtgacacaagccagtggcagtgcccaggtcatgtgagtggtgggcgttacaaaagggcagttgtgcaggaatgctgatgtggtattgcctgatctgcgaagtttttaagagaagccaaaaaatccaatttcttgtatgccatttactgacctgtaaattttggctcaaatagaaaccatgtctgtgagctgaatctagcccatgggatgccagtgtgtgactttgggctgaatgtaagctctttgagggcaggaatctttatctgtttcattttaccagtatcattaatatctagaatggaatctagtatgtagtaggtactcaacaaatacatgttttgtgaataaataaagttaacgttaaatctcactgacccttgcagaccaatgtatagagaaatagatacatgtagaatttttttaatgacatttctggataatatagaaggaattcatctcacagttccagtagtttctttttttttttaacttgatatatttggaaatttttaagggaaaatttctatatggtagaaaaccttttcatgctgtggacaagctaattcttacttaatcttcaaacctgagctctgtcctttttccaaaagtctctttcctaagaacctattccccttcccctctgtcactcgtctgggctcccagggcagcctgggcttgtctcccctgtgtcctgctccctaccatgtgcactgacacactcatcgtctttattttgggggctgctaacttcctgaggtcagcctggtatctgactttgtatcccttggcatagagtaagcattcaacaaatgtctgttaattgtttttgtggtattgaattgtaaaagtaaaaaattctgaagtgcttttctttttctagaccaggtttcagttttatacaaatgccctgcttctgtattcaccaaatatttttagaatctctgttaagactaagtcaccatcctgacctgcagagattcagtctgaacaaacagacatacataaataattgtgtgttaaaatctatagtaaaggagaaaaatgtgctgtgagaatatgcagggcattcattatgatttagaaggatttagatccttgcccaaggaggtgaaggatttagatccttgcccaaggttagcattcggggaggattttctcctacacagggagtagctctcagaacaactacttcattgtaacaattcatgggttgcagaatgagttctgcgtgtcaccaggcaaccctcccattcacaggacctgcacacttgacaagaaagtcattgatgacccccttaaagtgggaaaggacagaaaatcttacatggggagcaggtgaagaaagatagtaggtgctcactctcccctcaaacgttttagtaatgacaagaagtagaacttaaaggagacagcatgcttttcaagatcagaaagatctgtacatttttaaatcagagggtaaggaattactggaaggcaggactaccagatagctaaaaggtaaatattggactgagatcctttgggtcatgaaggcatgtaaagtagatcacaaggaagagggagtcagtatagtctcaaaagaaataaacgttcagtgtcgagaactgactgtcttaatgaaaggataaagttagtcacaatctcgtctttatcctgatgcctgattggggaactcttttaaatatatatgcatatgtattctgccttagtccaaaatggtcagagttgggactcactgaagagaactgcacagaagatttctagaaattttatccatttcataacattttctagtacaatgttaatactttcctttaagaaacaaaactagagtcaagcaaagcatgtttgttgactaattccttcaataaacatttaaaggctccctactaagtgcaagacactgatctagagattaaaacatgtttaattttacccccggctcctcgcccccacttgtgtcctttttctggggaagtaaaaacaggagtagtagtatctgttgttagagagacgtttagctgttcatgatacatgaagctaggtattaagcacttgctaaccagggcagcgttaacaataaaattaccacttttctttgcaaataattctcaagagttagttattaaaaatgtgaacctaaccagaaatggtctcttcccccttttataatcataaatcttgcactggggagacaaaagtaggatgtaaatgcatcatatgtgaataaaatttagttaaatagtcacacttgtgagtagacaccatgcaaataaatgtatacataaaaattggacagcacttaaagagatttaataattcatcccattgcctctgcagataaaagaaccaaagtcccatttacgcgatggctaaaatatggcagataatgatgcattcatatttaatattgctaataaatttgcaggttcgcatttttattgataaacattttcttgaaatacagtgtaggaggacagatttttaaatttaagtactttataaattagaattgtagatagcgatgagattagtggtggtgctatgtcaagagccatctaccaactcacctgtgcttctacaagcacctagctatgattttcctatttcacttttacgtgcaaccaaattgcacacaatttagggaaaaaattagcatggtagcagagtaatgatcatagtaaatatcatgcttctccttgttgacataaattacatataatatttcagaaaaagattttgttagtctagcttaatatatggaaatattttgcctatagaatttatgtatcgaggaaatacttaagtttcttttaagatgatctctttgacacacacaagaaaggtatattgtacagtccagacagtttgagggctaaaattatttctattccttggaggctataaaatctcatttccagctacacaggctttaatgaaatattgtatagcttaggatacaggaagatttatttcttttttgggtgagttctctctaaaatttcagggaaaatttttgagaaaatgaatttataccttaaaaataatattccagaattcatcttaaaatagcatagaaagctaaaatatatttttgtaacaaaagttttgttatatttaataattctataaaatcttggtgttctttctgctgatcaccctctgaattaattggaacctataactttctgaattttattttgtataattggtagacttcatgtctcattcttttttttccccattaagattccagaagcttatttcattagagacccccacactttccttcttacaaaggactttattaaggtatatgttctgtatttagtgtggaaagtgttctttggtctttagctgcatgcatgtattcacaggttagattttccacatttaaccccagcttctgggaataagaatagtgactgggttaactgaagcatgtttggaaggagaagcaaagcttgtctacaaaatactaacacttggatgattctgcaccctgagaaaagagcacccgttgaattttctggactttttttcatggctgacttgggatacacttgcgttgtcaaagagtgtgttggcctctctctttgatgcatattgattatgacaatcaccctccttcccctgcaggccatggaggcacagatacagaactttggacagacgccatctcagttgcttattgagccacatccgcctcggagctctgccatgcacctggtaagacatatcagcatgttgagatttttttttctttcctttttacctgggaatagagcaaataaaattgtgattttaacagcatattttaaaaggcttctcgatttattggttaactcttcagcctaagtacaaactaataccccagggagagacagagaaggaagtgtaaatctacctttaagtcctacttaagctgtcccacttttggattcacaaaaatagccatcttctctatgtatgactctacataaactcattcatgcacacacaggcatagagacacacactgacaccagaattagactatatttgtaaattacaatgaaaaatgtattgcagacacaatatgatattgccaaatttcgtggcaagatacagtaggggaagtagttcatttgaataaaaggaaagaaatataaaggtaatttgtggttattacagagaggttgttgaacagagtggttaagagtaagggccccagagccggacagggcaaacaccatctctgcactagctagtaaatgacttgggcaaggtatttaacctctctgtttttgcatttcagcatcttcaaaatagaggtaaaaatagtacctactactgagaattgaatgattcaatactgtatagcacttagaccagcacctgtcatacaataagttcttaataaatgtgagctgacatcatcataattagctactggttaaacctcttattcccactttgcaagggagtcatattcttttcattttaatctgaatttaaaagtccatttccataaaaaagtttctttacagtttattagcaaatagtaaacattttcttctttaagtaatttgaagaaggtaaaatttttatgagcaatttctttagaattttttttaaaactgatttttcactatttttttactgaagtaaacaattcttgaaggtaaaaatgcgttcacaagatgaacttcaagacaacaagtactctaattttagagtaaagagctctggaatatggtccataatatatgtgtaaacaaatgtataagctgttattttgtgatggaagtattaatcacacctttcatttactctgtcatttaacgaatttttattgagccccttctgtatgtcagatctgatgctaagcactggagatacagtgacaaataagtcctctaaactttcaagaaatcagtagtcgaacttttgggaaacacataattgctttttgttgttgttgttttgaaacagaatctcactgtcacccaggctggagtgcagtggcgcaatctcagctcactgcaaccttcgcctccctggttcaagcaattctcctgccttagcctcccgagtagccgggattacaggtgtgcgccaccacccctggctaatttttgtatttttagtaaagatggggtttcaccatgttggtcaggctagtctcaaactcctgacctcgtgatctgcctgcctcagcctcccaaagtgctgggattacaggtgtgagtcaccacgcccgacctaaatgcatttgtttttaaatttttttttaagatagggtctcactctgttgcacaggctagaatatagcgccatgatcatggctcactgcagcctcaaactcctaggctcacacgatctttcttcctcagtcttcctagtagctgggactacgggtgtgtgccaccatgcctggctaaatttttaaaattttttgtagagattgggttttgctgtgtttcccaggctggtcttgaactcctggggaccctcagtctcccaaagcgctgggaatacaggcataagccaccatgcctgcctggtgtgtgtttaaactctttttttttttttttttttttttttttaccttccttcaacagctcagccaaacagcttcagcctccttggttagtcactagtgaactcttttgactgcagttggtctttctgtgtaactaaacagaaaggtttgcaccaagctcaggctgttgccgtataaacccctcagccacattgtagacatagagatgtggcctcggagcctcaccgtttttaataaactgtccagaagaatatctctaacactttattttatgaaatgctttggcagaagagttttattcccgtgttagttttctgtgtttaataataataataaaaatatttatcctggagatatgcccagtcagaattcattactttcctagaggaagttgttagagactgaattggcatgaaactgtttataaagaaactctaagctttctaagttcatgtagcagagaattcatatatactgcaaaccattaagaaacatgtatgaaagctaaataatggttatttccagcctccctactttatgtttttaatatggtggtatttgtagtgttttgtaggacttacagtatctactttctgtcaagtcatatgctagatgttgacaaaacagacgctaaaaacagaaagaagaaaacacatggacacgtgacagggaacaacacgcactggggcctgtcatgggggtgggggtggtgggaggggagcatcaggaagaacagctaatgtatgcagggcttactaccaaggtgatgggttgatctgtgcagcaaaccaccatggcacacgtttacctatgtaacaacctgcgtgtcctgcacatgtatcctggaacttaaaataattaaaaaaaaagaagaagaagaagaaaaagcattggccctccataagctcccagcctagaagggagaaacaaggcttcaaccataaacagtcagtgccagagcagaacctggggagaactgccagggaagcgctcggctgctttatggggctactgtattttaattatttagactgtagtcatgaccccagatcaaccagatagaaatgaaagtattagtcaattcactttatatttcgtgtaaaaaatgggagtcactaatttgactaactttcccaccaaactgatttttaagctgcattgcataactgtgttacgtcatgtgggtgtgtctatgagctaacttttcacattgcattgtggtgatatttgaattgaggctggtctttaatgattctgtgtccctgtatcagtgccttcacagaattcttattctctactctctgtgccattccccagtcaaagctgctcgatttggggcagacattcaccagtatgaaagtttaggtggcttttcctccttgtgtgtgctcgtgctagccttgtctgtttaacctcattctccctagacctttcactaactatgttattccttttgtcttcctctgttctcttccctttctattcaacagtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggtatgtgtgcctgagcaaatcacttactaaagatttcttaaaagctacaattaaagtaaaaaagtgtactgggattagctcatatcccacattatctacaaaaaacagcagactaaataaataattgtcaaatccaactaagggacttctatctgtctccttcatttctgctgtatgttagtgcctcataggatgcttggatcatagtcaactactcagtaactatttgacaaattgaagcagttctaccaataattcaggttctcctactctattctgctattgcctaactgcaaaaaaatacacccttcttttttcctatatcaaacagaagagagtttgaatatgggtttctggatgctggcttcacatcctcttgtctctatatcagtaatttatttagcaaatatttgaatgactattatgtgtcaagtagtcccaagcactgtatatacagcaataaacaaaacaagcaccaactctatttttgcagagcttagaatctttgcaaaaagacaaaatctaaattctccagtgatttcacacttcacatgtgtttctccaaactctttcctgaaagtaccagccagtacatcttgaagcgacataacgttgtggcaaacatttagacatattgcaggagttcaagaccagcctggccaagatggtgaaaccccgtctctactaaaactacaaaaattaaccaggcacagtggcaggcacctgtaatcccagctactcgggaggctgaggcaggagaaacgcttgaacccgggcagcagaggttgcagtgagctgagatcgcgccactgcactccagcctggacgacaaagtgagactttgtctcaaaataaacaaaccaacaaatcaaaacacatttagacatatggatgcttaaccagggcagagtggatgtgaccaaatgatttagttggcccagtttaccacttgggatctcccaggaagccgaggactccccgtctccagagttgaatagctgagccatgccgaagtaacctgaatctttctattttactgacctctacattgctctaaaaaatacagtgatttatatcctagctttatctcctaagagtttctaagtgcacctattttaaggttattggtgatattatcaacgtaaggtaacgctacttccattccatcagagataggcagcacatatcttaaggaaaatatatgactgtattattctcaggagacagcctctagaaatgttttgcattgagaaaaactacaaaggactaaatttttatttaaaattgtttgaaagtgttgtatatattatataatcacgtgtgaaaaactatgactaatgaacttcatcaagctctaaacattaatcctctgaaagtagcttttagtgagattaagattttaggtgtggcccaatttttataccttccatttacttgtcacatgttgaaaaaaaggccccattggatgggagccccagcttcctgtgtcctgccccaggtgagcgcaggctcatacccatccctgcttggaagcatagccctttcattgatttctgcttcctgtgtcctgccccaggtgagcccagcctcatacccatccctgcttggaagcatagccctttcattgatttcaggctcattgattgctcatgaccttagctttttgatgggttcaataaatgttacaatcttctatttatccagctttttctcatcattagaacagaaacaaaactcttcccagccttgtacatcgtaagtggaaacctgaagtccctgttgtgattattttgtaaggctgtctacagagacacatagtatcagaacaatttatcaaatcatttttaagcaaatatgcattttgtaaaatcatcataaaacactacccattaggaaatcccttctttctgagaattttatgttagtttttctctctttttttaatctttaggcctcagaggagctccaggatactccttggatcaagcccaccatcttcccattgaaatggatccattaataggtatgttaataaaaaagaataaattttcatggatactatccatatattcatatatagttatttttcataagatagttgaacaatattttttctaccacaagattaaaatgctaataatatcaaattatcatcaaggagctgtgtaaatcataatatgccatctaagaactttttggtattaaagcaatcgtttcttgatatttttggaggtcatttaagttggttataaataaggcaaataattccaaactgtattttctttcagcctaaagtgttctctaacagctcagtattatttaaaatataaggattcaaaaagattactaaaggctgggggaggaatagcattaggagaaatacctgatgtaaatgacaagttgatgggtgcagcaaaccaacatggcacatgtatacctatgtaacaaacctgcacattgtgcacatgtaccccagaacttaaatttaaaaaaaaaaaaaaaagggccgggcatggtggctcacgcctgtaatcccagtactttgggagtccaagacgggcggatcacgaggtcaggagatcgagaccatcctggctaacacggtgaaaccccgtctctactaaaaatataaaaaaattagccaggcgcggtggcgggcacctgtagtcccagctactcgggaggctgagggaggagaatggcgtgaacctgggaggcggagcttgcagtgagccaagatggcaccactgcactccagcctgggtgacagagcgagactccatctcaaaaaaaaaaaaggaagctaatattgaagaactcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatcattgaatttttttaaactgacatgttgtaaagcaaatgtttcatatgaattgcaaactgatgagctataactctttgcagcagacattcaaaatatttttaaataatcgtgtacatatttattagccattggatccagagctagcatcttagtctttcgaggcccttccggtttcatatatgtaagacagtttttaataatgtttgttctatctgtatcactggatgattagtaagataaattagaaaaaaattgaaaatgctacgaaaaattattaagctacatattaaagtcaaggtgttttattcttgggttcttttttttttttttttttgagatggagtctcattatgtcacccaggctggagtgcagtgatgcaatctcagaccactgcaacctccgcctcccaggttaaaccaattcccccacctcagcctcctgagtagctgggattacaggcgtgcaccaccacgcctgtctaatttttgtatttttagtagagacagggtttcaccgtgttggccaggctggtctcgaactcctgaccttaagtgatctgcctgcctggccctcccagagtcctgggattacagacgtgagccaccacgcgcagcctcttattcttagattcaaattcatccttcgtctttgaacctggaaataagataagatacagacgtttcaattagttacttatacccatacacaaaataccatttacatgtctttgggagcttataagctttaggattaagaatattattagtctagtctagctatttctctttccagtagacattgacaatgaaatatacagctagtgtgtaaccatggaaaaattaataggtctattctaattagtaaaggaccaactgtatagttttcaagtggcctgggacccttggtcttcttgtccttactgacttttgtgtataatatttttattgcttatgtttcttagtaattatttttatactgttagtagatatctacagatagtagtacttaatatttaactggtgttagagagtggtggtgaccttctacatctgcatttctgtttaagaattcagcccagtgatttatcctgaaaggatggtgcgcagtaagggacaggctggcatgcagacaggcactggggaaatcagatggtgtctctgagttcctgactttattcagattcaatcccagggctctgcactgattctttgcctgtctctttcctccccagtccctctctcatcttttttgttcctctcctcccctgctagccctttctggaaaggccttctgtctgttgacaatccaggcctgtaaagctgctgacctgaagctccctgtggggctgcccacgtaacaacatcccttgctcaaatctctaccctcctttttcacaggaattataaataccatctgaaaatgacagacttggggcaaatattaatatatctcttccttaataacatacttcatacaatatttagttttcatgtgattcttataaactaatgaacttgtatatagtgaacatctaaagaattaaatgcattaaaatattgtattatgttttaaattaattgtcttgaattcctcatattgtttttattggtggagggagaactaaaatttctggcataattttaaaatacataatgtggttcataaataattactgcgaaggaaatttatattcctcaagggagaatcttaataatctcataccattaaaaaaactatttctggataaatgaagcatgaaagtattgttttccttctttgagtgcttggcaaaactcatatggaatctttcttcaaatgcttttttccatttacttttagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacaggtaatcctaactatgaaacaccatattctcttcaaaatgactattgttaaaaccaaagctgaatatgaaatcatacttaatgtaggcatttttatcatttgccaacttgagtagtcaagattcaaattaaatgttcacattgtaagcaaagtaactaactataacttcatgtattccgaacgttagcatgatcccagaattcataggacaaatggggctattgttcctttcccacaaattcatatgcagtaaaagatcctaaaactccccttggtctggcccaaaccctgaagagaaaaatcgtgattgtgttattttataaagtcttttctttaaaaatctcaagtgacattcttgtatcagtttccaaaagcaatgcaagaaagcaacctgtagccagatttgaataacattgtaactttgtcagcccatagatgaacttttcacaaaactggtaaaataaaattaaaaatatggtaaaattttttaaaaaatctgataaagttacacttattaccatttgaagaaaaagactaaatgaagcaaacctgtcatttctgtgttgcagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgagtgtttgtatcaaatttgtcctatcaaactatagtttatttaaatatattttgcctttttgattttcctaatagttttttcctgaggtgtaaggattttaaaatatgaaagcttaagtggccaaaatctgtactggaacgtagctatgttcaaagtgttaaaatgatcagtactatcacctacaacatggagagacttccagatcccctcaccagtcccctacccagaccctctgctcagcagcccagtcaccaaatgtccccatccttcagaaattttcttcagcttcaccttatccattaaacctcatattatttctttcagctgaaaataatctctccctgctctgaatttttagaagattttgcctgtgtctcattcagggcactaactgctatctaccatatatactgtagtaaatttctccatttattcgtttagcaaacagtgagtgagtacccccttcacatgaggcattgtgggagatgcaaaaactgaataagacagtttccttgcttgggaggattcctcaagtgatagttattccacagtgcaccctaagatatcccataggaagaaagcgttgggagaggctggactccttcgtgaaataattttggagtacagtgtttatactcaaactttctacataagctctgaaagtcttacacaaataaatttgttgatgcttgtttaatccgcagcctctcaaacttctttttccaatgaaacttttatttatgtaagagaagttagttattagttgttggactgctgccccaagaaaacactaaagtagataatgagtgtctgtctttccatcttcagttcctgtcatagtaatatacataataggtttccaataaattaaatgactgaagagctggataagagattggctagaaataattactgcttttaattactaagctttcaatagttcactcaaatgcatgactttcctgtataatatagaaaggtttctgtgaagtgataatggcaagtactcaaaccaggattattcaaattgtcacagcttacacagcactccaaaataaactgaaacatgaatttggggaatacttataacccaacagagataaaaatttttcaggaaacctgtgcatctacaactaaaatactataagagtagataagaaatctacaagatgccatgttacattgcgtggctggctgctgcctctctggttagttccaacctgtgagacagctaggggtggaaactgaattgcacatccacccttcatgtcccactccatccccccaacccttatgcattttgacaggaatactgcaaaaataggaaatggctttggatggataagaacaaaggccccatcatagtacaggagagaatggagaaatacatttgtatgagaagatagtggaagattggattagatgtccaaatgttatgtgaagttttattcctgttgcccatagctagagttgaacagtggatgaagaaactaggtgtgttgtaaaatagcatatgcctcttggcatagctactgaacaagagagtgtctattgtacatacgagtctctgttctaaatttgaacaagatgtgatcttgatttgagggaaaagatattcaatgttgcttgatttccaaccagttcaaataattagttaccaattctgttattaacaaacattatgctctaaataccagtaagataatctccctatttactcttttgtaaagccatgtccgtaaacaattcatttttaacagaattctagtatgcctatgtatgcgtatgtgtacatgtgtataagacatatgacctaccagcgatggctttattattctcaagaatggtacattatcaagtatattttatctaaatatatgttcacatatttccaaattgtctttatttccataatagtgtagcatttctttaaaaagtttaattaagcagcaggtctgtgtagtatctttcatatacattgataaaaattagaacttgttagaaaaaatttaaaagaaacagaatagagctttaaatctaattaattaccgtcttcaaaatgaagcccagaaatgatgcaagtgttatttccaaaaaggggatttatttcttaaaagctgccatctggtagctgagataagatgttttatataatatactgctaggaggtaaagaatattaaagaaaaatattaaattatagtaattatctatgttcactactgtgttttctaatgatctcttaaaccaaaagatggctaactatcaattgtagctttggtacatcagttagcaagaaaagttaaatacaataatatttaaattatttaaagctccttacaacaggagctgtgtaaatacaaaatgcttttttaattcttaagaacaaaaatatggatattatatttgttaaaaagcagtatcatattttagttttaagtaaggacaagattatcttaaagatattatgacaaaattatcaatatgtatttttcagtattacctccatctataggaatttatttttagtgaaaagctgttgtcatcattatgaacctaaaccacttccatagaatccatcctgtcaagactttattagatatttaatgtgaacatacgtagtatggtacattaataaaagggaaaagtgctcttctagaataaacaagataagcacctaaagtattagtcaagcaacagtatgtgttgggtgcctactgtgtgcctactgtgagcctggtactatcccagcagctgggaatgctgcaaagtcacaacctctgactttctagagtttacaagaatctacttttatactgatcacaaactgtttctcctgcttggatatactgaggatgtcaagtatttgttaaatgaatcatgaattgttatccgataatattttgtaccatactttaaggattcgtaaaatgcttaactttacatcaaattgatgattatgaaaaaaactggttttagcttttttccataaggatgatcacagtagtaaaaaagtgatctcaggtttagtattgattgactgactgatttgtgacccacttatctatttaaaaagctaacctagtagcatatatatgcctgactagggcaaccatctgtgtcggtctcttcactcttttttcaggcagtcacagcacacactgaattgactgccatatcagtgccctgcctgtggtttgacatagacatagttgttgccatcagaaaactcacaatgtgaaagagattttcttctgttccagtttaatctactctagcttccaattcacaggtcagagaagcaggccatatgtgttttctatctcataatacattgatactcaagaccagaaagctagttatgtctaaatttgtattaaagtgtgtgacacaatgcccttaggttttggaggttgtatgtattaacctatccttgacgtgggaagtcctggcatgtaacataatatcctagtagctgttataatgaagggattggccttggtgtggacatggaactgctttgtgtgtcaccgaggccaaatcacacctgttcatcacaacatcatgaaatgataggatttatcatttaacctttacatgcatatcactaaaatcttctcaagataaaattcaactgactttaacatatttgtttctcttgcattgtcattattatattgtaatagatagctctattaattccacgaagaaaaaatgtcatgtttgtgaaatctttttggcaggtatagaaagtatgtatggttttattgtgtcaaatatattgtgaagaatgcagacatctcagaaatattagtctttttctaatcattttgaccattgtgatgaattggtcacaaagataatgaatatttgtaagcagactatcagatatagagtctcagaccataaaagagataagcaaagtctacctagtgcaggttagagttgaattatcattgctttattaatgtattttataatattattcattgttattctttcaaactcgcggctttgaacgtataaattatcttggagactttaaataggtccctaactagataacagaattgcaaagatgtgaaggacagatgctttcatccgaaacagacttttacacaaattctgaaactaatttggaagtgataaaaattaatttgcgcactttaattggaagcagcctactgcatgaaagagagcagagcagagcaggcaatttgtgctaaaagctgattgaattttttgtcaggtaggtatcttggacttggccgcttatcctcttgagcctctctttgcaatatattacaacccatctctgactggtgttctttaaaaggatcaatggtattcctttggaatccctagagtccaaaatttcattgatcttaggacttgacatttctcattacgtgctgtagcttccaacaagatagtcacaatagaggcaagttaacattgttgtctcttcaacagacactcaaaatacattgggacttcagctcaaaagccaatctgcttttaaagaatgtagttttaatgtttataccacatacaaggtgctttatagagagtttgatatacatacatacaaaaatttttaaatcatagccatgtgaaactttgaaagaggatttaccgttcatcttttcaactcaaatctacaaatattcattgggtagtttgtataacacattgttattatgcttttctattccactttttaaaaataagtattttagctcgtgtacgggcattatgcagactgtcaaaggagaagccaattgcaaaggagactccagctgtgcacacacaccttctctgggctcccattgtgtatgcctcagctctggacgctgaccctcctgccagccacaacctgtcaccaaacatctgccaaatcacatccctctctttgttggcatccaggcttcttttaaaaagactatcctggtgcccagctccacaactgccactaaccagtgctattataagaaatgaaagcatggccgatggatagcccagagagatttgtagagtatatttagatttagatacattaaacaagtttgtatcacttctcggagcaaagaatcttagctaggatttagcatatgttaaaccatctttgtaagatcagaggaagtgtagctccatatgcaatagttctcaccttgcagggctttttgaggaccaaatggtaatggatgtattggaacatcgatggcacagagtccattctgcagtagaccactcatccaccccatcccctcattctaacaccagtagactttccagggttccagactgagaagggagctgcttgctactcggcctcggcttttcctttccttttatgggactaaggcttcaagaaaggtctttggcctagattggaagcaatatatacagagtgactaatgtgttctgatcagagagcttcaggttccaaccagggggtgtctgggctttacgcagagcccagcttcctgaggaaggggaggtggatgatactattagttgtttttaggtgagcgtaggacagtaatgtactgtgacctagatctgggctcaggacttcaagagaagaggttgtcctgcagtggcagtgctcagaggaaaatgtagtcattgttatctctgaagaggaaaaagaagttagaatgaatgaataaataatttcaccgtatctgtcttccattcttcactgaatactctatgagtacataaggaaatgaaaccacatcatgggtgaatttgacattttccaacccacagaatgtttttacttgcattatcttgggaccttgggaaatgcgggtccaagtgtatttgatacttggaacagacctccacagcacctgcctgtggctgaggagttggggtcttgataagggactcctgaccgataccgctcttctcagctattccagcaaatttctaacataatatgttgaaataaatcttgaaatcatagtagtaatgaaactaccataccctttgactaaatcccttattctgggattttaactttcaaaactccatcatattttatctaagtataaacatgaataaaaatatcttctgccatgattctgcagtgacttccccagggtcagaaataaaatctgaatcagattttatcaggaggttcatcctctcactgtgcagcggaggtcttagaaactccactggctttgtttagttctaaatcagaaagaccacagcttcccctgcatatcagtgtcccacaaatgaggtttaaaataagaaccatgagttctttactttggccatttctctaaaagccagagaccatctcactaaaaaacctctcctgtctatgtgaataagcagcatctaatactagtatatttttttatcatccattttgagaatattgaaatgacctttgataaaaggaggatggaatttgtttattttaagccttttaatattcggagtttccaaatgcatgtctataaggaatctaaaaattggacgtgtttgttcttcatcagttctagtcattccagcacacggtgagtgcttctgtggaggcagtggtgggcctgagggcaacggcggtggccctcagaggggcggtccacctgcacctccctctgcactgggccctttaaccctgggctacatccatcaactgtgatgtgacagtgacagaatattcctaggattttgaatgattgttggggtgtgtgacatctgtccctagcaacgaaatgaaatataggaaacaagctttcccgccgctgcaggtttcccaactcagaaagcctggaatggcattttatttgcctttcacttaaagaaggaaacagtgctttcaggggccctaaaaaataccccctaatagttaagttccacagtttattcagatgatctggggaaatcgtaatgaaaaaaataaaatattttaaactctctaaatcagacatgagcctttgaaaaactcatttcctagcagaaaatgtataacatgcattaggaatatttttatacattttttttctcaattccctgcaataggatcagattgctttttattttttctatagcatattagggaaaggtcccaaaactattcattttatataaatgaattaagtgtataatttcagggttttccagtgtgctagtctctccaagataaaattatcatttagaaaaattaaacctgatattacacataaaatcttacaaatacttttttagagatttaatttttatggatacataatagttgtacatattgatgggatatgttatacaaggatacaatgtgtaatgatcaaattggggtaattaggatatccaacacctcagacattcatcacttctttgcattaggaacattctaaatcttctcttctagttattttgaaatgtacaataaattattagccgtagtcaccctattttgctaccaaacactagattttattccttctgcctaactttatctatctaactgtattgttctacccattaaccaacaccttcccaccacccttgccagcctctggtaaccactattctgtttatttcctctgtgagatcaatttcttcagctcccacatatgagtaagaagatgggacagttgtctttctgtgcctggctaatttcacttaacctcatgtccttcagttccatctatgttgttgcaaatgacaggatttctttttttttatagcagaataatattcaattatgtaaatatatctcattttctttatcttttcattatttgttggacacttaggttgattctatatctgagctattgtgaatagtgctgcagtcaacacaggggtgcagatatctctgatttgctgatttcctttgtttggaaaactcttatcaatgcttaaagcttattttaccaggaagcccagggcatctttgaaacaatttttttttctttttcacctttttcctgcagtgtgaaacataattttataaattatataaatatgtttcagacaaatccaggactgctgacattataaatggacactctaccaatagtcaaaacacattatagcaatatccatgtattcagaagaagatggcaaactagcatgagctgctgtcccccttctcccacactccatctaagagatgcctcaaaaacaaaattggagctgatgggtctgagaaaatgcaaataaaacggagaaatccttggggagacagaagataggcaggtcttaagagaagataggcaggtcttaaggaaggggctcttggccgaccagagtggaagatgtgggtcgtcttactgggtaaggccttgtgattatgcactttcctcatgaactctctgtggcttccctcttgccactgtgggcagagaactggagcagcagtccagctagccagcacccagaggtcccataagtgccaaagaaggggctattcagggggaggtgcatctgccagccctggaacatttaacttcccccaaccccagtgagggccagtagttcaacctaggaggcagctctaggaaagaggggcaccaagaccaaagtacagagtggttctctgagagacaagataggggatcgggggtggttaccccaccaaaaataggaattcacaaaggaaaacaggcaagcatgcaaagaacacaagtgctagaaaagaaagaccgcaaacagaacaacctatatgggtgatgcagaataagctcatttctttctgataaaagaagagaaaaatatagaactttttacaaaaggcataacattctctaagtccttcaatttatgaaagcagttagcagtgaaaatgcttctgggatataattcagctggactttttagctaggttcgcactaataaagtgaagtaggttcaattccaacccttagctgtatgaacttgggcaagttgaatcaccttgcaaagccttgggtgtctaggctatagactagggatagtaagagttcctacctcatagagcatgaccataaatacatgatgtaacacagataaatgccttagcaggcattgtacctgtttcataacaataatggaagaaaaagaatagccattaccactctcgttacgttctaagcatgttacatacgttaacttgtcctgtcatctaaacagcatgtataatagattcgctagttatgcgcatttcacaaaagaggagagcagagaggttaagtaactggctcatggtcacacagcttaataataatgcccttaataaacatgggtattttttgaatattgcattgctggtgtagctctctccccctgctattggtctgtagtgcctcactgctgctgttttcttgcaggtgactatccggcaccaagagccgtcctcacaggccatgaccatgaagttgtctgtgtttctgtctgtgcagaacttgggcttgttatcagtggtgctaaaggtcagaagtcatttctttcattttcaatgtctagaagatgactgttttctcacactaagcgtgattgtcagtttatttcttccaggaagcttcccatagacaaatggtatcccaaagttatttgtagatgtttagttttatgattaatatttactggcactaatataaaatatgtataaaattttatgtagtattttgtggtcaacagtgttctaagcagaacactgataaattacagtgtattcttatgatgcagccattgtaaaggacatgtaaaagacaaggggaaagtatccctgatgtagtgggggaggtggggggtcatgtcactcatcagacacggcctaggatcccctccctcttcaagtccctttctttataaggccaggggctgtgtagaggttggtggaaaggaaacaaagattacttggttctttggaggttttgttttgtttttgaggcataccttcactcttgtcacgcaggctggggtgcaatggtgcaatccaggctccctgcaacttccgcctcctgggttcaggtgattctcctgcctcaccctccctagtagctgggattacaggcgcccgcaaccaagcctggctaattttttgtattttcagtagagatggggtttcaccatgttggccaggctggtctttaactcctgacctcaggtgatccacccacctcagcctcccaaattgctgggattacaggcgtgagccaccacacccagcctctttggagtttttgtagaagatctttcatttcaggaagtcaggaaacttaggtcctagttctggctcaaatagcagttctctgtgggaagactcccaggcagaaaggagcctgatgcttggagaaactgaaaggagccctgggtgctgctggagtatcaccgtggtgccacaacctggaggaatgagaaggctgaagggatgggaggggcctggggcacaagcatttgcaatttttttttaaatgagtatagtaggaaactattgaagttttttaatcgaggtgatgagatagataggtttggttgttagagctcatttcagcctttctacggagaatggatagagtctgaaggctggcaccatgtttttaaaattttggtatctaagaataaataacccagaaatggacacataggatattttcagtcttttaattttaaaaagtaataatatgtgtaatatcattttaccctgtgaagttaaaaaaaaaaaaaaaaaggaaaataagtgacacatagtaggcgccaagaaagagacatttcctgcaggggctgtgtgatattagagatgattgctggtgttttcctaattttctatagggcaagtctattactttagtaatcaggacaaaatttaatcatgtcacttgctttgtaaaatatgtgtctattcagctcaattaaaaataaacacgtaattcatacattgttttgtggaaatctttttgggacaagggaatagatatataacaccaaactatagtgaccaatttttatgaattgatcagtgaattttttactttatcaacactattttataagggcaaaaaaacccagaaaccatcagagccaaatgtcactccttaccctcctttcacactcttgcctcactattcatttatttgaaagacaaaatatctttctgtaggctgaaatacttaagttttctcaattttgcttttacattttatgcgtatggatgacagaaaaaggtaaaatgtacttgacggcagtgtattgatgtggtacaacgcgtaaaattttgatgctacttgagaaaatgagcagctgttctgataattctattaaactttcaagaaaagtttctaaaagcgtattaagagaaaatgtctggcacataaagtcttttattgtcacgtaatctgtgagctgtaccattttactatgaatattacctgacaaaggaaaagaccaagtatctacctggtgaagaagcgtgcggcgtaggagtgtgatatgtagcaggtactctggctttgctctgtttaaatgtagcatcagcgcttggcctggccagcctacctctttcctgtcctcttccgtcacatctgagcgcacacccagcaaggttttcaggttggtgggagctagtatgtcgtttgtcgtccccaactgaccctggcattgatgtccccactttgcagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggtaaatctgcatagttcgtgctaagtaggactgaagccaagagattaaagattgattgttttacattaaataattcataatagaatgtctgtgctatccagataaatgtgttctagattaaaagtatataacttcttgcggactggtactttaaagaaacccaaagttcatttaattgcaagtaattaactcactgcattagacttcagaaatgatagctgttgtttgattaaagcttagaacctcgggagggtttttaaagctccttttataattgtttcagtgctgcaccctcacaacattaaaagtgagtttattttcaaagatttctatctctagaaccctaaacaaaaattacatatacccatttgcccttcattcatgaataaattataattgctgggttgtcattattaaacactgttttgaaatatgtttcttccatttgttctttaattctctataatattaatattcaagatttaactaaacatgttacttaatgctcaaattcttcctggattaaattgataatattctcttgggaatttaatcttggttttaataagatcttttgtatatgtaagaacttcgatgaattccacaatggaaattctgtggattgaacttgattttgttggacaaatgactgacagtaggcaataatgataagggaactgtactgagtacttttcagtagtgacagttggctatttaggaaaaattgagagaaatggttgttgtgtattttattttattttgtttttttttgtttgtttgttttaccttttctgaaggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggtgagctgcgtcaaggacaagtatcatcactgagaactgtcattgaaggctctcttcattctaccaagggtgaattgtgctgtgagtgcaattccagcatccaaatgaaagaaagactggcaaagaaaaggggaaaatgaggggaagagtaaggattctagtgagagggaaacagaggaagagaataagaaggaaaaaaagaaaaggatctgatgaagaacaggtgcctgcagacatgttttaagggcccaagacatagaacttactcccaccaagttccctgttctcaggttcctgcctagtctcagacaggccaccctggcttatatgatgtgagggaaacacgtatttttcagcagaggtgggattcagtgtgagacctacttcttgctaaccagtttccagcaaagtgcatagtgtgggccgtagctggcccccctttcaacagcatgcggcactcacgcattacccagaacaatttttttacccccatgttcttatttacctgtttctcatttatgttattttgttttattgtatgtatttccttaaaacacgttaatcctttaatccagctctttcttggaaagagttgatatggatgttaatcaattaataatgattttccattgttcctcaatttgcaataggattttattatttcctgaaatttacctttgggtttcttacaaagtgaaaataatattagaaatataaagtctaaagttcctaagcctttaaaataaactacaaccctgtaatctgaatatggcatgtgatttctaatttttgctatttaacagaaataagaaaagcttgttaatcaacgtttttcccaactacatgtaatattcctcataacagtattggttttaaaatattttaaatattaagacataataaagttaacaaagcatcttcacaatataataaaatggcactgaagtcatcaggaaaaacgctgtaagctaatttagtctgggaaaggatgtttggtctgcagcccagactgtttttaaagaaggtttaaggttattattggagtatcccaaagtgctgcagcccatacttaggaataaatgggaatggtttgttgtgttactatttgtatatatgtgtgtttccagagtgtttgaaatgatttgtgtttgtaagcagtttcaatatttccctgatattcttactcgttcgtgtattcattttgctgccatcatcataggttgagtgcagtgcaaagtactaaggatccacaacaagaaactgaccccagagagctcagatcctcataatcattgcatatgagggcaccaggaacagactaacagaagaaggaagggatgaactcttcttgagggctgggaagggcaggaaagaccttagaagaggctcatccattcaccaggcatgaacagacagggtggatggaagagcatattcaaagttgcagtagtattagggggtctcaatggaggggggaaagatactaagtttctatttctattttaacctcatccttggttttgattattttgttgttttataatgaatagtgcatgcatatcaattataaactgataaacatatattggggatattactcaaaaggtatttattggatgaggtgtctaatcaaaagtgaagcaacactttatgtagacagaaatcctgaaacctgagttcagtcagtggcagtgggactggggaggaatatccctgaaaaagaagcctcagagctgaacagctgatcagttaggagggagagggagaggagacaaggtgacttaaccagcaaaagaccagcaaggtcagaaggtaccagtgattcatggtggacatgttgaatctgagggttttgtgacacagcctggcagtgacctccacttggcaatgggaaatcagcatctggggcttcagaatgagacgtcgttgcctttacgtccagggagactgtggaccgagaggacaagaggtggagtgattcaagggggcaaagaaaagaaaggtcacagagataggaagagatgccagatatcctcagagaagccaatagatgcccaaaacaaggcagcggacaggcacgtgtgtgattgctgagagaaatggggcacccagcggaggctggaaatgtggttccgtgggcccctcacgctctgcagcagggctggctgtccaggtgtgtgcgggctaactgtgctcctctcagcagaaccaagaagaaatttcagtcctacttccatgaatacaaaattaagacttggcaaaccttgagatcgtgatattgtctagtgtaaaatgccaaactttgagatactgtctagtgtaaaatagcaaccacagaaatgattttatatcactcttaactgctgtttctgcttttccaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattcaccgactgtttcagatttcattggacatgtcactagcatgctttcattgtgttgtcatacaggtttccgaagtcatcatcatctgatgtagagcctacagcatctaaaaacatgaaatcgagtcctaatgaggttctgcaatttgctgaaacctgagctgctctgccgagccatctggcagggatctggggcaacagcgaccatggggaaacggccctcattgtctattctgcataatccactttggggattgtc

SEQ ID NO: 14121 - DNA, 22823 bp, Human
caacacaaaatcacctagcaacacatttctcagaatgtatctgtcattaagtgacacgtgactatttgcactgttgacctcaagtacacaaatagatcagacaagtggagaaagacctcattctacttcattctaatttaaatgcaggtgctgtccgtagttaggaaaatgtgaaggagcaatcagcctccagtgatattcaagtctaattaaaaattcttcttggactgtttagttcaaagctccctcttaatcttccaggagcttaatcctccacacaaagtatatgaagacacaaaaatgtagaaagtatgtgaaatagctattatttaagtgtggaatattaattttgttgtaaggaggggatttattcactgaaataaactttattaatttgactcatcgccacagaagtcacgtaggctcctctctgagtcagaaaatgtcaagagctttctgtctatttttcctctttagggactgcttgagtacagcaaaaggaggggccagcagatttcagttcaagcatgtttgaagcctgttttccgacattatttgtagaacaaaaaataaacatagtaaaatctccactacaaatgatctctataaagtgtaataacatgatttaagtttatgtattattttctatattttataaattgctgcattgaacagctttaataaaaaaaattaaagttagccttgaaaatttttttggttgttgtttgttttaatttacagacatgatagtaccttttagctgttcctatacttgagtagcaatcaatttgggtgtaaaatattagggtcataatgttctttatacctcatcccactctctcatggtatttgttactcagagaagaaatctgagtcctgattatttcaattcctttgaagaaaccaagttacttttttgtttatttagcagtaggaatctttttatttaaatttaaaaattttcacctggaaacttcctattctaggtctcactttgtgaattttttccttgcccatgttgaactctcaacctccaattttagatttcttctcagacctggaaagcatattttttaagataaaatttttaatcttgcttgtgatccaccattccattttatgctttaaggacatctctgatttgtagattggaattctgtgatttgtcctcccttaaatttctgagctcttctaaatgtctttattcatttcacatttgggaatatttctgaagtgaatcctctccattattgatttgattttcacactgtcaaatctgtcttttcttgcttctagtacaaaacctgctggattttttcttcttgcttcagcgtcttgaaccaagtttcctttttaaatctaagtctgttcttgttgggtggtggcagtgtcctctcaaattgtttctggggtccctacacccccgtgagctcccaggccatgtctgtggcaatgctgaaggacaaatgcagggtgtggccctcctggtgatgaagaggaggtgcaccccaggtcaccagaagccaagagaacccacggggctgagcagggcaggatgaagcaacatgttctcacaaaaaccctgaagatgagatacgattgtcgcagcctctccctatgtgggcctgactctcttcactacactaaactggatgtgaatggagagggggcctctggagagcaaagggccctctgttccccttcctaatatgaatgccttactttgatttacattcaagtatcattctcccttagattttgtaaggttgaaaggtaattgtcattattaccacagaaaggaaaactggagttcaaagaaacttaactgagaagtgagtcttggtctctgtattattgtgttgatgtcaggagtcagagcaactggtgatgaaacagaacccaaactcagtgactcccaggaatggcctcatatcctgttgtgcaactttccgaagcctctaggtcattgtggtgccttgtagctgtcccgggagccctcagcagcagttggagctggtgcacaggaaggatgaggaagaccaggctctgggggctgctgtggatgctctttgtctcaggtaagacaaggaagaggactgagcaggggaggcgtttggtccaggatctcggggagcccttttctgttgaagcttcagagcacagggccatccaagatagagccaaccagtagttatggcagaccgtgctgctctacccagaattgggagaacatgcagtgtctgcacacaaaagtaaaagaaggagagagtcagggaaaaaagatgtctgtgcatgtcgatgttgttagagacatgcaaagcctagtatgggaataatgatagagtagatctcatcatggcatgatctacaataagtttatttgatgttgaaatttttttcttatattccatcatgatgtgtttgatgttgacaatctgttaaacccaaaagacagaattgatttaacaaatatttcccaggggtctactatgggacagcaaatatactactgctgaggacacagacgtgaccagaagaggctggtgctcattttggtggaggtgatcatcccagctctccatggcacgctggggttggagggcacagttgctgaggctcagcagagccggcgcatgccccagctctttcttgtgtctcctcttacgatccgcacagctcacatctgcacccaaaccagaagcatgcgggctttattcactcctcctcctaatccttatgaataacaggaggaaagtgtcaatatgagttaaaagcgaggcttgccttgggaaggcatgaaaaatcagggagaggtatcctcctgggctctctactttgagcaaagtcatggacaactgccttgaagagcctgtgctcagacattgctctgggtcttcttggagctggggtgataatctagatgggcagaagggagttagctcctcatggacaagtgcatttccttgtgtttgattcatgtttttctgaaggagaactgggagatggcagagggctgaaggttatgtacctgtgtgagagaaaaccagtggtatatatttcattgtgccctgtggggataggttaggggttaacctcaatgctccttgcaactggatacttattcacacttgggccaggacttctctaatccctatcagactgtgttggaccatgtagctcagtgctttaggtggaaccagagtccttgggtttgaatcctggctctagtacttaactatggtgagactttgggcaaatcacttaatctgtctgtgcctcagtttccttatctataaaatggggagaataatggtgtcaactttttactttataaagattaaataagatagtctttaaaaacccttagcacataatacttaataggtagtatttgctacccttttaattaacatattcaaaggaattcccttcttgcaattgtgcacagacagctcagcagccttcatttcttattgtctccttccttctgtgagagacaggcaagtttgcaaactcagtcacctgtaactcccaccttccctggggagctggcaaataaaagagatttatctgtaacattaacttcagaggttagggcttcagtggtggcaacttgaggatggagtctgtgtgtcttccaaagagcccagcacagtgcctatgatagagaagtctcccagccagtctgatgagtgagtgaacaaatgagggaaccaggcttggtttcagacaacactcagcctctggtcaacagtctcttggaggcacattcctgactggagtgtgtgggagttgcccaagaggtctgtttccgaggtttccctagaaactggagtctgctcccagaagaactggctttcaagactgatttcacctttaaactccttgtgagtccctgagttgagtcttcctaaggtcaggcagatctgttggcctatcctggggtgggcatgccagggggctccatgaaagggtaagcacttgtcatttttcaccaggcctgcaaggacctaagtgtgtggtattaataacagcagtactagtgttaccgtgacccacacagtagacccagcagcactgtctagcctgttatttggtgctccatgggggaaggtaccccaggcctgagtgggtaagctacagtctctcagcaaacttagagagccctgtgtgtccagctgaaaacacggaccttggtcttctcacttccgctctgcttggcctcccatcagcaaggctcccttggacaaggccagatgagcatccccaattctagatggttaacccagttcggactccaagaatgtgatggaaactattgtcactgtaacccaggggttctcaaacatggcactattgacatttggggtgggatgattctttgttgtgggggctgtcctgtgcactgtagattgcttagcctggtatccattagatgttagtagcatccacccctctccctggttataacaaccaaaaatgtctagatattgtccagtgtttcagggagagttgtggcggggagcaaaaattgctccccagtggagaaccactgctgtgactccgtgacatcaaaaataggagggggcatttcttggctcaggtaactgggaagtacaaggggtgctcctttggagcacagctgagtccatgactcagataacgtgggtttttttctctctttctttctctcccctccactatccccctcttccttcctcccactcactttctgcctgtttagccattctcgggcagcctattcctacgtggtagaaagtttcacataataaagtttcacatctcattgacctgtgaatcccagcaagaagcatttccattaatggctacagcagtctcagggaggactctgattggtccagctcagccatgtgctccttcctaaaccaatcagcctggcagggagatggggtactttgtgtatgtgtgtgtgtgtgtgtgtgtgtttttttttaacagagtcttgccctgtggcccaggctggagtgcagtgttgtgatcttggctcactgtaacctccacctcccgggttcaagtgattctcccacctcagcctcccatgtatctgggactacaggtgtgcaccaccatgcctggctaatttttttgtatttttagtagaggcaaggtttcaccatgttggccaggctggtctcgaactcccgacctcaggtgatctgacctcctcatcctcccaaagtgtgggattacatgcgtgagccactgtgcctggccccgagatggggtacttggattggcaaatcctgtgtcctgtgcccatccttgagaatgtgggctgccccaacagtagagccacacaggatcgttcccttggaaaggggtgctctgctacccaaggaagggaaaaaggagtgccaggcagtcagatatccatgcccatcatgccctccagacggcttcctcactgtttgtccaaaggtcttttgagctgatctccttgccctgacttagatgaagttcctcaaggtgtccttggagccactctctgctagcaccgtgtctttgcgttcactttttatgtcatacgcccttgtaatcgatccctcccaccatgctgcagccactcgtggtcttagtacaatatcccatgttctgtctccaggcaggcagtttcttcctctcaaagtcagtcttcctcttctgatcatttatgaaatttgatcctcatgcaccatatgcagtctcttatagtaaaaaacctactcacagtggaaagatctgaggtctagtgctggcttgcagggcaagttgtattttctctggaggcctcaagaacctcatctgaaatatgggtggttggacaagaaaaacagggggctcctctcctttttccccactcagagagagaaaaataattcctcacagaacccattctctttccctgcttatagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtgagtggcctgggacttggggggaaagaagggccaggtgaggaaaggggcagtggtggtagcatcagcagagctggggttcaggattcccagcagtctgtcttcctcccaggacctctttatctctcatctaaggtccagtagtaagtagaaccttccatgcatgagattctccttggatagcacagcctaattttgggtgctgtggtaggaattggggtacaattaaggtgagtggtagatttgggataatttagtcccattctttgttctccacttagaagtcatgtcctgactccccctcccaaggatgcgtttggtggcatgcctgtgtgcttctgaagcagcccctctcacatctttctgtgggcacagaccacctggggatcttatttcaaatgcacactccaactgaatgggtacaggggtctgcatctctattgatctcccaggtgatgccaatgctgatggtccatggctcccattttgggggagcaagtctccagagctcattttgtgtccccttgtacacaactctactcactggataggagaggggggtttacttatctgtaccctattcatttcagaactgcttgagggaagcacctgtgccttcctgggctctgcacccctagcaaataatgtagtttctgacacaaagtaggccctcaggagatgttgcattaaggaatgaattatggaagacagaggaaagggaagcaggctcaagttcccagcacctggggaattctaagcctgaggaagacaaggtgcacacacaatatattaataaaagataacttttaaagcaatatgccataagccaggtgaacgaaaggcagagtgaatcaagtaagcctggaattattcttggagaaggttggggcacaagaattggtgaagaacagaaggcaagttcatttccaacagtacgaatgacaaaaaattcctttcttcttctctctttctgctctccctcacttcctgccctttttttcttctttccttttttcgatttctgactcaggttgactccacagtatttctttggctttagcaaaggaaaactttgcatttgggccatgctcatttccctcctcagcttcatttaccgtaccacctacccgtccatcaactcatccacattttcatccatacatccatacatccattcacccacccatccacccattcatcatccatctgtccatccatccatccaatgtgtcttcttgcaggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcaggtatagtttccaggtccctgggcccctggtttggacactgagccctttgtttcccagtctgtgtgctgagaggatgtgaaagtgagggaaaggggagggtggggcaggagaagacttgagtcacattagtctgggtagaaatgtccaggggaagaaggaagtggtgatggagaataggggaggctctcagccaggctgtccttctccccagttcaccttctttgtttccttgcaacctgagtattaaagagagggaaatggcatcttccccaagttccagtggagctcatccaaccccaggggcctgatgggcagtgggaaagcactctgagtgaggggccctggatctagtgttggcctgactaactgaatgtgactttgggtgagtcaggaaccctctctggctttagcttctttgacaattcagtaggcatggtagaaacccaaagctggaagacattgtccacctaataactctcagcaggagctggagctggggctaaatgcagtattggtttttgccttattgttttttaaataacattgttgcatgtgcccaattatagataaatagaatcagaatttttgcagatgaggtccctctcagtatttttaataagatgtttaggagatttctaatgtgtaggcaaacttaagaaccactaacttagcaatttcacacctctttacagttattaaatgttgatttatattagaatgtgtttatcattaaatactgaattatcaggatggaaatacttttccacatcaccactagtctaacatgtcttttttctcatattctcttctagtctttattcatgtttatacatattttaatatggcagtaagtctaattatacatgtttttattcttttccttgctgaaattattctttgatgctgctacctaaatttcataaatataatttcaatgagtgcatatttttctatcaattgggaaagccataacttacataaccattggcctgttcttagacattgatatagtgttgataactctgagataaacatattcttgcagatatatttttcttcttttaaataattaactcgaaatttccatgagataatttaaacactgatatcattttgtatacaaatagcatctaccaatggtcttccaaaagattggaaacaatttgcagtgtgatccattaagcataaataaagcagtgtcatggcaggcttacagacacggatttagtcttttaaatcattaaatagtgtgagttaaatcacattcctgctaaaacaaatgtgaactggtgcctgctctaatttctctatgagtgtagactccacctccatatgggtagtggcagtgcctttttccccattatgttgtttggggaacaaagtgctcattaaacttctgtggaataaatcaaacgaatgatctactaagagtcaatttttttttttcctctactttcattttgcaatacataagttaagagaacataatctttgcccatattcttacttttaccggaaggagggccttaagtgtaagctgtccaggttctgggccttttaatcaaagtattggagaagacgcacaaagtaacaaaggaatgaagcagtgaaagcaggaatttatttaagcgagaaagcgctccccagggtagaagtggccccacgcaagtggctcaagggccaagttacaaagttttctgggttttaagtactccacgtgaagttcctcccagttaccccttatctggatgaagcatttggtttgtggctaactaaaggctaaggtgaattggcgccctctgtgggtaaagggatggtcgtctctgcttggctcagggccaatctaagacactctccctttccagctgagacgtggtggaagggggagggctgtagggagagtagcctttgattctttgctgctggggcatggggagatggggtttttccttttgttttagctttagaaagtttatgttaattggccttaggttccctgaccccagccccaggagttttccttttgatccagctatgggaagtcagcacgaatccatcctagatttcttgcccctagaccttggtgttgctccatgattcagcatgaattggtcttacgttcctgcctccagaccctattctcctgccttgctgctagagactgcatctctcttttatctgttaactttatctatcatctaatatgaactatcctttcagccaaagtccagtctggaaagtggaatccacactagctgtttgaaaagaagaagctttttttctttttcttttctttttttttttgagacacggtctcactctgtcaatcaggctggagtggagtggcacgatcatggctcactgtagcctcaacctcctcccacctttgcctcccaagtagctgggaccacaggtgcataccaccaggacagctaatactttttattatttttgtagagatgggggtctccctgtgttgcccaggctgatctcgaattcttgggatcaagtgatcctcccacctcggcctcccaaagtgctgggattacaagtgtgagccaccacatccagccatgaaacgaaggaatttaatgcagggaattgtttgcccaggtgatggaagagctgagacgctatcctggggatggagaggcactgcagaggtagccactatcaccctatctctaggtagtttccccagaagcaagctgtaaagtcttgttaaaatgttttaggactaggtgttgtggctcacacatataatcccagcactttggcaggctgaggtgggagaatcacttgagcccaggaatttgagattagcttgggcaacatagcaagactccgtctttacaaaaaaataataaaaaaattagcagggcatggtggcatgcacccatggtcccagctactcgggaggctgaggcaggaggatcacttgagcctgggagatcaaggcttcagtgagctgtgatcaagccactgtactccagcctgggcaacagagcaagatcctgctctctttctctctaaaaaaaaaaaaaaaaaaaaaagacaaaaagaaaaatgttttaggaagtgatttctggcaaagccattgaggaagtgggaccaggaagggaaggaagccaagcaagcgtgtcataaccaaggggtatctcacaggataactctggctcagtcttgttaaggagctctggggactcctgggtcacatttggagttgtccctataaggggcagtaactgagcaagggcagctctaaccaaggccaagcacatgaattcctggcccttcagggggttggtagcttgtgtgcagcctcgaaaaaaatgcagatggtggcctgttgggagtggacatgccccaggagttcagcataggaaaatggtaaagcactcagagtggataatgcagagcactggcaggagagacttggggaggaggtgcagtgagcagagcccggaagccaggacattcaggttgcagcactggaatcggggcagatgctgaggatgctgagtgcaccaccatgtgaggggtgagagagatgctggctccctgccccttgctgcctgtctctctgccccatccctgcccccgtctctgccccctgtcccccaccagttgctgaactcgaccagtcaggcttgggaatgtagtcccctgtgctacaagtcagggcccttgaatgggggtggatttcaggcaaataggcagttttctgctttctagctcctttacgccgtttccctctttgctagtttgtgcatgtggttttaagttttgtataggtgggtgtgttgattttaaatcaattgctttgctttattccttaatgtgtttgattctatttcctggtgacttttcttggattgttttttttttattttatttaaatgtttagtccgggggaagatttattctgctacatgctataaactgtagaaaagcctacaccgttaccatgttgctgtccagatactgcaagactatttactaaatgatcctcctgcctctccaagtagctgggaccatgggtgcatgctaccacgtccggcttatccactggacctctgatttccttagacattatgttcctgcatagcactggctctgcatctggcctttgtgttccattgccatctgtctgtccctgtgtcttaccatgccacatccttgtgctctcatctgcttgcatgtctgctgatggaactggccaagtgccctcactcctttgcatctttttattatgatacctattgatgtttacccagaaaccttagaatcatttcgccaaaatctataaaattcatgatgagattttcactacgggtggattcttctcggtttataggtgaggaaaccgagctaaagaggtgagatgaccatcccagtaggcagggtacggtactgagaatagagagcgggtttcctggccagagtcctctctccctaccacatcacagggaggaggatgggctgatcagcccgactgtctccctccagtgcctctcctggacagggacctatactctccactgaattgtttctaatcagtagtttttggcaatgagacagactgaaaagcacagggtcaggcagtgcgggaaaggtggagcaaggatctaagcagaggagagtgggacatgaaggcattttctagagggaacatgtgcgtgtgggagagactttgccagcagtagcgttcagcctcttgtctcccgcagggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccggctatttctaaagtcagcgtctcaccttcctgcccactgccctcgttcctctaataatcttgggtgggcatttgtgcctcagaaaagaagttacagccccaaacatgcttggtccttcattccaccagccacttggggttggcatgaaatacagacagctcaatgcttttcaccgtaattctcttgtgggggctgtgacatgcagaaggcacacctgatacttctcctgctcagttttgccctggaccatacaattttggcctgacctggacagagctcccactacagaagcatcctgctcgccccatgctgggacttcctctttctagcatcagacacttgggtttcatgcttatgtgtggttctttccaacactcccagaaaagggtgttgaagattgtggaacctggagaaataagacatcgtggtgagaaagtgcatccttctcagagaaaagagttaaactgagtatcttcttctggggaaatactggcaggccgagatgggatccataggagagcaacaacagaccatgtcagacatcctgtgtgcatttatcgctggatcctgaaaatagccccgtgaaggcagaaatgtatgtgactagaacgaggccacatgaataagccactgcccactggcaggagtgaaaactgaagcgctccttacctgaaggaccccaaaaccatatagaatagaataaccaggagttccgcctgtgtctaaatgcctcttttcctgtatcacacaagggtcagggatggtggagtaaaagctctccccctgggaggcttctggaggctgtccccatgtgcttgcctagttccccactctgccctcctcctcttctctcagtctgctcctggaacacctgcctcagtttccatgctctctccagtgccctccccggtgaagcaggtaggtgttcaggccaccacagagacaatctctgtgggagattgtcttgcaatctcccacagatttcaatcaggattttgttatttcctactttgagctttaaagggaaatgggcctcatgggtggggaaaggatggtgggtccttccagcccaatttagtgatgcccagggcagatattatcctcagttcccaagagcaatcatacttttccacacataccgtgtgtctcatgttaggtaaatgtatttttacaatgagcaccacttctgtggaaaaagttccctgcacggggaggtccagcttccagactgctccatcgcataaggacttccccattcccctaaatgctgctctgtcagaacctgcccaggtaatggtaatgaccctagagagatgatttctgaaccgcaattttgagcccattagaaggtgtgtggtgggcatttatttcatcctgatgctctggtgagaatctttgcagacgcactagatccagaagctgttaatcttggtgcatttattttcctacctaaaagaaccaagcagctcagaggcagtgactgtacaggatgcagtgtttataataatgctgagcttgctggtctggaaccccacacttcagcaatcccagcattgttcctgtttatgaagttgacaaagtgaccagggcaagggggtattatcattaaatacactctaggagaggcagaacacatgagggcaatgtttttcagaggtctttaggccaccgcatcagattctcctggagcataaagcaaatgctttatgagtccagggcccctgcagacctactgtatactagtatacagctccctcttagtggatctcaagcttgtttccaaaaagtcattacactccttaccaaagcccatgacacattcatacagattcatccagacataacccactgcatggtccagtgcatgcttgtgtgcttaacttattatagatcaagtgttatttaagtccaacatattaaacgtgactgaaatattatatgcactaaatcggaagacaaatggccgtgctggatactctcccatttgcacttacaggccacgccatgctccatcctccccatcctgcctgggaacctgaccaatgtggctaaaccagcaggctccctggctgccagcttctggctggttgagccaatgggaagcatgagaggagagccgagggtggggagacagtcagatcagggtttctgtcctcagggctccctccctggcaggtggtggcaggagtggctgcattcccctctgaaggctccttcaagcctctcagcaaacagctcccatctccaagtccagccacctgttccatcctctcctctgtaggcccagcagtgggaatgacccaccactattgccagcctcagcatactgaagcaccccttactggattccctaaattctatgcacatgtttattaaatgctcctcaattacccagtttcaatgagccagcggtgtcttgctgttatcttgactgatacaatagtgttgtgtggctaacgacacaggtcttggaggaaaaccatgtatgggtttgaatctagctctgcatccttgcagggtgtctgatcctgggtgactcagttaaccttctgggcttcaatattcctccttgccttaatgggcatgatagtgcctaaccatgccagtgatgattttggatgctaacaacagaatccaactctggctatctaaaacagcaagggaattctagggggatatcagtaactcagagttgatgagaggctgggggattgggtttagaaaatgggcagaagccaagagagaatggacagcagaggccacatgagacagtctggacatgttgccatcaatgccactgccctggatactggaggccaccatgctattcctagactctgaatccttaaattgcctctgagtaagtaatctgcaactggccctgcatttgagcctcatccgcagatctggggtcctgggcagaatcatgcatgtggccaggcttaggtcaagtcacgtgcctgcagcacagctgccgggagaagggtgggaggaatagctgcttccatcctcaatagaaggggaagcagaactctgcatctggtgaaactcacacattggggcctgtccccccaaaagaaaaaggtgtttggtactggagagtcaaaagatgacacacctccattataccatctcccaatgttgacaggatccaaggagacgcctgagtaaagcacctgacacacagtaggacttcaatccatggtggttactgctattactgttataactggggtctccatgcctgtgcctggacaggttagctcagggaagcccatacctggtactcaggcaaagcccctgagtcaccgagacatgctgcagggtccatcttacctatatgcagctcttgcagacatggtcaacttggactccttgcctcagaaccacctaagctgttgctaaaatacagattcctgggtcccttcccagatctgccaagtcagaatatctggtggtggagcctgggtgtgtatgtctgccacacttcctgagtgaagccacgtgcctgtccttgggaaccatggtgcggggtgatattaaagagggaggatgtagcagaaaggcttgaacccggccttgggggatgaacaatgtttgtttgcgcagcaccatttcacagggagactggggtgcaggcttgcgggttgtaggggtcagtggtcagtgatgaggaggttggtggcctgaaggggtgagtgacgcagtggggacatcaggtgggtgggtctagactcaccatggtgcagaaagggaagcaactgagtgttcccatcaggactgtgacatcatgatggcaggaaggaagctgtcacaagggtggccagcctgcccctctttttctgcatcttcctgagctgttccccgagtcacacttcccccaaggtttgtcaattgtaaagtagccacccagcctcgtggggagatggtgaccgcgtatgtggggcaacatcctgcagcaactacaagaggccctgggccagccggcagacagcacatctgggtggcagatagagtggagggggcagggctctgagggtggccctggctgctgctgctgctgctcctgctgctgcaggtaaggagagtgggtaagcaggctggggaagaggggaccagggagagggatgtagacagcccagcagaagtgcccactaatgggagtttcctcttatatctttgggatggactggaatgggatcaggtaatgtggtacaaatgggaaagggaaaggaggcaatgcatgcagacggtgcttgtccagcctgacccaggagggactgggcgatgaaacagaagctggaggtccctctactgcatcttgaagttgagagaattaggtggattcagcagagcaatcccccagcactgtgctgatatcctgggagatgtaaagaaaagcgagacagagtctccccttaaaaaagcattcactcactgtgcagaggaggcgttagtagagcaaaaggtaaataacagcaaaaagacaggcagtaacatgaaaacaaaacttctgtggaagtcactctagcagggcacagaagggaatgtggagaagaagacaagagttctggaatcagacagggctggggcaaatcctgtctcagccacactctatgtatgtgaccttgagtaaggtttctaacctctattaggctcagtttcctcattgtaaatggaaccgactcacaggtatcagagggttgtcttaagaattaaacagtggatgtatggaaagcccttggctcagtatttagggcctaataagtgcttaataaatgttatgatgggagatgatgatgatggaaccaggtgtagggtgatccgtgatatttagggtgaagaggaggtagagactagtgccagctacaactgttcaggttgactgccctctgggaccaaatgggaatatccatcccatttgggagaaaacagagaagaatgggaagagcatctgtcttggggacaccaggagctaatacaaagagctgtgtgaggccaagtgctatggctcgcacctgtaatcccaacactttgggaggctgaggtgagaggatggcttgagcccaggagttcgagaccagtctgggcaacatagtgagatccctgtttctagaaagaacaaaaagttagctggacatggtggcacacgcctgtagtcccagctatgtggtgggggctgagatgggaggatcacttgaacccagaaggtcaagactgcagtgattgcaccactgcactccagcctgtgtgacagagcaagactctgtctcaaaaaacaaagacaaaaacaaaagaactgtgtaccagaaagcaaaagccatgcctgggccaccatatgtggaatagaaaatgggtggtaaatctggtgaagttcttttgtacctttttatgatgaacattttccagtctacgaaatgtagaaagagtagtcacagtcaactcatcacgtagattcaaacttcaaccatgatggatatttgccttatttgctccatatgggtaggaatcttgctaagatatatatatattatataatatcatatatatgtgcaaacagacacatatatgattgcagaactatttaaaaataatcacagaaatacttaatcactcctacatgcttgacagaggagctaggaatactctttgtctgtggcgctgtgtctgtgttgtggtctgaggttggggatgcagaggtgagagaagaaatcatgtttgctcagtgaagtgcttgacttgtcattcccagattccaagctgtaggtgacatggaggagcaaatgtgcctgctagaaggacagaatctgaccatggcctgttcttacaacatcatgaaatatgcctccagcctgaaggcctggcagtggggttggagccagggtcccccagagactctggtgctcatggagactagaaacaaagacctaaactgggcctgggctgggaggtacctgctggaggattatcccacggaagctataatcagggtcgtggtgatagggctctggaggcaggacttgaggcgtattagtgcatgacccacctgtctcctcaggtcccctttgtcctgcaccatcggatttggctggtattggtgcaaaggtgagcagctgcaggattcaggtcatggaagggtctccttaggcacagccaatgagctggaccccatctgcccattcatgaggggctgtttggagggcagcacagagcaatgggaaaagttgcaggcctgaaaccaggggacctgggtcttccattctcttgctttgtgacttttttgagaaagtcaatagcttctctctgggcctctgttttctcacctgtaagacaaggatgttggactaggtaatataaaaaattatcttaccctgtggcagagggccgctagagaaactggttaattgaacatgtgctatgagccaagcatgtaccttgttaatctctttactctgaaataagtgctgctgtcttcactgcagaagagaagactcaaagagattaagttattcactatgtcattctgcagataagtggtgcagctgggacttacaggaacccatctgatttcatcatacctggtgaatcaatgaaatgggccccgtttggtcaatgaaaagctgttcctcttctcaggaatttcaatagcagtagatgaggcacagttattagggaggaaaatgaaggacattttggtgaccttcggttgcttctcattggtggaaacactgccaattccccctcctcctttgttagcaagccttcctgcctacatggggaggtggaactgggatggtggagctcagtgcttttgcctcaagtttttctataaaactcttttcaagctagtgaatttgagaggcctccattaattagcagaggacattgctcttctgctatttgaatatatgctaatctgaatatgtgaatatcaggacaggctggggctgaagtcagacttcatagcatctgcaaataaacagttgaccaagcaaagggacagagccatgggcaggatggttggaatctactgaacccatgtaatagaataaaataacttcccggttcttgagaaacatccaaggatacccggtcactgacaggctgattacaaatcaatgatgcaattggtcaagcaggtccatcacccactgctcctgactcaggagcattttattaatttggtcttattgcctctttgttacataaatactaaaacttcagtcctttgcaaaggtaagggcagccatcacagggcaatagaagattgtggattcttggtccctctctgccttgatcatacttagtgaccttggggaagtgcctcacccttttctaggcctcagtaaacccctggcagtggggcttcccctctgtgacattcagtggctccaaccttttgggtttgttgatctttattgagttcagggaaataaaggcctatatttcacatgtagcaaagttggcccaattcaggcaccagtggatggcttggtccttctggtatgaatccatcattggagttctgcccagttctttaatttaagtcttaaaaaagacaagagaaatggttgagaaagactgagcgcatactgttaaatgagaactgtatcaagtttaataaggatacgcttaaacataattatcttcattgaaccataaataacaggcagtgccattttgatagcagcttcgtattccttctctccaggaactggagaaaacttgaggctaatctagccagagaagcagcatcccgtacagattgttcttgtctaagggaatttctgatgttgcagagggaccataaaggatgccaagtgaaacgtccttgcctatctcctgtatgggctccctgacccaatcatttcccccgcttgaatttgcagggaaaagagcatgacatttggcatcagaaggctggatgtggaatcccatcctctcccaccactgcacactgggcactttcggataagtcagttcttctcccaggctggaactcaatccttgcattcatgttataaaggaaaacctacgccctgaaagatggcaaggtcaactgtaagcaaacaaaaatgcaaacatgctgtgtttttgttttagctttagcttttgtcttatttttttcacaaaagatcttcatgtaaccaaactgagttgacagactccttatttcatggcccactttaaaggaaacactttaccactcatttggtttcatgtgtttttttaatgtgtatttttatgtatagagatggagtcttgctatgttacccaggctggtcttgaactcctgggctcaagtgatcctccctccttggcctcccaaagtgctaagattatagccatgaactaccactcctagcttaatgtgtgtgttttttttaatctttactaccttcatcctgagctgcactgcctacccttccctcataggcatcttcttaataatcatatttcatattttccatgtctatttgcatgcatgtagattcttgaaaatatatagaattgattttgtgtgcttttgttttttacacatttcactctgttgtagaaaaaaatctgcaattaaactgaaacttctgcattatctattgcactctcttctttatgttatctggtaatcattttgtgagagaagtctaactttcacaaaggcaggttattgatagacaagcaaactctgccctgtcttccttcccctgctgagagggaaaagcaaaccccaaactgatatgcttccacgtacaattcatttcaatattcctttacttcatatacatttgtgccttttgacttccatttttaaactggtataacatcttctcaaataaattatgtattatgagttaaataaaatttttagcatgtgtttatttttgtctcatggtttaagctttttttttgaaaattataactctagttatatgttttcagatagcattgtgcttctgagactatccgttgttgctatatgtaaatctaaatcttcaatttttggctgctaggtaggatttcatataatgtaggggcagtattggatttcatttttctgttccccctagtgatgggaacctaagttgcttcaactctttactaccacaaaacaacacaagcatacaaacagaaaaacaagcaaacaaaatacctcaaaataaacacttccattcatgctcttgaaggagccatataagaattttttaaactacatgttaagttggcattaagccaaatagaaaataggaacaaaatagagggtttaggaacatacccacacatagacagtcacttgactgccactaaagggcctctgcaatttagtgtggaaaagatgttgtttctatcaaagggtaatgatcagttggatacccacccagaaaacaaaataggtttttaactctttcacactgcacatgaaattaattgaaaatgcatcatagacctaaatataaaaggtgaaaacaatatagtttctggaagaaaatgtagaaaaaatgaccttggagaagtcaaatattttctaaacaggacgtaaaaaatagtatgcataacagagcataagtcagggatggaacattgagcatgggatagccacatatttatgccacagaggctccagattgttctccagaatgttgggtcatgttgcattccccccagcagggctcaaggatccccctttcctccactctcaccaactcctagtgtcatccaccttccatgtgctcaccattcagatgagttcaaagtgacagttccatgttttaaaattagtatttctctaactaacacgatcaaacatctgtttatgagtttcttgggcatatagttttttactgcaatgtataacctatttctaaccattttctatttggcttccttccttccgcttgttgatttttaatcagcccttggttagtttagatgttgaaattatttgtataaattcacaggatacaaatgcaatttcattacatgcacgaattgcaaagtgtccaagtaagggtttttagggtatccatcacctgaatgatgtacattataccattaagcaatttatcatcatccaccccacccccatcccctcactcttctgagtctctattgtctattattctactctctatgttcatgtgt

SEQ ID NO: 14122 - DNA, 6320 bp, Human
gagacggggtttcaccatgttggccaagctggtctcgaactcctgacctcaggtgatctgcctgcctcggccttccaaagtgctgggcttacaggcatgggccaccgtgcccagccgtttatatgtattaactcttaatcatcaaaacaaactatgtggtattaccataattatcgccatttatacaaagcaacagagggataaggagattaaggcacttgcccaagtgcaagaggtaggacaggaacccagagtcccgtgctggtagctgcttttctgtgcacttaacattatctcatttaattcttgcagtcacttcatgaagaaggtggcggtcctagggcattggagaagttatgtgcttgttcaaggtcatgcagctggaagatggtggtggtaggacaggaagtctgtagggcctgattctgcagccctctagtctatactcctttgctcctgtgtccctcatcccccctgcagaatgggcaccccgttacctttctgagccactgtgcgcagaaaagagagcatgttggccaggctggtctcgaactcctgacctcaagtgatcagcctgccttagcctcccaaagtcctgggattacaggcgtgaaccaccacgctcagcctctgaatactttgtactcaagccatttttcagtgctgtgtttgcagtgagcacacccgagggatgaagacacgtctccctgtgggaacctgggcttaccagggcccctagaggaggggaatctctcaagctcagagctctatggctgcggtgcaggcccactgtgtgcatggtgtcagtctgggcccttccatgttgcccccgtgggacttggggtaaggggaactgatgcaaacatcacgctgctgttgcttggtgtgagcaattaattcctgtggctctcacccaggagtctcatgtctttgggtcagacaaactcatcagcttgtagaaatggcacagtcccacgggcctgttagaatcttctattgtgcacatgttgctcttaaaatatacaaatcagttttgattttaaaaaattatttatttttttagtgataggagttttgctacgttgcccaggctggtttcaaactcttgggctcaggaggtcctcccactttggcctggactgccagcataatgtatcaccacacccgggactgattttcgtttttcaagaacaaaaaccaaaaacatacacaaaccgagagtcaaagcttgctaattagaggaaagtcaggaaatgggaaccattcaaagaagaaaatacccccacctcctactctcacctatccaaagacaattaggtgaatcccttagtagatatctttccagacggttttccatatagattcccatatctggccaggcgcggtggctcacacctgtaatcctagcgcttggggaggctgaggcggatggaccacctgaggtcaggagttcgagaccagcctgaccaacatggagaaacctcgtctctacgaaaaatacaaaattagccgggcacagtggtgcaagcctgtaatcccagctactcaggaggccgaggcaggagaattgcttgaacctaggaggcagacattgtgctgagccgagccaagatcatgccattgcactaaactccgccttaaaaaaaaaaaaaaagattcccacatctttactagtttgcagaaataagatcctagcatatgcagtgtgtaggaaccaccttggtttagccacgtctctgtgactgggggccactgtggtgacccccagctccccggacagagtcaagagctcaccagcctgcaaaggttttcacggcccccagccagactcgggggcttcctcttgccctgctacttcctgggagctctgagggcaggaaatggcgccactcagctcctggcctaacagcttggggaccacaaatgcaaaggaaaccaccctcccctcccacctcctcctctgcacccttgagttctcaggctcacattcccaccacccacctctgagcccagccctccctagcatcaccacttccatcccattcctcagccaagagccaggaatcctgattccagatcccacgcttccctgcctccctcaggtgagccccagacccccaggcaccccgctggcccctgaaggagcaggtgatggtgctgtcttcgcccagcagctgtgggagcaggcgggtggggcaggatggaggggtgggtggggtgggtggagccagggcccacttcctttccccttggggccctgtccttcccagtcttgccccagcctcgggaggtggtggagtgacctggccccagtgctgcgtccttatcagccgagccggtaagagggtgagacttggtggggtaggggcctcagtgggcctgggaatgtgcctgtggcttgaaaagactctgacaggttatgatgggaagagattgggagccattgggctgcacagggtcagggaaggccaggaggggctggtcactgctggaatctaagctgctgaggctggagggagcctcaggatggggctgatgggggagctgccagcatctgttcctctgtcatttctgataacagtaaaagccagcatggaaaaaaccgttaaaccgcaggttgggcctggccgttggcagggaagtgggcagaggggaggcccggccaggtcctccggcaactcccgcgtgttctgcttctccggctgcccacctgcaggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccctatttatctccatcaccatttccccctctttcttgttcctggaaacggctgctgagtctccatcggccaaacttatctgccctgtgatttctttgacaattctccttttcccccagaacccaccctgggttgaccagagtctgggaagaaggacaagagaacccggcaaactccctcctaggattaactttgtaaagcacccttgccctgtagctgcaagggctgtggaacctgggcagcccgcaaccacctttagctctgggccccccaggccagcctggagcatggctgggtggggccaccagcccatgctctcaggcgggcctgtgatctttcccagggcacatggactgtaggctggccctggcccacaccaccacactctccccagccatggacagaggcagccagaggcctcacggtttctcctccgagtttctggctgggtgtagttctcagaaaccccagtgcctgcgtgtgtccactcgtgggtgtggtttgtgtgcaagagctgaggatttggcgatgcttgggaggggtagttgtgggtacagacggtgtgggggtgggaagtggtgcagagactgaagagggtcaacctgggcatgggggacacagggactgctgagaacgtgcgtgtcatctttgctctgatggggtggacatagcagaaaatctaactctgtctgtagccccatacagaatgccagggtgagcacagtggctggtgcctttaatcccagcactttggaaagttgaggcaggaggatcgcttgagcccaggagttcgagtctgaagtgagctgtgattgcaccactgcacttcagcctgggcaacagagtgagcccctgtctcaaaaaagaaaagaaaaagaaagccaggcttcatggaaagatcgtatgtgtgacccaaatatgagttcttcagctcagccatggtaatcccttccttgaagtctccatttctgcagtacacatgcatgtgcgctctctctctctctctcacacacacacacacacacacacacacacacgcgcgcgcgcgcgcgcgcgctctcctgcgaacagaggcagggggagaggggtttgccctggtctcggggactggtctggctggcgcttccccactgcacgtttccaggtttagtttgtctgtgtctcctcttccatcccaggggctgagccccttccatcctccaagaggaaccagtgagagtgagtgaaggaggggcctggagccagggacttcccctgtggggcctgggtggagaggggagaactcaatggtgctgcctttgagaccagcccaggctacagcccaggagcacacatgggccagggcagttggtatttcccgaggacaaagaggaaattttcaaagaggaagttgttgagttagagcttgcggtggctgagagcagacaggttgacctgcaaaaaaagacaggggaggcatgtgagtgtgacagccctgctctgtggcctgggcaggagatgggggaaagggtcaggtgggggatgggctcgtgcagtgggagaggagacggagggagggagcgggaaggggcttgcttagtgggtgggaagagctgagctcggatggaaccagcttctaccagccaggctgggcacccactgggctgcatctggtggccttttctgattgctatttggactcactgcagctgcagaatgacagaggccatgtccaaaatcccttagagacactgttgtcttagagttgttaaaataagagcccccatatcaggtttagaaaatactg

SEQ ID NO: 14123 - DNA, 40323 bp, Human
  misc_feature (1)...(40323): n = A,T,C or G
taggttttgttttttgtttttttttaatctgctaggaagtcttaaaatagaatggagaaaatgaaagactttactgatgttatctggtaagtgttagaagaggcatacatgcatcggagactggaagggaataagggaatttggaaaaaacaggctgatttttttaaatgttttaattttcatgacttataggttgatgcttagaagatctgtgtgtaggccggacatggtggctcatgtctgtaatcccagcactttgggaggccgaggcaggcggatcacctgaagtcaggagtttgagaccagcctggcaaacatggtgaaaccccatctctactaaaaatacaaaaaaactagccaggcgtggtggtgcacgcctatagttccagctactcgggaggttgaggcaggagaattgcttgaacctgggaggtggaggttacagtgagctgagatcacaccattgcactccagcctaggcgacaagagtgaaactccatctcaaaaaaaaaaaaaaagaaaagaaaagaaagaaacagaaacaggccagtcattgggaaaattttccgtttatgagtcttgagtcagaaaattggtgaaatgccctttggaagctgagtcagtgcttatgactagttttaggatatgtctgtttctgagtttctaagatccttgctggatctttgaactttgaaaaatttctcttagtccagtgatagtttcacattgatatcaacttttattaaacatttaaaattttcctaactattgtaagtagatttgggttcagctaagtacatcagtgaatcggattggtgtgtaatgaaaccataagacatgggtcccaacttcagaatgcttcacatttggttgtggaaacaggtcacatgtatcatgttaagtaatggagataaaaagtttgcaattaactttttttagtgatttctttttttttattagtgaaatttaaaatctatttccccaaagtaatctttggagttcaacctaattttagtgataatatatgtgccagatttaatgctgtttctccttcccaccgctcccgcctccccaaccccaaccttccgtacattagttgaaagggccctgcaggaaggttctgaagtcccaggcaaatgtaatagggggtaggcagaggacttacttagagagatggtggtgaaagtctcaaactgcagatttctagaacaaacaggttacttgtaagaagcagacagagatacttagatcagtaaaatacttctgtaacactagaagtgagaagacatgagaacgttatctagaaactatcaagaggaaatgactgcagaccaaaaatcctacgcatagtagtcaaataaaaaatgtcaagggaaaaaaaaaatgtttggaaaggcaaggaataccaactatagacctcaaatgctgaagaatatacttgaggtattctcccaggttaaagtcaaagcatagcatagttctaaggacaaaagaagtcaatgagcgtcgaaaacaagtgcagtttgataatcaacttgttcagtattgcaagccctcacacctacatggacagagttaatcacagtctgtgttctgcctttgtgtctctttccacctcaccccagtctaaccccatccccatctcctacacgctgcttagctgtcatttcagtggactttcaggaaggaggggaggtaaaagcatgggatcagtctaacgtcttgatttggaaaatctgtttttaaaatactgtgcttcttaccacaaaaggttgctgtgaagagttgttggtcagggcttatactgcaaacaacagaaaccagcaatggaggatttaaacaaaaaagaaatctatggacaggattctgggtgattcctaggctcctggggaaggctggagaaccctgctcagttggttggaaattggacaaaatttacttcgcagtgacagcactgtatcttcacttagaaataaattgcctttttcttcttttttcaaacataggttatatatttggggagaaccccagaagaagcatatagaatattaatctttggagagacatcctatattcctttcaggtaaatataagaatgatgtggtagattcaggtaatcagatccttgccagaaatatcttgatagttgtttctgaaaaaagaagatctggtaaatagtcattttaggatgagcgcaaataacaccacagatctgggtttttccacagtgacactgttgacgttttgtcatggaggctatcttgtgcgtcgtagcatgtttagtggcctccgtggcttctgcccactagatgctggtaaaatccccacacccactctaattgtcaaaactcagaatgtcttcagacattgccatatatccctgtaagtgaccttgggggatggagagcaaaatctccctacgctgagaactactgccattgatgaaaactaagctttggctgggcacagtggctcatgcctgtaatcccagcatattggaatgccaaggtggaatgattgcgtgagcccaggagttccagaccagcctcggcaacaaagacagaccccatctctataaaaaaattttaaaaaaaattagccaggcgtggttgcacatgcctgtagtcccagctacttgggagactgaggctggaggattgtttgagcctaggagttcgagggtgcagtgagtgagctatggtcataccccagcactcaagcctgggcaatagagagataacttgttctcaaaaaaaaaaaaaaaaaaaaaaaaaaaaaaaaaaaaaagcaaacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtctcctttcatacctttgatatttatgctaagtaatccctacgtgtattttgttgtcgtcacttgttctcgcgtcaggatacgacctgcagctcgcttgtcgattctagaggatccgtttaaagacgtggtggaccgtttattctaacatttgtggaatattcattttccccttttaagttaatgtatatacttatagtttttaacaaaaacactaatctttttttattttattttatttttttgagatgggagtctcgctctgtcaccaggctggagtgcagtggcgtgcgatcttggctcattgcaacctctgcctcccaggttcaagtgattctccttcctcagcctcccgggtagctgggactacaggtgcgcgccaccatgcccggctaatttttatgtttttagtagagacaggggttcaccatgttggccaggatggtctcaatctcttgacctcgtgatccacctgcctcggcctcccaaagtgctgggattacaggcgtgagccaccacgcccggcctcaaaaacactaatcttaagtgtacagtagtaaggttttacatgtatttatgtaactaccacacagtaagaaatattacagtgtgaagacccaaataaggtggggaattagtgatagctccaccagcaaccctgtttccccaggagcaaatgagtaccattcagataggcacagtttttctgcatgcctagcttaatcataattaaattaatttttatgttgcctaattccagaagatttcatcttgtaatggctcaaggtagccaaaaaggagaagcagggtaggggtcggggtgccttatttctctgggtaaaaccttacttgatattaagagatttgtataggaagatttactggtatgtattgatgcagtgtttggctggagttgtctgtaaagtaatataagcactttcccaaaactagagtgatcctgtggaaggtagttgacttgttagttcctgtggttttattggtattactgtcctttaaaaatcagaaagaaggtagggcacagctgtttacacctgtaatctcaacacttcgggaggccaaaaaggtgagaagactgcttgaggctagaagttttttttttttttgagacgagtctcgagtctcgctctgtcacccaggctggagtgcaatggcgcaagctccgctcactgcaagctccgcctccgggttcacgccattctcctgcctcagcctcggagtagctgggactacaggtgccccccaccacgcccggctcatttttcgtatttttagtagagacagggtttcaccgtgttagccaggaagatctcgatctcctcaccttgtgatccacttgcctcggcctcgcaaagtggtgggattacaggcgttagccactgtgcccagccagttgtgtgggtgttttgggcttgttgttttttgttttttgttttttgagatagagtctcactttgtcgcccaggctggagtgcagtggcatgatctcggctcactgcaacctccatctctcttgttcaagcaattctctgccttagcctcctgagtagctgggattacaggcgcccaccaccgtgcctggctaatttttgtatttttagtagagacagggtttcatcatcttagccaggctggtcttgaactcctgacctcgtgatccacctgcctcggcctccctaagtgctgggattacatgcctgagccactgcgcccggcagaggccgggagtttaagaccagccttggtatcataatgagactccatctctaccttaaaaaaaaaaaaaaaagttagctagatgcggtgatacatgcctgtggtccttgctactggggacactgaggtgggaggatcacttaaacccaggagtttgaggctgcagtgagctgcactgcaccccaacatgggcaacagggcaagacgttatctctataaaaaagtttaaaaaaaaaacccagaagttacccagttaaatgggtaaaagtctttaggataacgatagcaacaaaatgcttatgaccttctacctaatattttaaatgtgaccttgatttctcagtatttctgtcatacttggttggagacacacacacacagacagacacacgtataaatagacacacatacacacatatgtttattacaggatcaaaaagcagtctttcccagtaagattttcatacggtattttccagtttaaagaaaaaattcaaatgctttgcccctttgggggagagataggtattgatttgttgaattcaagaaggtggctcagctgttaaagccaaaaataatccagagagaacatttgaaatttaggaagtggtcattattgatccaggcccataaaacagtacctattggaataggtagaaactgcagtgaaatttgtaattgatttatcttttatttaaaagtcaaaaggcgagatttttttcttcttgataatggttcagagtgtacatttgattttaaattctagtcacctttgtcttaggtaagtgtaattgcagaaaattaactgatctacattttattactcttgggtttcagagatgctgcctatggaagttgcaatttctacattacacttcttgactgttttcatgcagtaaagaaggtgagtgacatgtaggatgcacccagtgttgtgttgaggaactaacatgcggtccaagaaaactaggccttcttcccgagatctttttgttagtgtttcttccaagatgcctatggtgacagaggtgctccatttcccaactaatgtcagaatgagaccaaaccaggaaacagtttattctgaatttctgagtgcttctatgtatgagttgggggaaaagtcacttaagaaacagggaaaataagagttatacgattaggttctagatccagaattggttttgagtatattatgatctaaaagaacaaaagtaaagatgacttgtttactggtaagttctctttgatttgtatattctatatacctgattcctgccaataccattacaacagacgtaacacagtcactgtcaaacacttcatttttgttttgtcaggcgttcaatttctagttcaacagaatttgaatgcctcaattagtttgttatacagttttatgtgaaactaagtgggtcactgctgctttgtcaaactatttccaagtgattccttgggtcataaccagggctgctgtgttgattccaggggacaccctccctatcacgttctacgtgaacagggtcccctggggtcacacagtgcagcaagtcctggtattaatgtcaggacagcaggagaaactagaatggtaaatcagtagcccatggatcaaataagcctttgacagcatttttctgtaacttgtgcttttagagccaaaaggaacccaggtttactttcttgtataatgaaacatggtggcttgctgggaattgtgacagacatgtcttaaaacgagaggactaatcagcatacaaattcagagactaattgatatacttttttccctgtatcaatcaatgaggtatgggcacattgtttggatttgagcccagtgactgtgggatatggagctgattggggtagttgccatgagctctgaggcggctccatgggccctcagtgtgggcaggtatggggcactggtggaaatcaggagaccaaagggcaacaggtgtaaatggtaccttctggttgcagttgcagcccctgccaggtgggctcatgcaggcaggcacactcacctttaaaaagagaaaagtaaagctttgaggggtttggaaatgatctattataacaccatatggcagcttctattattattttttggcttttttttttttaattgggtattgcacccaaagtcaattagctggtacgataggtcaaagattgccatttgcatactatattttgggtttttttaaaattaaattttcattttttctgctatgctcagctaatttttatattttttgtggagatgaggtctcactatgttgcctaggctggtctcaaactcctgagctcaagcgatccactcaccttggcctcccaaagtgctgggattacaggcgtgcaccaccgcacccagccactatatttagttttatttaagggtcactatcttctgatttgcagtgtaagcattttttatttgtgactgattttgaatattgcatatatgaagaaacatgcatcaatgtaattatgttttcagtgtgattcacttccaataagatcacctcatgaaattcaaaggaaaataggaattccttataaactacttttttttattgtttcattctattagaaatagctgtagtccaaaatcatgaaatatattgcagtcaaggaaataaattttgtgattgacttagtcttgggattagtgtttaaataactatataaaatgaagacctttttagttgatattctagccttcttattttacatttgtatttcagtagtttacttttgaaaactgggtgtacaaaagccccctctttgaaccaagaataccttgtggatcagcaattcttgcttccctcctgtttggctcagggatcagcagccaggaggatatttctcagaggctgctaggtctgtttgtccttgtctcagaaaatagacactctgcttattttggttatcatactctgcctgctatcacacagagtaaggctataggataggacagaaattttttttgttttattcctatggaaagaatatcttttttttcctcaaaagttttgattttagtgttgatgtcagagctgtttactttagggaacattgattaaagactgttcggaagaatttgaaaatgaagatatggatgaagtatgagggttttgtttgggataaactagcacatggattctctcctctttcttatcgatgtagagaccattgggttgtgcattatatttgaatcctaaacttctgaattttcagccaggggtggtagtgatctggtaagagaagaggattactttcagggcgtgattatttaacaatacatggataggatgactggtgaatgaaaataaaaaagcacatctcacaaacaaaatccaaacaaaacacaacaaacttattacatatagttataattaatttccatataaaagaagcacttagaagacgccgcccacttcctttgaaagctgttcagtggaaagtaatctgatcatgacaatactttcttggggggcccctgatatttagtattctgaaattggataggaaactgttttcttatttgcatccttgttcttaaaagctttcttttggattttaggcaatgcagtatggcttccttaatttcaactcatttaaccttgatgaatatgaacactatgaagtaagtcttcaaggatcatgttttcaactcttcctccccccgcccagctttattgaggggaataattgacaaataaaacttatatatacttaagatgtacaaagtaatgttttgatatatgtatacaccatgaaatgattacctaatcaagctaattaacatattcatcacctcacataatttagtcttttggcgtgtgtgatgagaatacctgagatgtactctagcagatttcaagcatacagtacacacattagatctccagaatttacttatcctctgatggtttgtactctgaccaaaatttctctgcctgtttttaatttttctttttttaaattgaaaaaaaaagagagagaccaagtctcgctctgttacctaggctgaagtgcagtggtatacatggctcactgcagccttgaacttctgggattaaatgatcctctctcttcagcctcccaagtagctggaatcacaggtatgtaccaccatgccaggctaattttttaatttttatttttgtagagatggggtttcactttgttgcccaggctagagttgaactcctggcctcaagcacttctcccaccttggcctcccaaagtgctaggatcacagatgtgtgccactgtgcacggccctgtttttagctttcttaatcacccatttcacttacagaagcaatattcttgttttgttttagacgtgtatagagtgaaaaaaagtcaagtcttcatcttcttatccctatttctcctgtcccaattctcagtgggaatttctgcatttgatgcacaattctagagtgaatgagtgtgccccgtgtgttctttatactgtttagtttaaatgtattttagtattgatggctgtcacacagtgattgagatgcttttaaaacccttagcatagaataagatgagatgaatagtcattatacacctaattatctctggaaaatatctttgtttttgccataaccttcggtttgtcaggacacttctggttgcaagttacagaaagtaaacacaaatagcttaaataaaaaaggaaaaatctgccaggcgcagtggctcatgcctgtaatcctagcactttgggaggcctagaggggcagattgcctgagctcaggagtttgagatcagcctgggcaacatggtgaaacctcatctctaaaatacaaaaagttagccaggcgtggtggtgggcgcctgtagtcccagctactcaggaggctgaggcaggagaatcacttgaacccgggaggcagaggttgccgtgagccaagatcaccccactgcactccagcctgggtgacagagcaagattctgtctcaaaaaaaagggaaaaatttactggattacataaattaaaagtccaggaataggattggcttctagcatgccccttcaggtgctcagacacttaatcagaaattggacttgaagttagttttattctcaggccagccttctccagtagtgataaagatggccaccagcaactttgacctgccagtttggcaaaatgatcagaaaagtgtaatcttagctccatcagaaggcccaggaatgcctctcactggcctgacttacgtcatgtgcccatctctgcaccagcctgtgttctttggcagggcagggctaaggaatactctggccagccttagttctctggccatcccaggagcctggggcatagggtcagccccatcaaaccagccggaccaaaaaaaaatttattttctaacagttttattttattttatttttctttctttcttttttagagacagggtctcactctgctgcccaggctggagtgcagtggtgcgatcttggctcactgcattctctctcccaggttcaagtgatcctcccacctcagcctcccagtaacggggactacaggcacgtgccaccatgcccagctaattttgtaatttttttgtagagatgggatttcgccatgtttcccagcctggtcacaaactcctgcactcaagggatctacctgcctcagtctcccaaagtgctgggattacagatgtaagccacggcacccaaccacacaaaatttcttaaaaacataggacagggccagggagagataagccaggcaaaaccacaggtgtgttctatgttttttaacatagtatatatattttaaaaagaataaataatttgattctacagctttatcctccaaatagggaatgagtaagatactgtgctaaagcccttttcagcccagagtagttgtagcctcctgtcttcttaccctgctgtagttaccttgagcagacttgctccccagcactggggagatgattcctcaaacagcagcacttcatgtggcagcatcttgaatcctcagagaattctttttcacaacgtccaaagtaaatattatttcaaactcttacgtttaactgaactgttttttcaatttcagttaataatgacactcagttgtttctgtgatgtaccaaagatgtaagaatacattgtaggattcattagggccaaccctgtctttacttctctgatagcagtccatttctaaagtacaacgtacatttaactagcaccttaaacttacagaatatagctaagttattaacaccttttttgcgcttgtccttaaaacattaaacatttgaaacaagttactttgtctatgtaagcaaaactgctaaaaacactagttggtatttgttccttttgtagtgatgcctttgtgtgctattaatgaataatataggcactaagtaactcccctgttactactgtagagattggagggtctgggctggggggtagcaggggcacaccacaaacgtcttcacctccatgaagctgtgtggtgacacagggaactgtttaggttcccacacaccagttcagttattatagtgtatttagaaatttggggatagtgtcattcattgattctacaatgcccattttttcctatttcagctcctctgaattcaggatgtatcttaattaatggcatcagcaattcagtgaaatctagttgttgccaacaactgatcacgggtttgttatttaaaagtccagatttctgatttcactttaaaatcagaatatctggcaacagctgccctcattcctgctttgacctttccttttctttttatttaaagagagagggtctcactgtgttgccctggctggactcaaattcctgggcttaagtgatccttctgcctcagcctcccaagtagctaggactacaggtgcatgccactgcacccggctgtttagacctttgtattatggaacatgggctgactgattccccatgttgatcattaagtccagtaaactggtttgggattacctgcttggtccctgtagatattcaagaaactctgttattttttactcatttttaggtacacgtagaaacaccccaatttcaaagctaatttatctgttgtttttaatcacgagtcctctccttctgcactatcaagtgtcttctacttcctgcttaagtctctgttgtccatttcattaagacagaagtttctattattgttaaatttgaactgtatctatgttataatagtaatggtaactcaatccaaaggacctaataacaggaagtaacatgtcttacatatcagtttatatttgtttttttgtagggacatactgtgatcttggtatacttgtaattttttagtttcctggtcggttcagtgcatttatttatttattattttaatttttnnnnnnnnnnnnnnnnnnnnnnnnnnnnnnnnnnnnnnnnnnnnnnnnnnnnnnnnnnnnnnnnnnnnncaggctggagtgcaatggcacaatctcggctcactacaacttccgcctcctgggttcaagcaattctcctgcctcagcctcccgagtagctgggattacaggcatgcgccaccatgcctggctaattttgtagtttttagtagaggcaggatttctccatgttggtcaggctgatcacgaacaaatgaactttttaaattggttgccttattaaatagttaggaagatagtggaaagatatatctctgtaagtaggtaagtaagtaaatattgggaagccagaaacctaagtagatagtttttccccctttattcgtggagtcaagattgctcatgttggaagccagttagtcattcaggaaaacagggaagttcccagattccttatactggaaaagtttgcttgctttcttattaattagcagcaactataatgagaattgattcagataaaataaccaaatagtatatttgtatggcagcagtcagctctgtattccaagggctgataccctagcaatgaaacactgttaaaagaagatgattaggaacaggatatacgtccattccctagatatacttatagcagggcaaattgagattcctgtctcatggcaatttgtaaacagcttttccgctaaagcaaatgagtttgaagtccttcagagactcagtcttgagtagagaggttgtggggagaatacatttaaaaacgaattgtgctggtcttccccttgcagaaagcagaaaatggagatttaaattggataataccagaccgatttattgccttctgtggacctcattcaagagccagacttgaaagtggtatgtgaaattatggcattaatctcattttgttattgaaaatatctatcctatattttcttttgaaagagttacaccaagcttgaccaagtgttaattattatttaagcatacttggtcacttcagtagatcattctgactggattttaactttcttttcttttgttttttacagttataatcaaattggtatttaattcccagtccagatactgtttccgttcagttacaggtgaaactattagccattgttttctttatgtgttttataagatctggtgcatttctttatgtaggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaaggtatgtttctaggggtggttaaagaatagtatacagtatgagtatatgaatatgtagaaacagaccatattcatttagtttatgtgtcagaacatgaaactgcctttatttttagagtgccgtgaaacctttgatttcagatgaaaagtatagtaacttattttcataagtaattctacaaatacatcacattgaaatgcatttatttattcatcaaatatttattgggtgcatcctatataattctaggatacatcaatgagtagcgtagactgtaagagcctgtcttaatggaaactatattcttaacaagttgctctgttttcagcaattgtaacagtgcctggcacttaatagatattttttgaataaatgaatgactatacaataataaatggtatgaagatagtaggatttatttaactctcttgttagttaattaagaaacaagaaatatagttttgttacaaaaatccaatattggaaaaaaagctcagcaagccttggggaaagggggagactgatctccagagttactgctgtatttgtagttttaaatataatggcaaaacatcacatttcagtttttattgaaaaattacatggcatacaaagaaacaggaaagtatagcctattcaaagggaagaaataaatccaggccgggcatggtggctcacgcctataatcccagcactttgggaggccatggcgggcggatcgcctgaggtcaggagtttgagaccagcctggccaaaatagtgaaaccctgtctctactaaaaatacaaaaaaattagctgggtgtggtgacggatacctgtaatcccagctactttggaggctgaggcacaaaaatcacttgaacccggaaggcagaggttgcaatgagctgagatcatgccactgcactccagcctggccaatagacagaacaaaaaaaagaagaagaaataaatccacagaagctatccctgagaaagatcaaattgtggacttagtaggcaaaaaattttaaataaccatcttaaagatacccaagagttaaaagaatatgtgggaaaagtcaaggaaacgatttatgaagaaatactaatatcagttataaaaagaacacataaaagggaaccaaaaggaaattctggaaatgtactaaaactgagatgaaaaattcactggagggattcaaaagcatatttgagcaggcagaagaatcagtgcgtgtgaagctagaatcattaaagaattagcaagtctgaggaacagaaagaataaagagcataacataaatgaacagaatttaagggatccctgagacacacccaagtagaccaagatacagatcgtgggagttccagagggagaagagaagtaaaggagcagacagatgatttggctgaaaactccccagatttgatatatgcaggaatatccaagaagctcaacaaactccaagcaggataaactcagaggcccatgtgaacatgcattataatcaagctataatgccacagacagtcttgaaagcagcaagagagaagtgacctaccacatacaggggataccactgagattgtcagcagatctctcatcagaaacattgcaggccagaaggcagtgggttgatatattcaaaatgcataagtgagggaaaacctgttaagaattctacatctggcaaaactccttcaaaaataatggaaaaattaagactttgcccaggcaatcagtttgcctttctgataaaggcaaatacatggaccattataaaagctagtattatcgtaacgagataatttgtaaaatattattactgtaacttgtaaatattgtaacttgcaaaaaacaaatagaaaatctgaatagacccctaactagtaaggggattaagtagtccaaagcctcctgacaaagcaaaaccttggatataataacatcgccagtaaattctaccaaacacttaaaagggagtttttaatcactagatctgacttgcaagaaactctaaagggggagtcttttaggttgaaatgaaggcacactagacagtaacacacagccatttgagaagaggaaataaagatttctgataaaggcaaatacaaggaccactataaaagctagttttattgtaacaagataatttgtaaaatattattactgtaacttgttattgtaacttgcaaatattataatatgtaaattattgtaatttgtaaaataatttgtcgtttgcaagtagtataatttttgtgtattattatatacaaaaattgcaagtagtatattattgtaatttataaaatagagagtagaaaaccaatagagaaaatgaacaaaaccaagggttggttctttaagaagaataacaaaaatgataaacctttagctagaatgatgaagtataaaaggaagaagactcaaattactaaaattagaaatgaaaatggcattaccactgatactacagaaataaagctgatcagtacgtaaaaatgatcagtattgtaggacaacaaattggatagtctacatgaaatggacaaattcctagaaaaacaaaacaccagaactaaatcataaagaaatagaaaatctgaacagacccctaactaataaggagattaagtaatccaaaacctcctgagaaagcaaaaccctggacatgatagcatcaccagtaaattctaccaaacacttaaaaaactaaaaccagtccttctcaaactcttctgaaaatttgaggaaaaaggaacactttctaactcaataaggtcagcattaccctgataccaaaaacaaaaagacactataagataactaactataggccagtatcccttacgaacatcgatgtgaaaaccttgaacaaaatactagccaatggaattcagcagcatatttaaaaggattgtgtgccatgaccaagtaggatttatcccatgattacaagagtggttcaacatatgaaaatcaatcagtgtgatataccacgttaaggacaaaaaccatacgatcatctctgcacaaaaagcgtctgacaaaagtcattacccttttgtgataaaaacacagtacaaactaggtatagaaggagattacctcaacataagaaccgtatgtgaaaagcccacagctaacatcatactcaatggtgaaagactgaaagcttttcctctaagctcatgaagaagacaaggaggcttggttttgtggcttctatttaacatggtaatggaagttctagccaaaggaagtaagcaaaaaaaaaaaaaatcgaaattagacagggggaagtaaaattatctttttgcagatgatatgacttatatgtattatagaaaaccctgggccaggtgcaatggctcttggctgtaatcctagcactttgggaggccgaggtgggtagattgcctgagctcagaagtttgagaccagcctgggcaacacggtgaaaccccgcctctactaaaataccaaaaaaaaaaaaaaaaaaaattagccgggcgtggcgcatgctaaggcaggagaattgcgtgaatctgggaggtggaggttgcagtgagctgagatctcgccactgcactccagcctgggggacagagcaagactctgtctccaaaaaaaaaaaaacagagagagaaccctcaagattacgcacacacacacagagcccctgctagaattaataaatgagttcagcaaagaagtagcagcatatacaatcaacaggcaaaaatcccttgtttctaagccctgacaataaaaatataaaaaagaaactaagaatacagtttcatttataatagcatcaagaagaatcaaatattggggaattaaccaaggagatgaaagatttgtataaaacatttttgaggaaaattaaagaagatgtaattaaatgtaatgacatcacatttgtgcactgggtgacttaatattgttaacatgtcagtattgcccgaagggatatacagattcaatgcaagcctgtcaaaatttcaacatttcttgcaaaaatagaaaaatgattctgaaattcatttggaatctcaagggatgccaaatggccaaaacaatcttgagaaagaataaaaaggttggaggactcacttcctggtttaaaacttcatacaggctgggcatggtagcttaacacctgtaatcccagtactttgggaggctgagacagaaggattgcttgagcccaggagtttaagaccaccctggacagcatggcaaaaccccatctctactaaaaaatacaaaaattaactgggtgtggtggtgtttacctgtagtcccagctactcgggaagcttagatagcaggatcccttgaacctgcgaggttgaggcggcagtgagccatgattgtgccattgcattccagcctgggtgacgtagtgagatcccgtctcaaaaaaaaaaaaaaaaaaaggcttagtacaaagctacatcaatcaagattgtgtggtactggcataaagacagatacatagaccagtgataggatagagagctcagaaataaatccttgtgtatatggtcaaatgacattcaagaaggatacagaaaccactcaatggggaaaggacagtcttttcaacaaatggtgctgggaaaacctgatatccacatgtaaaagaatgaaattgggcccttacataacaccatatacaaaaattaaaatggatcaaggacctaaatataggacttaaaactataaaactcttagaggaaaacagagggtgaaaacttcatgacattagatttggcagtaatatgacaccaaaggcactgacaatgaaagaacagacaaatcggactatataaaattttaaaacttttgtgcatcaaagtatactatcagcagagtaacaaggtaacccatggattgggagaaaatatttgcaaatcacttctgataagggattaacatccagaagatatagagaaaacgcctaaaaacaacaacaaaacccagttcataaatgggaagaggacttgaatacacctttctccaaagatataaaatggccagtgagcacaagtaaagttctcagcatttttgacttatagggaaagtcaaatcacaaccacagtgagataccactttatacccattgggatggctgttatctaaaagaacaaaaacatcaccaccagaaaattacaagtgtggagatgtggagaaaattagaagccttgtgtactgctagtgggagtataaaacaatgcagctgctatggaaaatggtgtggcagttcctgaaaaaattaacgtcattcagcagttccatctctggttatatgctcagaaacaattgacagcagggatatgaacagatatttttacacccatgttgtagcagcattcttcttcttcttctttttttttcttttttttgagatggactttcactctgtttcccagactagagtgctgtggtgcaatcttggctcactgcaacctctgccacctgggttcaagtgattctcctgcctcagcctccagagtagctgggatgacaggcacgcaccatgacatccagctaatttttgtatttttagtagaaacagggtttcaccatgttggccaggctggtctcgaactcctgacctcaagtagtccacccgccttggcctcccaaagttctgagattacaggtgtgagccaccacgcccggccagcagcattactctgaatagccaaaaggtggaagcaatccaggtttccatcagaggaaggctaaagaaatggctaaagaaaatgtgctatatcatacaacagaatattatgcatctttagaaatgaagaaaattctgacacatgtactgccacatggatgaaccttaaagatattaggccaatttaggtttgccagtcagaaaaggacagatattgtatgaatccagttgtatgagatacttggggtaagagaaagtagattggtggttgccagggcctgaggggaggcagggattggtagttattgtttaatgggtccagagttggctgggcacggtggctcacgcctgtaatcccagcactttgggaggctgaggtggccgcctcacgaggtcaggagatcaagaccatcctggctaacacggtgataccccatctctactaaaaatacaaagaattagccaggcttggtggtgggcgcctgtagtcccagttactcgggagtctgaggcaggagaagggcgtgaacccgggaggtggagcttgcggtgagctgagattgcgccattgcactccggcctgggcgacagagcaagactccatctcaaaaaaataaataaataaaaataataaannnnnnnnnnnnnnnnnnnntggatggtggtaatgtttgtacaacaatgtgaatgtacttaatgctactgagctgtacacataaaaagtggttaaaatgatattcagaaacttacactaaggaaatacaagtttccgaattaaccaatacagaatttttttgtttttgtttttgagacggagtcttgctctgtcgcctaggctggagtgcagtggcacgatctcagctcactgcaacctctgcctcccaggttcacgccattctcctgcctcagcctccccagtagctgggactacaggcgcccgccaccgcgcccggctaattttttgtatttttactagagacggggtttcactgtgttagccaggatggtcttgatctcttgtgatccacctgcctcggcctcccaaagtgctgggattacaggtgtaagccaccgcacccggccccaatacagaatttaaaataactgtcttaaacatgttcagtgagctaaaacagaattcagacaactaaatgaaatcaggaaaatgatgcctgaagaaaaatggtaaattttatgtatattttactccaatttttaaacataattaaaacaaaagccagcattgcttatttcattttttaattataaaaagcagttgaaggaattcttcagcaaggtccttttgcaccccaaccccatcacacacccgacatttggcaacctgcagagaccttttttgggggttgggtaccacgggcatctggtgggtagagatcagcgatgctgctaaacatcctacagcgcacaggacagctcctcactataaataattatccagcctcaaatgttagtactgctgaggttgagataccctgaaatagaatgatgaccaattaaaagcctagagaggatcttatttgattgcatctttgtttagggaagaaaaatgatgacagtatgaaaattgggctgtacagtgaaaattgagattcattaagaggtatattaatctgctggggcatatcaccaactgggtggcttaaacaacagaagttaattctctcacagttctggaggctagaagtctaagggcaaggcactggcagggatgttttctggggaggcctctctcctcggcttgcagtgcagatgtctgtcatctctgagtcttctcatggtttgcacttaactcctgccgtctctttcttttatttttttgagatggagtctcgctctgtctcccaggctggagtaaagtggcgcgatctcagctcactgcaagctccgcctcccgggttcacgccattctcctgcctcagcctcccgagtagctgggactacaggtgcctgccaccacgcccggctaattttttgtattttttagtagagacagggtttcactgtgttagccaggatggtctcaatctcctgacctcatgatctgccctcctcggcctcccaaactgctgggattacaggtgtgagccaccgcacccggcctatctcttttttttcttagaagtacaacagtcctattggattagggccccactctgtgaccttatttatttccgtaaaggccttatctgcaaatacagttgtattgggacttagaacaatatatggatttgggttaggggggacacaattcagttcattatattctgccatctggcccccctcaaatttatgtcccttcacttcaaaaatacattcaccccatctcaacagttctgaacatctcaattcattccggcatcaactccaagttcagagtctcatctaaatagcatccaactcaggtataggggagacttgaggtatgatccatcctgaggcataattcctcccagctgtgatgggatggtacaggcacaggatagacattaccattccaaaagggagaaaccagaagaaagagcttctaagcaagtccaaaacctagccaggcaaatcccattacatcttaaggctagagaatcatcctctttggctccacgctctgccctccaggccctctagggtagtggctttgtccctgagggctgtggtcagaggcagctgggtttgctgtaactaatagaggtggccctaccctgtgaaatcaaggagtaggcaggccttccctgagcttatatactctgtgtctcggtggcagtggcagcactgggggtctctaaattgcccttgggatcatccttccttttcttgaaggacaaagaatgtttgcatccaggtagctctgctgtcagaagtccaaaagccttactttattttattccatgtccatcccctttagtgcaagatgccagtgtctctgctggtataatcccatctcttgtccttgcttctgctgagatggctgattaagtctaggtaatctctttagagggggagtgtccagccacacccttgacttttctctctgtaacactcttattttttgcaatatggatagcctgagaattttctgactctagttcctgattccctgttgcttaacaatttcttctttaattcgtctttttccttttgcattttacagtaaccagtaaggagaaaccaggttgtatcttcaacactttccttacaaatctcccctgctaaatatgcaaggttgtcaatcacaaagccacttctccatttctatgtagttgttacagtgacccctatctcatgatccaaatctgtatttagggttctccagaaaaacaagcagtaggattttttttatatgtaggagatttattaaaaggaattggctcatgcaagtatggattctggtgagtccaaaatatgcagcgtgggccagcagcctggaaacatgggagagttgatggtgcagatgaaagccaaaggcagtctcttgctcaggaaagtcagggtttttgttctgcccaggtttttcagctaattggatggggcccatccacattatggagggaactgtgcttactgaaagctcaccaacttaaatgttaatctccaaagattcattccggattgacacataaaattaaccatcactggaggtaatgataatagtctagataagacaggccagcaccaatagaggtttaaaaaaatctgagtgaaaatgggtattacagaccagaaaacataattggatgtgggagtaagtgcaaaattacaagcctttggttttgcaaagatggtggtaccgtttttctaaaatgcccagggcagaagacactgcacttactgagaatcattgctcagaaagtgattctccacctcggctacacatagaatcatctggaagattttaggaatctctgtgtccaagctatgctgcataccagttaaatctaaattcttggcgtaaggccaggcgtggtggctcaagtgtataataccagcattttaggaggccaaggcaggcggatcacctgaggtgaggtgagtttgagaccagcttggccaacatggtgaagccccgtctctactgaaaatacagacattagccggctgtggtggcacatggctgtaaatcccagctacttgggaggctgaggtaggagaattgcttgagcccaggaggtgaaggttgcagtgagctgagattgcatcattgcactccagcctgctgggcaacagagtgagactccgtctcaaaaataaatagataaatgaaacaaataataaatacattccggatgtgagaccgggcatcagtatttaaaaacctctctaggtgattccagagtgtaaccagccttgagaaccactattgaaagaagcagagtcatgagaagccttttaaaaaaattctgcctgcccaacaaaatcctggagtacatcagcccaagtttcatttctgtgcttctttattttcctagctggccttggtcgcacgggcactctgatagcctgctacatcatgaagcattacaggatgacagcagccgagaccattgcgtgggtcaggatctgcagacctggctcggtgattgggcctcagcagcagtttttggtgatgtaagtagtagcctacgtctgtagttcccagggaacatgtggggttggaatctgatggggagtggaatttcctttagtttccaacaacaacagataatctggtaggaagaagttgttcatgtatctttctggaaagctctattttgatgttatttaaatgctctaggaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccggtaatcaagccgtttctgttgcgatgttgttactgctttaactgctattgagaacctgtcagggtatggagaaaaccgtaggtaaaataataaagcagctcttggatgattgtcagttttttatatttataaccctctctaggcactttttacccaaaatagtggaaacaaggttgtgtgtccataaaactatgttttacttactcagcaggtgcataaaaggttgtgaagtgagctcttcagccagatctacccctgcccctcacccctttttgccatttcacaacagctgatttaggaaagcaatcattctcaaatagagagcttttaacaaatcaaaggcttagggggtagcagtactactacattaagtggtagtaagtacactgagattttaaaaagagcgttttcaaacttgaaagcccattaaccctcttcactgttgatgtgttttctaacaagagtgctgctgtgttgtctctgaaagtcaactttggctgtcttaaaatgtcacctgaagcttgattgtgaaagggaaaaatattctagagcttgcagaaacttggactgtgttcatgtggataaattgctgctctgctgtactgcattaataagtgcaacttaaatcattagctcagtgtttttttacttacacagtacagtgatgatgacgaaatcaatggagtgacacaaggtgatagacttcgggccttgaaaagcagaagacaatccaaaacaaacgctattcctctcacgtgagtctgggttcctttgttgtggttgatgtttcttcatatgtgtgtggggtccttggtgagggtttttcctgtacatttttctccatagttgcaagcccatgatgccactttgaaatgcttgcctatgttatttaaaacctaggggtgctggccttggaagctctcagctgtcccttgtttaccttggtcctcatgagcctttatgggtgggaaggcgacatcagggatactttttctccatgaataatcagcatggggcatcctcaggagcgcgacagcagatgtaaagcccaggatgccagacttgtccatagttactaaagtggtgtatttctttacatttgccatgttgcagatcatttgttttgataagcatgacatgatggcttaatgacattatgttgttttggggcaacaatgaactggtctaaactatattttgggtttttcgtttgtttctttggggaatgattttctaattatagaggaagatttagcctgagaataggaaatgttgtagtactgagtgtatgtatgtctatgtgtacattcttgtgaatgtgtgttagttgggattcaacctgatggagcatccaagattgttagaaaaatatgcagaagcaaagtacatgaccatggtattttttgtaggctgttctttagtaaatgctcccacttgttgccattggatttcttccttctagttacttcctttttcattgtgggacaccagatttccagccttcttttttgcggggagggagtgtgatggacatagatcatttattcagtaagcatcttgtaatatggtaaggaagtatgatataatataccatttatattggcagagaacaggttttcttttcaattaaaagtaattcctcactagtgtctcgtcataaaaattctgaagtagaattacacctaaggcatgtgtcattatgggttgctcccctgggaggttcttcttaaaagacccaaggcaaagaattgagttttacaatatgcagtgttatgtgaatgaatgtagggcatccattttgattataggcatttattaagcatttcttttgcaacttagtggtactttagtcaactatacttttttaaaaatggtgccttttggccaggtgtggtggctcatgcctgtaatcccagcactttgggaggccaaggtgggcagatcacctgaggtcaggagttcaagaccagcctggccaatatggtgaaaccccgtctctacaaaaatacaaaaactagccgggcatgatggtgggagctgtaggcattataggatcccagctactcgggagggtgaggcaggaggatcgcttgaacccgggaggcagagattgcattgagccgagatcgtgccattgcactccagcctgggtgacagagtgagactctatctcaaaaaacaaacaaacaaacaaaaatagtgcctttgtataatttacttaactccaaatgccattttgtttttaatttccttattaaaagtcttcacctaaggccttaatggtttttctttggaagtattatggtggctccaggtaatcatccagatactaattctggatgtggtggaggaggcaggcagcaccctcgagcagtgcttctcagacttcagtgtgcaggaggcacccgggcgcttgttgaaatatgggttatgattggtggggtgggggtggggcccaagagttcacatttctatccgaggctgctggtccagggaccacacattgaattgcaagccctaggaaactgatgcttttgtgggttgattttagctgtgtctgggattttttgttttgtttttcagaatcagcatcatcagtttatgttttaatattttgttgcctgctgttcaaaagtcaagttgagagtcaggggatacaaatcctgcttagtcaaaagtttttgttaaataggaaatttcctttagtcaccctctgaatctgctactctcattaacgtgagttcaaatctagctgggcgtggctgtgcgcacctgtagaccaggctatgcgggaggctgaggcaacaggactacttgagcccaggagtctgaggctgcagtgagccatgatcactgcatccagcctgggtgacagagtgagaccctgtctaaataaataagtaaaatcaagtacaatggtaaaagttaaaaaacaaagaggtagctcaggattccttttggtaatatcccaaaaacaatatatataaatagccccacataacacaaataacaaagttttaggccacacttttaaagaagaaagcgaaatgctagtttttctaagctctgagttatgtgtatagacccgaggggatttttgatgagtctcagcaaatctccttcctcctcccttacaacattttgcttatccccgtctctgctttttcaaaccctctctgctattatttgcagttttttggccctagaaaagatcaattgaagattttctttctttccctcttgtgtctatgttgttattttaggaatagaagtccctgagggactgttctcaacagttgcttgggttgaaaaatacaaaatcaatttcttcatccaagtttgactcattgatttctgtgagcaagttattttgctttagcattggcacttagccttatgaaaatacagtacatgcaagaaggaaagttagtgagaaatacacaagtactagtgattcttaggagaaggttatagtacataaaatattattccaatgattggtttctctttttttttttttttttttttttaagacagagtcttgctctgttggccgggctggagtgcaatggtgtgccctcggctcactgcaacctctgcctcccaggttcaagtgattctgctgcctgagcctccggagtatctgggattatgcaccaccacacccagctaattttttgtatttttagtagagacaaggtttcaccatgttggccaggctggtctcgaaatcctgacctcaagtggtacacccacctcagcctcccaaagtgctaggattacaggcatgaaccaccggcgcctggccggtttctcttttataaatggtcagttttgggggagagtttaagtttttagtgattataaaatggccatttgctcagcctgtctgatcctgactacaatgatgacaggaaaccatgtggcaccatgacattgagctgatcttcaggacgtgatgacaagtatattgtctgtgctaaaatggatttggtagattgcataacttgagccatgaggcctgtcgttctgcatactgatggttttggtaggtttggagatgagtatatctgttagcaatggaaaataattctttttttatttttattttttatttttatttttgagacagagtatcgccctgtcgcccaggctggagtaaagtggtgcgatctcggctcactgcaagctccgcctcctgggatcatgccattctcctgcctcagcctcccaagtagctgggaatacaggcgcccaccaccacgcccggctaaatttttgtatttttagtagagacagggtttcactgtgttagccaggatggtctcgatctcctgacctcgtgatctgcccaccttggcctcccaaagtgctgggattacaggtgtgagccactgcacccggccggaaaataattcttaagccatgaggtttactagaggaaaaagtaaccatctataatgctgacacttggacattcgggccattctgcctttaaggaactgaaggtgaaggctgggatcggtagagagttctctagggctcccagaccatttattcattccatttaaatattcacccctgtgatctttatgtatattagtagcttgttttttttgtgggaagattaaataagatggtgtgggtataacttgtggggtaaggttaggctgtatttcgagttcaccctttagtctaatccctttccacaatataggatgcctggcatgtaatttctttttccccgagacagagtcttgctttgtcacccaggctggggtacagtggcgtaatcttggctcactgcaacctccaccttatgggttcaagtgattctcctgcctcagcctcctgagtagctgggaatacaggcacacgccaccacgcctcgctaatttttgtatttttagtagagatggggtttcaccgtgttggccaggctggtctcaaactcctgacctcgtgatctgcccgcctcagcctcctaaagtgctgggattacaggcgtgagccactgcgcctggcctgacatgtaatttttaatgatgacagtgatgaggtcaacaataaaaatgacatgataagccaaatcagccatttccaaattgattagcagtactctgcacacagcagatgctcagtagaggctctaatatttggtcacagatgtatccaggtgaccatttggaagtatagtcattggaaagagcttctgcccttccaaatgggaggaggtttccttcctcactgctagaacccagaccaatggattaagaaacaccaagctgaggctggacacagtggctcatgcctgtaatcccagtgctttgggagttcaaggcagcaggatcacttgagcccaggagttcgagaccagcctggccaacatagtgagattctgtctctacaaaaaaaataaaaaaaaaaaactgggcatggtggcatgaacaggcagtctcagctgctactcaggaggctgatgtgggaggattgcttgtgcctaggagttggaggttacagtgaactatgataacgccactgcactccagcctgggcaacagagcaagacccctgtttctttctttctttcttcttctttttttttttttttttttttgagacggagtcttgctctgtcgcccaggctggagtgcagtggcgcaatcttggctcactgcaagctccacctcccaggttcatgccattctcctgcctcagcctcccgagtagcgtggtgcctgccaccacgcccggctaattttttgtatttttagtagagacggggtttcaccatgttagccaggatggtcttgatctcctgacctcgtgatccgcccgcctcagcctcccaaagtgctgggattacaggtgtgagccaccacgcccggcctttatttttttttattttttttattttttgagacagagtctcgctctgtcggccaggctagagtgcagtggcatgatctcggctcactgcaacctccgcctcccgagctcaagcaattctcctgccccaacttcccgagtagctgggattacaggcatatgccaccacgtctggctaatttttgtatttttttagtagagacggggtttcaccatgttggccaggctggtctcgaactcctgacctcaggtgatccacctgcctcagcctcccaaagtgaaaagatttcgggaaataggaactaccctttagtcgccctctgaattctgctcctctcattaacgggagtgtaaatatagctgggcgtggatgggcgcacctgctgaccaagcctgtgcgggagggtgaagcaacaggacctgcttgggcccagaagtctgaggctgagcttaagccatgatcattgcatccccctccgggtgaaaagaatgaaaaccctgtcttagacaaaacaagcnnnnnnnnnnnnnnnnnnnntgttttttttaatcaaagctctggattaggaattcttatttaaatttttttttttttaaatttttttgagacacagtcttgctctcttggccaagctggaatgcagtgacacaatcatagcagcctccatttcctgtgctcgtgatcctcccacctcagcttcctgagtagctgagactacaggtgcacaccaccatgcccagctaatttttaaaaaaattattagtaggccaggcacggtggctcacgcctgtaatcccagcactttgggaggctgaggcaggcaaatcatctgagatcgagagttcaagaccagcctaaccaacatggagaaaccccatctgtactaaaaatgcaaaattagctgggcatggtggcacatgcctgtaatcccagttgcttgggaggctgaggcagaattgcttgaacccgggagggggaggttgcagtgagccgagatcacaccactgcactccagcctgggcgacaagagtgaaactccatctcaaaaaaaattaaataaataaataataaaatagagctcaggtgcgatggctcacgcctataatcccagcattttgggatgctgaggcaggcggatcacctgagatcaggagtttgagaccagcctggccaacgtggtgaaaccctgtattaaaaatacagtacttagccgggcgtggtgatgtgcgcctctaatcccaactactcaggaggctgcagtgggagaattgtttgaacctgggaagcggaggttgcagtgagccaaaatcacgccattgcactccgggctgggtgacagagcaagactccatctcaaaaaattataataattaaaaaataaaaaataagaaagaaacaccaagctgaaagccaactagtatgaggaaaatgagtgtggaaaacaactaagaaaagtctatagtatgcatacctaagtgaaattttgctcattttgtgttgccctgggttaaatgtgaaccatattataaaaatgtgccattcccttagcttcctggatggctcaggagttagtaactcccttgaagtgagatcagttctgctgtattacgttcatttttagttgtgcctcctgtgattttgttaactagtctggggttttgtgtttttttgtttgtttgtttttggttatctggttttgcctcctttgccccttgtggtttgctttagttttctgtgtgtgcacatcttctgctttttgaagaacctcaatcatttatctgtgactgatttcagtatcataaagttaaattaacatggggtagttatctcactagtgactgagtcccaaagtatgaaacctgtttaaacacagcatttttttattcaacataaaatggcaaaactccatccttgttgaccacccctttgtatccctgttgctgttggctgggcttttagggtgtctaaaattcacatatggcttgattgattgatgattgcgtaatttattttggcttcccaatttgaacatctgttctttccccttcacccctttccagatgtcccctagctgtgctgacctctgcactgtgtagtgttgtcatctggtggattgtttgtgactacattcttcccatcctgctattctgtctcgatggtttcagaacacagtagccatcaggaccccctgacagatagctgctgtaagtgtcccgttctgtttctctgccgttgcttacttctggtgcctagtgtggttcccacaatgcatgtttttctccttgtcagctcctagctttgttggtttgcctattttcaaaggttctttttctgaatcttttcaattaatgggatggtggtggggagggaaggtgggcttcactgttcctctcatagaaaggatattgaaagtaacatacgttgttttaaagttatgcttatccttaacatatttcaaaatagcagttgataaagacactgaaacagtttttcttcactgaaacagtttttcttccctatcaaaagtagttagcttaggataattggggtggttttattttcgtcagttggctatacaatttccctctagttttctgtatcttgagtatgtccttcccagtctagcaaagaagcatttttcccactgatctactttcattaaatatgtgattttgtagcctcgaaatctgccattgtacagcagctctctcataagtcttctctctttagtgtgcagaatttcctgctctgtctcattttcctcctcccctttagggaatacagtaagtacagtgtgtagcacttgatgctaaatgaaagtaggaggtcggagctgaggtcgcctgtttaaattggtgcatttccatatgatggtcattgttcctgcttttctccttgcccagacatagccagaatgcctttaataggctaatagcagcaaatctgtattctcttgagatctttcatctttgaaatgaagaccttaacagcgaagaggctttatttctgcagaagaatgtacaagaggcccacttgtggaacagcatgttgaagacccccagaaggcgggtgtgtccgtgtcacggggtccaccgccacccttctgtgtctgagctgcgttcttccttctctgaagctttttccttaactcatattttaagaatttcttctcttgtctcctcttggacttggaagttatgaaagaatgcaaaagttccttgcaagatctcttccaaagaaaaattccattgcaaccaactctggtactttgtggtttcactgagtattttcacatagctgagaaagatttaaaaatcaagctgatttcactcttcagaattaggcaaaacctgcttaacttgctcctatttatggcattttcttgaatatcttacaaataaaagcttattgtcgcgcattcagacctgctgtatttctgagatagattaaccttttgggtgttttcttctttacttctcttagtcaactacgattgccacatattctgactcaagagcatcatgcactacatagagttattcttctcaaactgttccaagtggcaaagatgttctgaatgggtggagcagttgcaaataatgcttaggcactttgtggttgaatgatcattcccagggtaagtttaaacatggtctctatcaggctctcttcttttcagtattccatgtaaactataccttctgttgttattggtaatgacgtttgccattgtatttctagacccaagcagagtattcagttcagcctgactaattatttggaattttgagaagcaaaaagcttgtgacagttacagtggtgttaatcagtatcatctttgtagcacccccatgtctttctctcaaaagggttttatttgtaaggtggtgactcctgagctccaccatcctctgtcatcaccacccacctctgctggcagtggacgcaggtggtgtggcatcgtctgctaagttgtttccagtgaaaagctcctgttatgcagcatgcctggagaattaggccataacaacacttcaggcttctgagtcagactcagagatagtgggaaagccttctctggaggctgcagggcctcagggtcacctttgtgcacgctcttgtggtgtccggagtggacagccagtatacat

SEQ ID NO: 14124 - DNA, 28802 bp, Human
gtgatgagtctcagtgaccctggaaaatatgaagagtggccaatcactgtctagctttgtagttctggggctatccataacctttgcaagccagagaagaaacagctctggtctctcagaggaagggatttgccagcctcccatatcccctacttctatttttcctccctgaagcctgacatccacttcgcccttgctccttgtacccagcaagtgttctttctataccagggcttcttgaacctcagtgtgcatgagtcatggagaatacttactcaaagtacagattctggccctcacccttgattctgtgtagaccatgctttgagaaaactctgctccacagaatcattctctctctctttgctcccaaagctagttaagaagttcaggtactaaagaaagacaagttatttcccctgtttcccgtggtccagctatgggagacaaatggtatttaaagtaaccagaaaaaaaaaatctggaaatggaagttaaagtggaccaaattagctttcatatctagcagggattacaaccccacatttgttctcaactgcacactggatgcctgaagcagacccagcggtccctggagctgaggaagttgaggggagtggggggcctggcagtgttggaactaactccttttccctgttaattgggagtcccaaggaccaatgactgattttaaaatgcatgtttgccactccttctgtccccaggcccttgccatcactatgtgatcagttctgaatcatcatttgtactttgaaacagattcataccattccgttgtattcaatcaaattagcatatcaggcctttgctcttattgtgtgatgaaagactttgttccctgtttaaaggaatgctaggcaacaagaccagaataaggagattttgggtttgtttttagacctggatccttctcctgtgcaaccccaacgcatagtaggtttgagatggactataaaggtaaagctacttttataatgctagagtgtctgcggagaaatcagaaaggaccacagagtgctggtctggcttctcttttttccctttaggctatgtggtacagacatcatggaagagcctgaactgagtatttataatttcatgattctgctctggatatcagagcagcctctcccaggttataccttatctgatcctcccctggtgccatcatctgcccaggctggcttctcctttctcccgtctctacgtccccaagactaggctgcctacccggctcagagtttcttctattcagtacaaccaacacccagaggaactggtgaggaacaggaagctcaaggatctatcaagtggtggaggatggagtcacagaaagtcctttttctgatgggagagcaaggtgaaatccctagtggcttagacccagggctggagaggggataactggggagaaggcatccagggaagtcctttttctttaggatgatggtgatggggaactaaatggggaaatatggaaggtcacaggaaaagttaacacaagttagcaaaaagttaacataacacaaaaaggtcttgcaggaaaaaaaaaagaaaagaaaagaaagaaaaagtctccaagaatggtttggacagccaaaatgaatacttatagtcacgtatacctgctcactcctgacgcttcactcacacacagcacaggatctggtgaggctatcactaaatgtgccacattgtggttaagttttacctgattaacgaaatgctcacacttctaaactgaggtccttacagtagattccttttgcaagattgttactggcttacaacttaaaaataaaggaaaatcacaaggaaagaaaagtggggaaaaaatcggaggaaacttgcccctgccctggccaccggcaaggctgccacaaaggggttaaaagttaagtggaagtggagcttgaagaagtgggatggggcctctccagaaagctgaacgaggcatctggagcccgaacaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgcgtgagtaccgcccgcgcgccgcggccgcttggcttcgccgcggggagggtggaggctttctgggaggctgaacagcagagcagagtctcacggagggaagggacccctgcccaacccacgcactgccgcccacagctgcttccccccggggccagcgcctcacctgggagctgacgggggtgggaggggaagggaaggccatcacccccgcgagtgtgcgttagccgaggtgtgaatcggtcagcacgactggttccaatggactgagataaagcgctttggagatgccagggtctcttctggttgccagaggcgcggagtgcgaagttgcagccagaaccgggagactggggaggagagaagcaggaaaagttttgtggctcttggttgattcagaaagtatagacacggagcggattgctgggaaggggccggtgtgcccaccttgcacagggactgggagagccagaagtggacattaaggaattcgagggaagcgaatcagggatgaggctccaggtcccaggccaggggtgttcggaatgaacagtccgtgaaaaggaaaaacaaaaccaaacaaccaaccaaacaaaaaccttgcatttaagattgggaagctgagtttgaattcccacttcagcaaccccaccgcggaggaggtagaagtagacagaatttgctctgcgcccagcctcgctcgccttaccaaaaaccgtcacccctgcacaaatttcaaaacttgtcaccttttggagttttcttcctctgcccctgctccaagttctaaagctagtggatgggttagaacactgcccccactcacctacacatatccttactcttaaggtcttgctctcacttcggttaaaaaaaaaataggcacccggtaaatatttatactcgattactttccttggggaatgacattctccacctcatctctttgcacttggaaggtttgaaacttttgaaactttgtacattgctctcccttttgcttacagcactctagggctcccaattctgtactctcactacatcctaagggccacccactgtggccctgcagagtgacctggactagacctctttgttcccagtctcctctgttgtccatctttgggtccgcccagctggggacagctgcccctgggctggaggaagctctgagagaagttttgggttgccctgtttggcagtcctggatgtgtgctttggggcaaggaaaagctatcaatgaggtttcaaaattctagagtgggtgctagactaggccctcataacaggagtgagtcggccgggcgcagtggctcacgcttgcaatcccagcactttgggaggccgaggcaggcagatcatgaggtcaagagatcgagaccatcctggccaacatggtgaaaccccatctctactaaaattacaaaaattagctgggcatggtggcacacccctatagtcccagctactcgggaggctgaggcaggagaatcccttgaacccaggaggcggaggttgcagcgagccaagatcctggcactgcactccagcctgggagacagagcgagactccttctcaaaacaaacaaacaaacaaaaaacaaaaaacaaaaaaacaggggtgagttggccagtggtgcagattccaatcagatgctccattctcctttggctacacagcttgtgatgacctggtcctcagccgaatgaggtccacccttttcttatttcctcagctggtaagtgccagtctcgccttggcctgccgaggttggggttgggggagcaacacaaccttggcaaaactttggactgatatgctgagaatatcccagcttttggtggggagggatgaggcacaaggccccattcccagccttgccagactacttgagccaattgtagttttatgcccttcccaagagctttctagggtttttgcttggatttgttttgttttgttaatactaggagtcattttcagtcctgggatacattgtgggataaatgagataactgagtgtaccttgaaatgctaccatagggccattgcagaaatgctattattattgtaaaatttagggtagaggggatttctgtggtttgttttctcatcatttaccccaacaaagagcttgttttgggaagttctttttttctgtccctttgagaaggtggcatgtgcataggcactgcaactaaccagaagtgggctgtctttgttggaagtgggggagatcacagagcagagtcagggtaaggggctcaagggccaccaggcagcactgccagagtgctggctggagcaggaagcctttcaggtaattagggaacccctttgtcaggctcagggtatctatttcctccaagctttccaaggcctgtccctatcctcactctaacaacacccccaggccctccccgtcacattcctcttcttcctttgggtccttcgtgcctgctgaccccacacccatatcctgtccagggctacatgtaagaggggaaaaataaaagggaaaagaattttatcagctattttccagaggggagaggactccaccctttgaatctctgccatatggcgacagaggaggagcaggcttggggacctctgactaattcagtggtccccagtgctccgcacttgtagacccaacccagttggcaccacctttgcagatgcatgtcttcagcagcatttctgttcggctgataaaacacacaggggcctggggcctctttttcttatccctttggctccacctcctgggcctcctcattcccttgtcctcatctccttccttcgcaatctttgtctcaaaaagcttagggcaagaagtgccaaactgcagcagataaactcagctgcagagtcctacgaaaacaaatgaaaatgaggaacaaattccacttcttaccgttggtctcattgcctgatttcctttagaccctgagctggagggcctgggtttactttcagggctggatggttacccaactccactctcaggtacttgggcctccctctctcattgactttggttgatctaactaaatggcttgcagtgtggagaattaaaaataagaaggtatggaaaaagaacacaacaccaccctccagaagaaaattctcacagtcgccagggctgtgagaattccatatttttgtgggcttggacttctctaatgagaacattctcttccctccttagctaataaatgaaaacatattatctatgacttttagtcccagagctggacgttgtgctaaggagaaagatgcgtgcatgttggaaagatggagagacaaacaaatagggatgcatataaaggtgtacttcttagtacctgtgctcttggagtccgtcggaatgagttacttcccttcagatgcaacggaaaaggcctttgggcttaattgggaagtaggcttcttctttatttggaaaaatgaaatcaaactgatacttcttagagaggagtggcatccctaggcagctgatttaagaaaatgtcttaagaggtctttgagtgacaaagcctagaaccccagacaatcctggatgagcaaaggtaggcaggaggctgaattgctgagcatgataaaatgaagtgaagccttgtgtttaggtgggcacaagagacacaaggctgataggactccagagcccaggaagagcatataaagggtggagaggtgcctggagtcatagcaggacagtggtgggtggaggatggaaaagacctgggaggaaatttttttttaatacatggcttcattagcacagtaatgtctaatatttcagggttatgccattgtctcccctgggctgccctgtaatctcgttccatgccctcaacctttcagtaaatactggctacacacactagccttgtgttagtggctctctggggagggtaaagtaacttactttaccttggctaacttacggtgaagtggtatactagtgcggacagggagccattgagccatggagccacaacccaggagtctgtggtgctggtaaaatggaggaagaggtgacagggagaaatgtaggtgcccagagaatcttcaaaataattagggttccacagtaagtggatggggtccaagacatgctattttatttatttatttatttatttatttatttgagaagaagtttctctcttgttgctcaggctggagtacaatggtgtgatctcggatcaccgcaacctctgcctcccaggttcaagcagttctccttcctcagcctcctaagtagctgggattacaggcatgcgccaccatgcccagctaattttgtatttttagtagagacgggttttctctatattggtcaggctggtctcgaactcctgacttcagatgatccacccacatcggcctcccaaaatgttgggattacaggcgtgagccatggtgtctggccaagacatgctatttgaatataaaacagaaatctcggtacactgggaaccctcaggccacagacccttggtttatatatactcacaccttagcttagcctttgaagcttaagaaggcatctgctcagtcccttgttctagtctaggatgactgaaattcatggtaggcctcagagttggacagccccctaacacggatgcctcctgagtgtttgcaggaagcatggatggatcacttatctcccaaagtggctcatttcattcttataaatagctacatcattttacactttttccttggattgcagtgaaattggccttcccataacttctaatcattagttctaattctattctttgggctggtacagatttaatctggtccttcatgacaatacctgaagatgtttctagtgggccccactagattacaaactccttgagggattgatttaaatgacaatgacactaacacctaatggaggaaagagatccagctctcattttgtactctccacagcactgagcgagatcctttgcacatcactggcactgcagaaaaatgagaatgaatacacagaatgaatgtatcccttatccaaaatgcttaggaccagaagtgtttcaaatttcagattttttcagattttggaatatctgtgtaaacataatgagatgtctcagcaataggacccaagtctaagcatgaatttgtgtttcctgtataccttatatacatagcctgaagataattttagacaatatttttaataaacttgtggatgaaacaaagtgttgactgtgttttgactgtgacctgtcacatgaggtcaggtgtggaatcttccacttgcggcatcatgttggcactcaaaaagtttcgtattttggagtattttagaatttctgattttcagattaggggtgctcaaccagtgtaaataacatgcatcttaaagaaagttatttatttttcctccccaaattcttcttttccatatcaggggtcagcaaactttttctataaagggccagagagtaaatattgtaggctttaggggccatatatggtttctgatggatggtctactttgtcttatcttacgacacttttagaaatgtaaaagccggccacgcacggtggctcatgcctgcaatcccagcacttcgggaggccgaggcaggcagatcacctgaggtcaggagtttgagaccagcttggccaatatggctaaaccccgtctctactaaaaatacaaaaattagccgggcatggtggcacatgcctgtagtctcagctacttgggaggctgaggcaggagaatgtcttgaacctgggaggcagtggttgcagccagccaagatcgtgccactgcactccagcctgggcaacagagtgagactgtctcaagaaaaaaagaaagaaaggaatgtaaaagccattctttactgactgaccatacaaacacaacccctgagtcaggttaggttcactggccatagtttgccaaccccccatctagatgaaataacactagaccctcaacaatatgacttggtttctagaactctcctaatcctggttatcttcacatgaacactccccaatttaattaattcccccttaaaatataacatgagaacaagactgccatgactagaggtagctggcaggaacacacctgccacagttgtcctccaatcctattgcttttcctaaactccaaggattgtgctaagcaccaggagtaaaacacataagaataagaatggctccagcactttagaagtttatattcttactgaggtgacagttagacctatcctgaggaagcagcatatatgattttgtggcagatgagtcacagaaataagtatctcatgcccactgagaagcagaaggaaggggcctaaaacaaaagatatccactatttcttgaacttttaccagacaggataactgcttctacttcttagctcctttgttcctcaaaacagctaagacatagggactacttttatctctgttttacaggtgaggtttacagagttgaagtaacttcccaaaccacagctaaaacatggtaaagaagcctttgaatgtggcctgtctggctgcagagcctgagctctttgtctctgggctataccgccttcctggtgatacagtctgtggctcccaacggcctacttcctggcagaggctggcatgtcccttcatcctagttctgtaactctatggactaagattcccaggaactccttcgagatactcctcttgatccaggtgctagaatatgaaagcatgggcaaaataagactggcaggctaggagatcaggaaacagcaccaggaaaaaactaaggagggctgtgaaaagcaagaccaagtataggaaaactcagtctcttaaaatatggggatttagttattttggtagcagagctttctggatcgctgaggatttgcaaactcactttaaagaacaaaagagtcttcaatttactagtggcaggtagaaatattttcaaaatgtattgcacatgtctttgctttcttagaatacccccccgaaaaggactttatgactcagatgtatcatgaacatgtcgtggctatgttgcaactcagtgacatcattaatgcttattaaggtatagatatctaacctattcactcctaccataaatgattcaagaaaactggtgtgagttttcatacttatgtctgcttttcatttatttctgtttcttagttttcagctgttgcttctccttattatttgcttctaataggctcttcctacgtttcaactttagctaggatatcagataaccagggttattagaattatgtgtaaaacaagaataattgactctgaagaagtacctgaaagttcagtgcatgacttttactacatgaattttgtgacatctcttagaatcctcattttactaatttcttgagaccttgtctcctcccttgctcccagttcataagttgagatcaactagagtaactaagggtcaaatggagtccctagggaaacacagttaataaggatggactgagaagtaaacaacagaagagagctttttattcaactttaaattgtactataattcttgtagccttgtgggtagggaccgttcctcccatctagaatgaaaaagagtggaggtttcatcaattgtctcttaggatgtgacaagctctcactgactggtaggctcctgctactcccctacagagttgggagtcagaaggtcagataaagaaaggtcagtgtttgatggtttaatgccatggatgtgtgtgggaagacaggataaaaagagatctgtggtcagtcttgactctcataaatgtcattcctccagggctctagagactgtgaacctaaaagatgcactctccctgctgtgccgcagtgtttatgccaggattggctccaggcccctggctaaggtgtccccttgctctgcaccagctcaggcatttccagtcactcagtttggtctttctgccctcccacttgtcctgtccccctggtgtctcagagggtgctctgctcaccctggggtcagagccctgactctgaagttggggtccctttctcatttgcaggtggatcctgctactcattccacagcgctcggcctggtggtgggtggaggggctgctgcagctgcgagcctggccccagtgggtcagtagctggcttgggtccagagttgctttgctcttctggaacaggcacctctgtcctcagaactagcagcaggtctcactccacatctggaaaagttcaaaagtgtttgtctaggtgaaggaggcccttcgggggaggggattcaaaagcatgacatcatctcagtcaggcccagcttcctctggagagagaaaagggctgggccagggtggaccagatggggtccccagtaatcagtatgctgggggcgaagaggaagagagcaggcaagaagaggagtcttggaatggtgtcttgagaaggtgatcctttaattcagtgtctgaatactgcccccttggatgaattcagatgaatctgaccttaaagtcagagtggtgagagggtcccatctaaacaggaaagaagcctggattggcttctgcatcaatttattttgatcaacccacctcctgtttaagccagatgggagcccatccttttctctacagagatgtggggaataaattccgattttttggcagtttagacccagcctaacctccttgttgcatctactcaagagtcagctaaacgtcagtgttccattgctgcttcccttcatgaactatggccttccttttgggcagcaccttggtgattcaggctcttcatctctaagacagagatagtgatattccttctccccactgcttacctgacacataacagtaagacacgattgctgcagtcaccattaatagcaatctgcttgcagcaggttgtggaaggaagcagatatgagagagtgaaacccttgtcatcacctttagggaaaccgttcttggccccaggttgatggccgtgaagccaaaagtctaacttccctcttgatcctgagggaaacaagagatgtcattctaccttgctgtttacctggaaatcgctgaaaagtacagatctagatcccaatcaggaaaatttagagacaagctttagggtggcctgggaccctcagaggctcttccttgaagatgcaactgcctttatgaactctggataccaagttcacccttaacatttacaaggcccaaggcaagagtacaacagaggcctacatactatatttctaaacatttcaaggttgtaagtcaggccaactaactaataaaatatcttctatcctcttaccttgacaaacatatcttcgtgatcacctggaaggccaagtttcaatttgggatgctcagattcttggaattcactgccacagtgcagcttagcaggaagagatggctcctggccccagcccacttcccttcatctactttctacccatgactctggctcacattgcaaggcaattgcatgtgtgcctgggacaccccacccacaggcttaagcactaagcactaactcttctccctgcaagcagtcatcatttggccaccactgggccttgggggtgtacacccttgtgctgcagttccccttagcaggatggactgggagaagcggcccatcgtggatgtgagcaaagtgccatttgatcaagaagtgctaggacttctggtccccacagtatgacctagaagagagggtacatcctgattggtcctcacaggaagcaggacagggtgtgggctctttgaggcatagggttcagtcaagaagcttctccttcctgtgtctaatgaggatactgactgggaatggtgagtaacatctgtaatcccagagctttgggaggccaagacaggaggatcacttgaggccaggagcttaaggttacagtgagctatgatctcaccactgcattctagcctgggtgctgtgatgacagagcaagaccctgtcttaaaaaaaaaaaaaaaaaaagtatgtatcccaggatatacagaagagatgtgcaaagacactcatgaagatcttcagagaaaaatgagatccaaaacattatactataatactataataacttagcatttgttatctcattgtttatcccagcaatccatgtaaggtagccagaaaagacccttacttaagaggtaagagagctgagatacatacatgcattaaattacatggttagttattggaagagccagaacaaagcttgtctaccttcccactacattgatgagaaaccagaccttgtgttccctggttcattagctgaattcctaggtcagagcatgctaaaagaagaaaaggaaaggcgaatgggtttgaaggccatgagcaaaaggatgaggggagtatgggaatgggaagtctgagaagtatagatttttaaggggatcgcatagagacagtgagtctagtgattattccaagagttagtatactggatggagagtgaccaaaaaagaggatacagtgaaaagaaaaaagaagcatgaccttttgcacacattagatctttgcaatatttatgcaggtgtaattttatattttagtatgtaactaaacatactatgaacatcacctcatagttccacgttgctacagtttttataatttttttctttctaatgtttgtttatatgattatataatgattatggtatattaagtgcatatatcacttatcctatcataattcatttagttgttcacgtttccctcctataaataatactgtatgagacatttgtatgcatataaatctttccttccctatgtcctcagggcaaatttggtagtgggaaattaatccactgtccaggagtatgttcttgttgctgccaacaaggggcagcagggaatgttctagacgaattctacctgaagtcaggaaattgcatcaggtgatatcaccaggctgatatctttaggttctgattcttcctcctcgtttccctatagcttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacaggtaaaaacagcatttgtgtcagatcccggagagatgctggtgatgcttgggtaaagcatttaggatgttttcagaccgctcccctctccacagaggaaattatacaagtccctagtattaatgacttgagtatcatgcttagggtgccctgaagtaagttctagataattcttccttcagtgacagttttctcaggcccatgtcttgggagctgatcctgatcagtaatgcctccataccccttctctcatgctgagtctagcttagtgataaaataaggatcagaagactcaatagagatctccgatctcttctaaaggaaagaaggtgggtacaggtccaaactgggggtctttggcttctctaaggtagaccagcatctatttcagtttcaggacacctctaatacattctagattctagctctggttccaacagcttgaaatgagtttggtcagggatgggacacgaagtaactgttaactccccaaactcccttttctgtgttgaagtgcatgcccatatcatgacctgagattttgtgtatctatgagcacatgcacacatgcacacccatgttttggtctcttccagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggtgggtgaattgggccaaaaatggcagattgcccctcacttcatatgtatgcaggcaagctgtttctttccctccacccctctcctcatccctgccagtgggatttgggtcatgtgggaatcagcacggaaatacacagtttaaatattgctgggagaagtagaaagaggaggaaaggggtagagttaggtggtaaggcccatccaggctttgggtattgcattttagggaatagagagtaaacgggattctcagagatccatccaatcctctggttctttctagtacctatcagtggggctttgaccaggacaccatttccctttgggaatatttggcaactattgcttatttgctggggctgcttctcccacaatggttaggacaaataacatttcctctacatgagagggtttggtggttgtgccaggcacagagaggcagtaaaggggggcattggcaatggcaggaactgggcagaccagggatggtgagctcagcctggccttctcagccttagggcctatgactgtcaacagctttcagcatgcaggacagaaaatatgagggcctcagtcatgagatatgcccgagggatctttctgctttctgtttttaaaggagccagggccaggcgtggtggctcatgcctgtaatcccaacactttgggagcctgaagtgggcagatcacttgaggtcaggagttcaagaccagcccgggcaacatggtgaaaccccgtctctaccaaaacatacaaaaattagctgggtgtggtcatgcacctgtagtcccagctacccaggaggctgaggcaagagaatcacttgaaccagggaggtggaggttgcagtgagccgagatcatgccactgaactctaacctgggcaagactcgatctcaaaataaataaataaataaataaataaataaataaataaaagagccaaaatgggaatttggagagtcctggaggccaggagaaaaaacaggtaccccagcatctgctggtccaccccattatccctgtttgcctatatggccttcctgcaagtttgtgattgactggagagaaaacaacccaaatgggaaaagatcctcccctctcccagtcctgcaccatccaagccagtgtttaccaaggttgcaaatagctgcttgccagtaagcccaggctagtaacaaaagttttgtcatctgatgaggatagatatgaaatagacgagagtatgactattagaaatctctagtcccctgacaaattttaaatgtccttttccttaaaacctcctaagagagcacctcacagaaagcaaactggaaaaagttgggaaagaaatgaggagcaaagatactggcttatttactttgtttttgttattgtttttgttttaatacaggcagaaatcaaatgttcaggcatcagagaagtgaaattgactcagggcatctgcctggagcaaaataagacctccagctgtgtaagtcaaccccccacccaacctcttcctcccgcccctgtccctttcctccatcccttctgaacacccttaaaccttcttggattgcactggatttgagtaggggtccggggagtttagcttggtcagcctgcctttaatactgagctttctgtttagggagtaagaggccccatctggtgggcaaaaaagacaataacaattttaattattaataaattttgttatttttccatcctctatagtactttttccccctcctctatagtactttttaaattttcccctcctctgtagtacttttaaatctgagagagtcagatttaagttgctttttggttaagaaagtccttctcactcaccagatataaactagtcacctaaaatgtcagttcatttattatttcatttattattattaaatatttacacgtaactctttaatccatatagaatttattttgctgtaatgttatattttccatgtaaccgtttttcctaacattatttgttgaatgactccctcttctgttgcatgggatgtatcctttagcttatattaagtttttatatgtcttagggcatactcttcagacatattttatttgttcagtttgtctgtacttttgcctattttaaattttcaaaattattgtatgtttttactacagtatttgtaatatccagtcaggcagatctttttttattacactgtaaaaaatgtaaattatttttttctttttgaaaaaaatgcaaaaaaaatgctttaaaatttgaattgtaattgctctaaaatttcttcattttttctggttttcttttgcatctctcagcatcttgtttctttagcttttttctctagatttgatggatgtcataggcctatttgtcacatagatctcccactatatattcaaattgattgtcactgatagattaaaaagttaatagagttttgaacaattattttgggtttggccagtttcttgaatttgcctattgattctaggagctttttagttgattcctttcaattttaaggtaagctatcttgttatctactacaatatattgcttttctcctcctgtttagtagctatgcctcttgtttcagtttcatgtcttactgcattggaaagaatgtacagggaattgtgttattttaaatgattctggcagaccttgctttgtttcagtaaatctaatttcctaacagtaacatggctctggaggaaggatgaggtgaaggaaagagtggtatttacttacagaagaaaacattttcttacaagttggggatccatctaagggaatcacatatgtgatgtgctggcatgcatagactggaaagatcgcagcctgtagagggcttaaattacttattttttccattctaactcggtagttttactacgatcatcagttgggtctctctgacttacaaatttgtaaaaattatacctgaaagaatttaacttaggacatctaaaaacaacagaaatagtgaagacatgagtttgcatagtagaataactaaatgcagtctgcaaaatagttaacttaaacatgaacatacaatgtacaagtaacatgcagcatgtttctgatgctgattttcaactcaactcattagaaaaaaaattgtcaagttctttgctagttgtagccaaggaaaatgacgatctttccccctgcaaccccatcgacttggtggagcatacattttgctgtgtatcacacaggtatgtgccagaatgctaattctttgtgcctggaatttagagttaactgcagagcctttgcctttctgttgctcttcaaagctcacatgtaacttgggtcactgtatgagaaaagtgccagaaacttactgctcttttagaaataattcctcctaactctgctgtggtctttgctgtctggcctacttcgtgccacagctgagaaggtctctgcatgttcctctaagattgaggtagtatctgtgagtggggatgtgaaaagagagcagctcccctccagttcctatgccaaagaagacttccatccacactgccccttcataaagcaactctgtggcagctcatatgagtgcttttgttcccctggtctctccaccagtgttgatcccctttcttcctgagggctcctcatcctcagcccccatgcggcaaagcctcctgctactccccaaggtaatttatcctcagcttgctatcctgttccaaaatgtttagccacagctcccgattatgtccaagatgacctttccttggtccctactccctgcttgtctgataaacaatctgttccaaaagctgcgaatgctgcagagcctcctaattttccttaggttggatttgtactttcggtgtcagagggccttaaggtattggttctaatgttgggagcctcaggccctacctaataccctggtgaagagcaggaaggatttggtttccccgagcatcacatccttgatgtatgttggtatgctcctcatctaatatatgcccataacaggaatatatgtgcatgagtctagctatccagacactcattctgcactgacacatagtgagtaccaatatgttagctcaccctatgtggattctgtaggcgtgtcttctgtatgtgcattctgtagacatgtctatcccaatcactcttttttttttgctccccagccatcatctctaggcagccaggggaagggaaggtgataccactctcatctcaaacaccttttaccatatctcagcaccctcattagtaggatgtgtcttcctgagtctaactgtcattcttttggcagcagtgtcagcttaatttagtttttgtggttgtggttccccaaatagtttccaaaatgtaagattactttatactattatgctacacccatttgtccagagaaacccaccaaaatatttttaattgtggtaaaatatacataacataagtcatcaccttaaccacttttaagggtaccattgagtagtagtaagtacgttcacattattgtacaaccaatctctagaactgtctgcatcttccatcactgaaactgtgtacccatgaaacaactccctgctctccccagaccctggcaactttctgttcctatgttcctatgactttgcctactctaggtacctcatatgagtagagtcatagtgtttgtcttgttatgtgactggttgatttcactcagtataatgtctttaaagtccaaccatgttgtagcacgtgtcagaatttccttcctttttaaggatgaatgatattccattgtaagtgtaaaccttgttttgcttctccattcatctgttgatggacacttgggctttttcccctttaggctaatgtgaataatactgcttttaacataagtgtacaaatatctccttggcaacctgatttgagtccttttggggatatatccaaaagtgaaatggctggaccacatgggaattctatttttgaatttttgaggaaccaccagaccgttttacattcccaccagtagggtacaagggttccaatttcttctcatcctcatcaacacgtgttattttctgggtttttaaaatagcagccatcctaatgggtatgcggtggtatttcatggtggttttgatttgcatttccctgatgattagtgatgttgagcctctttcatgtgtttgttggccatttgtatatcttctttggggaaaagtctagtcaagtcctttgtccgccaatttgtatacctatctttagtaccacatctgtttatatgcagagtttgtaattactcagctagctcactttactcttattcacattgacttcatctgaggcaggctgcctccagcttgcactaaaggtcagtttccatgcggaaaacataagttacagatgaaggatttatgaagatggtgtgtctactggaaaaagcctgcaatctggaaacgatctcacttctcatccttcgttagctgcccccacttgttaggtgacttgaaacaggtcccttcattattccattttctatgtgaaaatagcgttttcacctgcattgtcaaactcacaccaaaatagataaaattatattaaaaggggttgggggagatgattgatcctagaatctcagcgttctaggatcttaatatcttaaatatcttaaaggtcattagaaaaatacctgtccctccctcacccccatctccgtccccattgcaatgcttgatgttaagagtctttgcaaagtttgagaatgctactctagagaggttagatgggtttattgtgtttgcagagaaacatgtgtgagctgatgtagttaggagcttgtaaatctgattctcatgaacaaaatggtgaggctgtgtcttcctcctgcccactctcccgtgatgtttgcccacagcctctcttgggggaggatgtttattccaagtgtccggagaagcattgtgctttgttcaggatccacctgctcctcttggggcccaaacacaattcactgatgcggttggattccagagtgggaggctggccgctattattcccttgaatctagtccaagaaactgtgcaaggggtggagggaccctgtgtggaggccaactggttgggatgttaagttgaacaacaattccctgagttcttttgtttggtgccacggttcatgcagtctgggttgtaaatgctataatgtgcactccccccaacacacacttaggagtcttacaatctagtcacagaaaaatgacaataacaatgcatagaatatgatcaatatgtagactctagatgatatggtatataaggtattactattattaataatgatagtagcagctgctatttatctagtgcccactagattctcaacaccacattggacacttttttttttttgagacagagtcttgctctgttgcccaggccggagtgcagagtgtagtgttgtgatctcagttcactgcaacctctgtctcctgggttcaagcgattctcgtgcctcagcctgccgagtagctgggattacagatgcccaccaccatgcccagctaatttttgcattttttagaagagacaaagtttcaccattttggccaggctggtctcgaacccttggcctcatctgatttgtccatctcggcctcccaaagtgctgggattacaggcatgagccactgcacccaactggacactttcatacaatatctatttagtcaccacaacaacctagtgtacagctgaggaacatgacactcagactagttgcatgacttgcaaagaatccagtaaagagcagagtaaggattgatgcccagtctggttgaaggtaggaccagcttcattgaggaggtagaaactgagttgagtcttgaaggatagtgaataccagggagaaggtagtgttcttcattctctttgaaatgagggttgtggaataatgcatgctgtccccatcttgggcttcctggaggtggggcctcagttccaaatgctcttccccactggcttcctctgctcaccctccagccattcttcaaggcctatagtgacatgtgtctgctaaccttaaccagacgtgtcctcacgctccttagtatgtccatagcactttggttgtacctttcttatggtgcttaccatggcagtagctctggcctctggagtctcttcacgcctccatttcttcatctacaaaattagtagaataactctaccaatctcgtaggtcgtgtgaggcctaaatgagttaatatatggaaagcactcagaactgtgcctggatatcataggcatctgttactttattttttatttctttatttttgagccagggtctctgtcacccagggtggagtacagtggactcaacctctcagggtggagagaccctcccacctcagccccccaagtagctggtactataagtgcatgccaccacacccggttgaatttctaaattttttatagagatagggtttccctgtgttgcccaggctggtctcgaattcctgggctgaagtaatcctcccacctcagcctcccaaagtgctaggatgacaggcatgagtcaccgcgcctggttggcatccatcattttaattgccgtacatgcaaactgaaagctttgacaaggtggaattcatagatacctcccaatccccacccccctacacatgacacatgaatacaacacacatacacatgacacttgcacagaggctttcacgcagtgtcctatattcagggcttgatacattgtcaaggtgtggcttcttgcactcagcaggtggaggaaggtgccatttggtttggctagtttacaacctgcaggagccctgtccctctgcctctcttgggaagcagacctatttcaactggagatacttcagaagcccagagtcatccaggcaagaaaccccctcctcctcatccagactctcggtgctggggagcgggggtgctcaaggggaagccatgtaaggctcccctgagacaactgggtttagagaggtggagactgttgattggttcagtgtggcattcagactacttagttcaaatgctgttcagaaaaacggatttttccagagttagaacgtctatccaaggacttactgggagacctgcagaattgctccttttcctgaggaatgaagcagcagtggcctgagaactcatttctctgtagccttgtttcctgggggttttttgaggctccagtttgggctcgtgtctctgtgacctggagtttggctaaccacactctcctggccttatccaagcccagttgttttccctcagctgcttcaaattccagctgggtcctgaggccaatcttgaccttgctttgtgtaggagcaaaggagcctgggttttcctgccttgggtcacagcagtgggaaaatacccaggctccattccaactgggaggaccctgtggccttgttgcaagcagcggccctgcccgcaaacaggaagctttctcctccacagagacccagttctgatgatggtcacataccccagcagttttcccctaacaggaaagttgtcagggctgttcaggcatttccttctctgccatctgccatccggactgaagagaaagtcttagtttcaattcctttcctgttcaggggaggaggacactctgattggaggctgctggaataaattctgactcactattgaagaattatctgagtttttcttctgagtccaaattcctgggtctgatggcccagtcagcaacctgaagaaaaatctatgaacttcattaaaactgggttccatgcttttaatggaaaacagagatggaagacgagacaaaaatgccatttcagtttgagcaatgcactttttgagactcctttgggtagaaagagggaggaggccactgaggtttccactgagtgtatattatagatttgttctctcctcctcacctcccttggcttttcttccatcattggggactgctgtaatcttgaaacagaatattttctcttagttattattgcattattaatattttctgtttttggccatttcttttgagtttaatttgcatatgtgtacatgggcaatgcttcaacgagacaatttttttaagtttgttctctaacatcttagatactagaagatatggattttggtcctgggagattatttaggtttttttcttattgtgttgttgcacatatacagttagcagttttttttttttctgttggaattttagaaacaaggatccttcttgcggacggggtaagagtatgactgtaatcagagactctgggtgcagtttagggcagagcagtaatttcatctcttgctctccatgtttctctgtcttcccaggcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacaggtaaggtgcacctctgcctgggggaacagggaaggagtagggctgaggttagagaatcctgggtggagatggggcatcttagatccagagagaccacaggtgctggggagaaggacttggctggctttgggagcggtccccccgagatggaccaccctggccatcagagcatcttctagaacagcatgggagggtggagcaggataagctggtttctctttagatttagcaacccttgtttctaattctagaaatttccagcaaactccaacttatgaaaaagcaccaatctgacctgaaaaaggtaagtcctctgagatgatgggcctgagagggaatgccggggcaggggggctccctggagtaaggggggaagtcattatcttccccagttctacctaccatccttctctgagtcttctcctttctagtcttgaaccaaaaatggtggggtatgactgaattaagagacgtcagtctcaaatcccatttcaaaaattcctgaggtcaatgccctcaagcatctgttcactgttgagtcacacacagggggctggagcgggctgggctccacttttggcaagtgacaggctgtatcttctttgtcttcttttcaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctggtcagttctgggggccagggtaaaggaaatgaggaagatagtgggtttctggggagttcagtggatgtcatggagcaggaggagaaatactagaaaaagcccttctgtgagcttacataaagatatgcatgtgtgcacacacagtaatcggtggaagattcaaaatattatgtagcaaactggggaggggacagtaatggtgccagcccacctactcggtgtggtagcagatgattcgtgtcatctattcattatgttttctgggatagttcagcttggggccaccagaacaggctgtttaatcagccacactgtatttgcaaccgtgttaaatgcccagtgggtgcccccttgctcaaaaggaggtatacggaaggagaatccccatttgccattctggatgagggaggacaaggctgaggtctgaatcttggcctctggcctgtcccctaccctggggaggtcatcccacccttcttggaactgcccgttttcctgcgggagctggctgccgagctgcggtggcatggtgtggtgcctctcctatgtcctttctcctctaggagctggaaccctgaccactcttcaggaagaaaggagtctgcacatgcagctgcaccctccctccgatccttcctcccacctccccctcccccttctcccacccctgcccccacttcctgtttgggcccctctcccatccagtgtctcacagccctgcttaccagataatgctactttatttatacactgtctagggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcggctccctggagccagactctggtcttctttgggtaaacgtgtgacgggggaaagccaaggtctggagaagctcccaggaacaactgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacacatctgttatgtgactctgtcttagctgggtgtgtctgcatgcaagagtgacaccctccattagacctagctagactgtgcagtgatgtggtggggaggaccagccagggaagagggagcacctcagcagacacaggcaccagccaggatgctaaggacctttagccaagtctgccaactattctcctccatgaggagaggaaacatccatttccagtggtagaaaggcagacccgaatgtaccagggagcttccaaatggagggtggtatgttgggttcttaggagctgtacccttcatgaacacccttctgagaagaggagcatgctgatcactgctgcaaaatatgcaaaacaaagggaaggggcaatgtcctgtgcaccctttattatcaggccacccccctccccagccccccaggtcagagtagacacagtgaaggactatgtggggactgttgttctagagacctggcagccaactcagggagggggctggtttccaccctcaagattaagacagcagcctaattaaaaaaaaaatctgtaagcatgtacctccccccagcttccaaaacaacccccaccccacccctaccaggccataggaagttggggagggagtgctgaggagctccaggaaacactcccaagtgtgtcgacagtggcagaggcagttggggccaaacaaaggttgattcttccattcttatctccataaagccagacctttcccttcagcactcctccacccccatctccttcttgcttttctccaactcctctaatcataggttcttccctaggacagaggggaggcgaaatgatgaggttcagagtcttccctcaaaggcgatggctgccttgagggttggagcaaaggatgatgagcaaaagacgatggtaatcagtagggaagtccagcccacttgcatctagttgcacatcttgccttgagagtgatccagtgagggtctgtcccagctaggacatcaagtaggaggggtgggttcagggttcagattcctaggaaatatgggaggagaggaaaaggcaacttggatgcacctccagcttcaggcctagcaacctgcaatgcatctcaccctgagtttgctggaatgtgtatgtatgctttgggaggaagggctgtgtgtgtattgcggggtggggtggggcagctggttccctctgacagctggacagcttgccctgaagaatttgcctgctttctggaaaaatccaactttcccaccgtgggcctgagcgtcctggtacagcaatggcgccacctgctggccttattgaggtcctactgctcagcctcagctcaatcgcctccatgttgggcttctctccctggctgccccaccctctagtccaatttctcttgtacacaaagctcatataactatagaacgtcactgttgaagagaactttaaagatacatttaattaaactcccttatggtatagttaaagacaaactaaggctcagagaagggaggtggcttgcccaatcacccagaattccaaagtcctgaatctgtagttttcccttccatcatatcatcctactcttctgccgagtcctccgtgttactccagttggatgtcatgaagccagtgtggcagtgtgaagataggtttgggacttcacttctggagcatttcatcaacataagctatcctaggcctggccagccaagcaggtcctggaggagccccaggacaaagatcacaggaggccatgaggttcggcttcttcggcgcccacagtgagcccaggaaaattagctgtagggtattacactgttgactatggagagcatatctggaattatcttcagccagattttcatctgaatggataaatgggaataccatctaagtccagataaatagatcacttccatctcatcccttctaggtagattaatcccacacttcctcttcacacaaaaccagtaataggtcatcgattttgtgcaacaggatgctgc

SEQ ID NO: 14125 - DNA, 177797 bp, Human
  misc_feature (1)...(177797): n = A,T,C or G
tcctgacctcacagagctctggttgagtgaggcatacagagaagtagtcagtcagttgtaatgccataagatgcatggaatgatggatagtgaatcagatttgtggcagcaagaaggtaagtgtcaagcctagatgaggggcaatgggaatgcttctagaagtgaggttcaggcagagtctgaaagatatgtaggaatcaggtagttgacggaggccagatggaaagaatgttccaggcagaggactcagtgtggataaagctctggaagggtgagagcacactgaggaactgaattaagttccatgtagctgtattgtagagaatgaggtaagattgctaagtgtgatgagattgcagaggatccctgtaatgggcaaaaagttgacatctttggtgaatgttcaggagggaggacttccaggaccagatgtttgagtagataaaatgagggggcagcacccaggtgtttcttaaagatcgcttggtggatggaggtattggagggaagacgatgagttcaattttgaatttgaggtgcctatgaaatatgtatatggtgacacatagttgtagacaatttgaagctcggaagaaagctttgaccagaaaataaaaatttgggtgacatcagtgtatgataggatgaaatcatagagaaagagtgtgtagagtcagtgaagaagacttcaagaccaaaccttaacacacatcagtatataaagaacaagtaaagagagcagagtctgcaaagaatgttaagatggatcaggcaggaggaaggagcaaaataggtgagtgaggtgtcatggaaaccaagggaagactgaaatccatccattgggtttagaaatgtggaaaccattcatgaccctagcaagaatagtttctgtgtagaggaggggcagggaatgggaaaacataaaccggcccaagatagattgtagcgcattgagaagtcaacaaacaattatggtggaaagtttagttatggaggagacgatttaaagagggtagaagctggaaggaaatggagctgaggggcttttattataatattcttcaagctgctggaaatctgtgatgtttaaaggctgataggaagaattcattagtgataaagaggttgaccataagctaaaatagccagagttataactcctcttaaaattctttgcccagtctgtcctgttacctttcagtattctaaataagttaattccaaactaattttggacttcactgagatcttgttacacaagattgcaaattcctataaagtatgattcaaactattctacttatttgttctgggtagcatttagtgtcttaaatagagaaaattttcaacaaatattatttttattactgatttgtttctttattttttgagcaaatatatttaatttttaatttttgtgagtacatagtaggtatatatatttatggggtacaggagatgttttgatacaggcatgcaatgcgtaatcacatcatggagaatgaggtgagcaaatacttatttaatctccattgtatgccagacatttttctaggtgccaaggatgttaaggttaccaggccatacacactaccaggccatacataccccttgttctcgaggagtttatcatctagggagtcagttaatgaaataattatggattgcaaatggtacttaaaatggcatggtggtagacaatcatcttgagtggctactgtatatacacactcttttcctatgaacttttctttccattgttggagggagaataattacaagctattaaagagttaaatgacttaagatggaaagaaaaaggtagtcagtaacggagactacttttggcatagcgagtttactcctctgtttaccatttctaaaggtcatgggactctgatgcctataatgggctgtatgttttgcaggttttgttggttgatcattacttagcctctgagagactaaccaactctccatgttttctcttttcccttttagtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaaggtaagcttttttcattccgcccatttgccagacctctgttaacctgccaaacccacatagaagtcaaggatctgcgggtggccagggctggtattgaaacagaaaggagtacatgatttgtggcctgagaaatggcagtagagacagaatgtgggcccaggtatgtagctgcagtactttctaggccatagagagttagtgtctaggaaataagaaaataaaaaggagcccattcttctctagtgattctttaccaccaagagctaataaatgtgcatggtactgttctgacaaggcctgggaaatagaaagatgagcaagacagtgttctggcccttacagcattaataagctagtggatcgcacagtacctgctggtgaacttcacaattgaagaatgcttggttttagttgtaaacaatcatttaacctcactggacttcaatttgttcgtctgtagaggaaagtaaactaggtcacttggagctcaaaaattctatgacgaattcatccttttaaacctggcatttttataaatgcacacttttaaaaagggaatcatagaagtttactggctctaattctttaaaacctgagtccttgcatcaggagatgagattttgtttgaaagctacggaaagtagcttgttatagatataaaataatgcactttggtattttgtgtgtgtgtatgtcacaagaagcacaaaaataacaggtactgtattatttaagggtaagagaattgtgccttgtaaaactgggttttctcttttaatagaaacatgtaaatcctacaatttttatgacagaaattttatgagaaattcaaaaataatcaaatgcttgatctttctgattaacatttgataaaatttacctgcttagaacaagcagcatgaatttcacagctttatgactttggaaaagaatattttagtctcatgaatgtattactgttaaaagttttaatttctctctataattgcaaattttaaaaacatataaattcaggcttaatttttattttgcctgtgcccttaagaattgtgatggctggctgggcacggtggctcacgcctgtaatcccagcactttgggaggccaaggcaggcggatcacctgaggtcaagagttcaagaccagcctggccaacgtggtgaaaccccgtctctactaaaaatacaaaaattagccaggcatggtggtgggcacctgtaatcccaggtactcgggaggctgaggcaggagaatcgcttgaacctgggatgcagaggttgaggttgcaatgagctgagatcgagccattgcacatcagcctgggtgaccagagcgaaactccatctcaaaaaaaaaaaaaaaaagaattttgatggctatgcagcaaaatgctacacatgcatgcatgtttataaaatttactttcatgttttaaaacttttgatttgcctgttagttattcaggactaacaagttttcctcccaatctgttgtagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacaggtaaacatcatcaccgagcctgctttagcagtgtcttacagatatggtatcattttaacaagaaagccagacttgataaaaatgcttttttaaaaaaaaggctttgacaaactatgacttgtggccatatttttgtaaataaagttttattgccacactcatagccacacttattcatttacatactgtctatgcccattttcatgcgatgactgcagaattaaatagtccagtgagatcatatggtctgtggaacctaaaatatttactgtgtgtctttttacagaaaaagcttgccagtccctgatgtacagaatacatttatttatttatttgtttattgattgattgattgattgattgagttggagtctcactctgttgcccaggctggagtgcagtggcacgatcttggctcactgcaacttccacctcccagcttcaagtgattctcctgccttagcctcctaagtagctgggattataggcacgtgccaccactctcagctaacgtttataattttagtagagatggggtttcaccatgttggccaggttggtctcaaactcctgacctcaagtggtctgcctgcctcgtcctcccacagtgctgggattataggcatgagctaccatgcctggcttccagaaatgtttcaggaagtccatgattacctgtttctattttttcagttaggatgatctgtgtataaaatgtgtcaggcgtgagatatggtacagaatatatattccgcaaagatgcttgtaaatatttttgccttttgcagtagttttgttcatgagttttgaattcattgtgcaataataattcatgtcatctttgacaggaagtaatatttcatgttatcttttattttcttataaaaattcaggccgggtgctgtggctcatgcctataatcctaccactttgggaggccgaggcaggtggattacctgaggtcaggagttcgagaccagcctggccaaacatgatgaaaccccgtctctactaaaaatacaaaaaattagcccggcgtggtggcaggcgcctgtaatcccagctacttgggaggctgaggcaggagaaccactggagcctgggagatggaggttgtagtgagtcaagatcataccactgcgctccagcctgggtgacaggagtgagactctgtctcaaaagaaagaaaaaaaaattcataacttgcaaggtgtagtgcatgagttgtttgaagtgtaactttaggcctacatttatatcataaagtgagagaaaggcaaaattttctttaaaactcatcattgaatgtgcatagcgaagacaacctaaaagcgttggttcctccactccattatgtggtaatgatggaggcttcgttctgtggtttccctcctgtcttttggttatgggttaaacccctcatgagaagactagatgagatacatttattattattcctctgcgatgtcttgaatattaaaaatatatcgtgtgtgtgtgtatatgcgcatgaaatacttgggagtaatagaactaattgtcactgctttagaaacctgggaaacacttttaggtagtaagtcaatggtaagattgtcacctttcttctaggagaaggaggggagattgtagacctgaatggaaggcagcatatgggaatggaaagagcatccttgtggagttgtaagaccttgattagagctgtgagcccagcactcggtaggagggaagtggcttccttatctgcaaagtagagataagatgtggggctcatgagactttgttaagattaatcaagataatgtgagccctgctttgcaaatattatagaacgatgcaaatattagcttagagaatatttatcaagatgagtcaaacttaagcagccatctactatgactgtttttatatcatgtgctttcagtaagataggggacagcatcgatcccacaaacacagccctcattggcctgtggacacctgaaatgcgactacaggggacctaacgtggcttttcattccccagttttgcaaatgcttttgggagaaggaacatcagtctaaatttagcttaaaagtaaagacaatgtttatgctaagggtagattttgataaggacagtggggctgaagataaactttatacacttcacagctttgcactgaactagtcttggagagggaggacaaatttcgtgccatttgcattgtttattcattccagcttaggttggtcatggagaaaggaaaaagcagatctttttaaaattgtgtgcccagtacctttctccccatttccaagttggaacacagatgataaaaagcaagaaaatgaggcataacaaacttgttattcttgtataatattaggtgattgttaacaagaaaagatgaaaagatactattgacttgtaagcctagagtgtacaattgaaatgaattggctaattgatggagttacccaaataattaaaactctggaatacttttgtcttatctgcatacatctctgacttttggtctaaaagatccaaacagtgatctcaattcttaattcattttgcatgtgtactcactcatacacagcttcaaaataagacctgttttttggaaagcattctcagcatatatttattggtcttcctgttcatgaggaatgttgctggatgctaaagactgcccaattaatttgtgcaattagggtgaaccaggcatttaaaaaatacattactggcaaataatcatagtgtgtaggtgtatcctactatcctacaaaggattttgaaaacatttgtgctttcttgctgtggttggtttgcaaacgtagctatagccaggaggtataggtagattttaaatggcagataatccaaaacaaaaacaaaaccctggataaatgctcactgttgctttgctcagtggagccgtcttattaattgcaagtgtcaaacattgagactttcaatgcaatagttaccaataaacatctatgtttatatgttgctatgagaggtcatatacaaaataaatttggcagagatagcccttgtttctgtggcacattctaataattaggtagtaaacttgggattgaacaccaagatgaactgtgatcaacgtatttaaattcaggaaagctttgtagggtagaatttcagaactgtttggagggtggaggaaaatggatgattgatgaggaaaccaagctcacagagcagaaagggagagtaattgaacagaggaaagagaacagtacaagaaatgggcagggaagagttgtcagaagagatcagagaagtgaaatagcttgggattcttggcaggctattgcacaaatattaagcctcttaaatctgaggcatagtgcagtataaatgacttgctggcaaggtcagcgtgtcaggaagcccctttgactaagtgatcaactcagcgtcattaatagtggggcagcctgaccttatgtgcctcctgctgtgagacagtatagagtgcagaattacccatgaagtgttcttgccaaatatatctaacctgaatctaatcaaacccttagacttaaccccaagtttacagggaataccaagggtaaagaaacaagttaaaaacatcacactcagacagaaaaaacaatcagacattgacaacgtagggcattgttgcctggtttcttaaaaaaaaaaaatcagagtataaaagaaagtgagatgatgtttgtagaaagagacacaaaaaataagtgtaatatattcaccttaattaaatcttgattttttaaaaaaaagccagatctaagagatattttgggaatagttggggaaatttgaacatgagctctgtcttagtccattttgtgttgttataacagagtgtcacagactgggtaatctataaagaaaagacatttatttctcactgttttagaggctgtgaagttcaatatcaagatgccagcatgtgaccagggccttcttactaagtcaccccatagcagaaggacaggagaacacaagagagcaagggggagctgaacttgcttttataacaagtccactctggtgataactaacccactcccaagataatgacattaatgcattcatgagggaagaccctcttattaggtcccatactcctaacactgtcgctttcaggggattaagtttctaacacatgaactttgggggacacattcaaaccataggaaatgtcattagatgatattttggaattactagttttcttatgtgtggtaatagtattgggattatgtaggaaaatatccttattcttttttgtttgtttgttttgagatggagtctctcactctgtggcccaagctggagtgcagtggagcagaggtgacactgcaacctctgcctccctggttcaagggattctcctgcctcagcctcccgagtggctggaattacaggtgtgcaccaccacacccagctaatttttgtatttttagtagagacggggtttcaccatgttgcccaggctggtttagaactcctgacctcaggtgatccacccgccttggcctcccaaaatgctgggattacaggcatgagccaccgcacccagcaggaaaatgtccttattcttaatagatgaatgctgaaagttttaggggtgaaattccatgatgttcgtagtttacaggcacactttcttttactgcacctcacttccactctttgtagatagatattgtgtcttttactaattgaatgaaggttctggcagccttgcttataggcaagcaagtttttctgacagcatgctctcactttgtgtctctgtcacatgttggtaatttttgcaatatttcaagaccttttcattgttgtatctgttatggtgatgtgtgataagtgatttttgttactattgtaattgttttggggcatcacaaaccacaaccatataagatggcaaacttaattgatacatgtgtattctctgactgctctaccaactggccattcccccatctctctccctgtcttcaggcatccctattggctgaaacacaacaatattgaaattaggctaattgataataacacaatggcctttaaatgttcaagtggaagaaggagtcacacatctctcactttatttatttttatttatttatttatttttgagacagagttcttgctctgttacccaggctggagtgcagtggcacgatcctggctcactgcaaggtctgcctcccgggttcacgccattctcctgcctcagcctcccaagtaactgagacaacaggcgcccgccaccacgcccgggtaatttttgtatttttattagagatggggtttcaccgtgttagccagggtggtctcgatctcctgacctcgtgatccaccctcctcggcctcccaaagtgctggggttacagacgtgagccaccgagcccggccacatctctcactttaaatcaaaagctaaaaatgattaaccttagtgaggagggcatgttgaaagccaaaataagccaaaagctaggcctttgcatcagttagccaagttgtgaattcgaaggaaaagttcttgaaggaaattaaaagtgctactccagagagtacatgaatgataagaaagtaaaacagctctgttgctaatacggagaatgtttgagagaggtctagaaccagccacaacattctcttcagccagagctcaatccagaacaaggacctaactttcttcaattctctgaaggcttggagaggtcaggaagttgcagaagaaaaatctgaagctagtagtggttggttcatgaggtttaaagaaagaagccatctgcataccataaaagtacaaggagaagcagcaagtactgatgtagaagctgcagcaagttgtccagaagatcactgataaaggtggctacactaagcagccttatacctgaagaagatgccatttaggactttcatagctagagagaaagtcattgcttggcttcagaggacaggctggctctcttgttaagggctaatgcagctggtgacttttagttgcagccagtgctcataggctgttctgaaaattctatggcccttaagaactatgttaaatgtactctgcctgtgctatataaagagaatagcaaagcccggatgacggcacatgtgtttgcagtttggtttaccgaaggttttaagaccactattgagaactgatgctcagaataaaagattcctttcaaaatattactgctcattgacaatgtacctggtcactcaagagctctaatggagatgtacaaaaagatgaatgttgttttcatgcctgcaatcacaacatccattctgtagcccatggatcaaggagtcatttggactttcaagtcttattatttaagaaatacattttttaaggctattactgccatagatcatgattcctctgatggatctgggcaaagtaaataaaaagctttctggaaagagtttgccattctagatgccattagaaacattcatgatacatgggaggaggtcaaaatatcagcattaaagatatttaattaaattagatacttgaaaatgtcaaatcccacccttatggatgactttgaggggtacaaaatttcagtggaggaagtcactacagatatggtggaaatagcaagagaactcgagttagaagtggatcctgaagatatgaccaaactgctgcaatctcatgttcaaacttgaatggatgaggagctgctgcttatgaatgagcaaagaaagtgctttcatgagatgaaatcgactcctggtgtagatgctgtgaacattgtgaaatgacaacaatggatttagaatacgctataaatttaattgataaagcattagcaggacttaagaggactgactcattttgaaagcagttctagcatgggtcaaatgctatcaaacagtatcacttactacagagaaatatttagtaaaaggaagggtcaggtaaagctgcagacttcactgttgtcttattttaagaaattgccacagccaccccaaccctcaggaacccccatcctgattggttgacagtcatcaacatcaaggcaagaccctctaccagcaaaaaggttatgactcacagaaggctccgatgattattagcatttttaaagcaataaagtgttttaaaattaaggtatgtactttaaagcatagcgctactgcaaacttaatagacgacagtatagtgtaaacatgacttttatttgcactgggaaactgacagattcatgtgagtcgctttattgtgataataactttattgcagtggtcaggaactgaacccacaacatatctgagatattgcccgtagtttcagaggtattttacacacaagtagcacgaacttgactcttgagcggttcatatgcaggtgatcattgtattatcctttgaatatctcagtatattggaaaatattttagaaagaagggggaaaatattaaaatttcctagacttataaatagaatagtatattttaaagccgaatttaaaagctttcactgtaatacatttagagactttttagaaacaaacttaaagtttttaactgtttaatgggagtgttgggtgagtgtgaggtgacatgaggccaaggaagagaaattggccttgtgaaatgaccaagggccaatctaagaagtcaagttgaaaaaaaaggagatgactataggggattttgtgaggaatcaagcatcaggattgcgttacaggctgttgtgaagacaaggatgatgaagaaatgaacggttctgaattttcttctaaataaataaatgctaaataaatgctaactaaataaatgctcaccagagttgatttcttgacccttagcagggaggattgtgagaagatgagcaatgacatctttgttacaagcagcctcatccttgattaatattaggaagggtgtactcttaattatcagtcaaggaagtccagggtgttttcgagatggaatgctagagaattaatggagaaaattcagtgatcagtgaatagatttgctgatgatagcttaaattcatgaccacagaggacatttctttggattgcattataatgagaaaagagcgggaataatggagttaaaggtttctgtaatgttttctcaccttgacagagaatgccaacctgtagggaaaaaaacatttctattgttttgtttttgtaaaaagttacgtttagtatttcagagttctaaaaatatgtttaacaatcaaataaatcattggtgtttatgtgaattaggctgtctatataggcagtctctataggcatcactaaatctcctatattcaaagaacagaaattgatctcatagaactatatagggtgacagacaggagtggttttcttgaatataaatcaagtatgaagtagttggccggtcctaattttggcagagttaggtttctgtgctacctggagtaagttgtggtagtctacatatatgtgaaaacatttgcaagagtttgctcactgactgttagaatgacaattccagtggttacaatcaccagccacttcagggtaatctcatttttcacaggcttcaaacccgaacatttctgtggtagttatcatctctgaggagaggccaagtttcagaaaatacccctccaatttatttttgcatcataggaacattgaatatgttcatcttttttacataaaaatcaattgtataagggtgtcctttgtttttaaattggatctctttaacagtgacctaaattcaaagcttgtttggcatctgactttttgattgtttcaaacatgttttattgattgcccagttcctggaaacaaacatgtagtgacctagttatgccagatggtatgaaaaggccttctatgggaagcatttagaatcacagtatagagttcagggtccagcttccatgctgaacctgcccactgcctcgttgcacaagcctgtgctctttgttgaacccaggaacctgcctcgtaatcagacagaagcgttataaggggagacaaaaaattcaagtgcttcaagatttcctgtttcaagatgctgaaagatcagaaaattttacatataaatacctgagttaattaaaaagcaggtattccaggactctggaaaaccctgatttatacagcatatgttttaagtacagcactctaacacagataaagatgatcaaataacacatgaacccacttttatagtttgcaactataaaactcttagaaaatattttaaaaaccataagaaacaaacttttctgcatctattgagataatcaggtggtttttgtctttggttctgtttatatgctggattacatttattgatttgcgtatattgaaccagccttgcatcccagggatgaagcccacttgatcatggtggataagctttttgatgtgctgctggattcggtttgctagtatttttttgaggatttttgcatcaatgttcatcaaggatattggtctaaaattctcttttttggttgtgtctctgcctggctttggtatcaggatgatgctggcctcataaaatgagttagggaggattccctctttttctattgactggaatagtttcagaaggaatggtaccagttcctccttgtacctctggtagaattcggctgtgaatccatctggtcctggactctttttggttggtaagctggtgattattgccaccatttcagatcctgttattggtctattcagagattcaacttcttcctggtttagtcttgggagagtgtatatgtcgaggaatttatccatttcttctagattttctagtgtattagcgtagaggtgtttgtagtattctctgatggtagtttgtatttctgtgggatcggtggtgatatcccctttatcattttttattgcgtctatttgattctcctctcttttcttctttattagtcttgctagcggtctatcaattttgttgatcctttcaaaaaaccagctcctggattcattaattttttgaagggttttttgtgtctctatttctttgagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgcttcgaatgtgtcccagagattctggtatgttgtgtctttgttctcgttggtttcaaagaacatctttatttctgccttcatttcgttatgtacccagtagtcattcaggagcaggttgttcagtttccatgtagttgaacggttttgagtgagtttcttaatcctgagttctagtttgattgcactgtggtctgagagacagtttgttatcatttctgttcttttacatttgccaaggagagctttacttccaagtatgtggtcaattttggactaggtgtggtgtggtgctgaaaaaaatgtatattctgttgatttggggtggagggttctgtagatgtctttgacaaaattcaacaacccttcatgctaaaaactctcaataaattaggtattgatgggatgtatctcaaaataataagagctacctgtgacagacccacagccaatatcatactgaatgggcaaaaactggaagcattccctttgaaaactggcacaagacagggatgccctctctcaccattcctattcaacatagtgttggaagttctggccagggcaattaggcaggagaaggaaataaagggtattcagttaggaaaagaggaagtcaaattgtccctgttggcagatgacatgattgtatatctagaaaaccccatcgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttccaagataataaaatacctaggaatccaacttacaaaggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatgtatagattcaatgccatccccatcaagctaccaatgactttcttcacagaattggaaaaaactactcaaaagttcatatggaaccaaaaaagagcccacattgccaagtcaatcctaagccaaaagaacaaagctggaggcatcacgctacctgacttcaaactatactacaaggctacagtaaccaaaacagcgtggtactggtaccaaaacagagatataaatcaatgcaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatctcttctttataccttatacaaaaattaattgaagatggattaaagacttaaacgttagacctaaaaccataaaaaccctagaagaaaacctaggcattaccattcaggacataggcttgggcaaggacttcctgtctaaaacaccaaaagcaatggcaacaaaagccaaaattgacaaatgggatctaattaaactaaagagcttctgcacagcaaaagaagctaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatggagccaaaagacacatgaaaaaatgctcatcatcactggccatcagagaaatacaaatcaaaaccacaatgagataccatctgacaccagttagaatggcaatcattaaaaagtcaggaaacaacaggtgctggagaggatgtggagaattaggtacacttttacactgttggtgggactgtaaactagttcaaccattgtggaagtcagtgtggcaattcctaagggatctagaattagaaataccatttgacccagccatcccattactgagtatatacccaaaggactataaatcatgctgctataaagacacatgcacacgtatgtttattgcggcagtattcacaatagcaaagacttggaaccaacccaaatggccaacaatgatagactggattaagaaaatgtggcacatatacaccatggaatactatgcagccataaaaaatgatgagttcatgtcctttgtagggacagggatgaaattggaaatcatcattctcagtaaactatggcaaggacaaaaaaaccaaacaccgcatattctcactcataggtgggaattgaacagtgagaacacatggacacaggaaggggaacatcacactctggggactgttgtggggtggggggaggcgggagggatagcattaggagatatacctaatgctaaataacgagttaatgggtgcagcacaccagcatggcacatgtatacatatgtaactaacctgcacattgtgcacatgtaacctaaaacttaaagtataatgataataaaaaaaaagaagaagaaaaaaaaagaaacaaacttcaagattaaggtctttatacatattctacagaagaaaataaactttatgtggattaggaagaaaggaaaggactggtagttgatgtggaatcctgaaatcattgtgaaaactcttttttcctttaattattggtcatataaataataagccttagggcaaaattgggttaaagtgacacaagaactgtttgggattctgttagagatgccagaagttgttccagcagttctgtttggacaggaaaaatggaaacagaatggaccattggagaacaagattatctaattgaagataggtctcttttggcagatatgttcagtaacatcctaagctctaaagcttagcactggaacacacacacacacacacacacacacacacacacacacagagcattctaaagggccaaatagatatacttagcttttgtttaaaaaaacttaaaagaataagcttaatggagaaattaacaggaaaatatgagctcattgaagtggaaagtatcctaattgcatggctgaaattacttttttttaaaagagtttcaatacttttgtcacaggactttgaataaagaaaaatatttcttggtttccactggacaaaagccagtaagaagctggggaaatagatgtgatgcctgccaactccacatgggagaaaaagatgggtagatggttgggtcgatgcagatgagatgggcactttggaaatcttttctcagtgatgagaaatggtgttcatttaggggagctgagacattgagttctgctcagaaacctgctcttgaatttccgcagtatctctcctgtcctggcaacgtgaatattactgggatgaagcctaaatctatgattacaaaacaaacaaacctagttttatcctgacagaagtaatgccagaattattgtaacacttttcacactggttattccctaaactgagtccataaactatgtaaatagattagaagtctaaagaaaaaaatggttataaaacatcttacttatgtggaaggggaactgagccaggctgggtcagtagagggcagaggtgaattgtggctctctcttcctccccatcgcctaaggccacatgcccttatggatagggccctcccaggtgatcttggaccagtgcagtggcctgccttcttttggaggagctgctgggcagtgactggggaaggtgaggctgaggctactagacatctgtcttcttgctgagcagagagctcagttggagtgtgtgctgattgcatttattgaagcttggcttccttgaggtggaataagtcattaacaccaggcacttcctatgccatctgggcttttcttcagtgtcccactcaagtactcctttggcataatctaagaaatatttaattgagtgttactgagtctcttgtggctctaaaatggctgctctctgtagccatccgtgccaaaccttacctgcgtcaacagctgaaggtatcactgaaggtgtcctacacatctcactgataggtgctgggacttttaagtgttagctggtcttgttccagcaacctctgccagattgactttcgcgcaggggccctctagcctggagtcaagaaagatcagcagagacaggggtaagatccaaagagggaaaatcaccgcatgtgagagagaacatgtctgcatgtcactgggctcctgccagtggagaggagaactgctcgttttacttggattgagaatgtagggctgggacattaggataatcaaaatatagattcttagaacttcagagaatgggttgtgacccagacgttacccttcctgcggcccagtatctggtctttacccaggtagatgtcttctgggaaccaaagaggctgtcagctttaagggtccacctgcccggacctgtttaagagaagcaagtatgtgtttcttcattggttctccctaagcccctcctctcagattttttttcattttattggcaattaaaatgcctttatcatgacgtggaatatcaaattaccatattttatacctctagggctctataaaataatatacctattaataattagactcctgttcctacataggaataagcattgaaaataataattatggagcagctcagagtggaagcatgttgagctacttctgatattggcaaagtggtaagattttatggtcactgtgtttgaagatgacagttctgagcatgttggaaatagttttaagagacgatggcttgaattgatggttgattttggctctatacattttaagaaatggtttcaggatttatagctggtatttctgggctctgatggtctgatgtggctctgtgctatccctcagaattgagatttgctaaaatgaggaagaatcatctggtttactaaaaaaatcagtcctctgaaatctgccccataaagttgtagtgagagaagcaacattttttgccgtatattgaagaggacagagttctctcctgaaccttctctaagaccatgatagtactgtttttttcctttctcatccttccattttttttccctcttctgtctcctttcttaaataaaataatttatatatagaattgaatgttctatttcaacaaggtcactgtatgagactgtgcatttactctagtgacactgccattgggcaaatagcttggacacgtctgtgaacaagatttgccaccgttgagaatatttaaagtatgtctctagccttgaagaacattctaaaattcaaaatattttgtatatttctaaatattttaaacaaagagagcaatgcctccaagatgatcactttgcagaagactggtttagaatctgcaagctctaacggagttgttaaagaatatggtcttaacattctgtggcttcaagataagcctctttttttttttctttttctttttttaagagatagggtctcactctgttgcccaagctggagtgcagtggcaggatcatagcatgctgcaagctcaaactctcgggctcaagtgatcctcctgcctcagcctcccaagtagctaagagtataggtgtgtgccaccatacctggccatggggcaagcctcttcgtaagacaatgcatttttagaaaactgatagctgatttgaccttcaaaacaatcaggagaaacatgaaaagtagacatttatgtctcccatttatttatgtgaaatttgaggctcagagattgggactagcttgtgttggtatttccaagacaatagctctctttccattttagcaaattcatcatatcttggccctcagtttcttcatttttcaaataattggattggctaaggagactaccaaggtgtctttgagccctccaaacctctatgatgatttctacatctttgctcttttctgcaatcttagacaccactggtgctgacatatgcacaggccatatggacagatcaatgtcaaacagagtgaatgaataacctatacttgtctctcaaatgctactgacttagaagactcgtctttagtatcagtttctctgaaaagctttttagtacttcttcaacccacacttctctctgttccttaaatctttattgcatttagaatctaatcagacaattttaaatttaaatattttaaagttgttgcttttgtgcctcgtttctcttcctcaccagcttgcgctttttataaggccaggatcacttatgaattgatcttagaactaggcacacatgaattgtgggtaaatatattagattagtctaggttgtgcttcagtaacacattagcacaacaaagtttacgttttgtgtgcattagacatgttagaggtgagcagaggactctgctctgcatatttcagggacttgggttgatagtggttccatcatgttactgccatgttatccagaatatatggcttccttaattcctacagcagggaacgagaggttctgcaaaggaccacactcattccctttcccatagccccctgttcagaatgagtcccatggccatacctattagtgctattgatggaattatgcctcccatccccaaattcatatgttgaagccccaaaccccaatgcagctatatttggagacagagcctaaaaggagataactaaggttaagtgagatcataagggcagggccctgatgtgataggaccagtgagcttgacctctctgttgctttccccacacacttgcacaaagaagagtccatgtgagcacacagccagatggcagccacccacaagctaggaggaggggcctcaccaaaaatccaccatgttggtaccataatcttgggtttccagcctccagaactgtgaggaaataaaaaaaaaaatctattgtttaaaccacccagtctacggtattttgttatggcaatctaacacatagttttggagctgggaaatgtggggaaacaagtggctctttggggaacaatggatgtttctgccagaagagtcagggcagtggacaagacagacatggttccctgcacccagggatctaaatgaacctgttagtgttatttgtggctttcagtttttctacatgacttgcaaccaaaccacaggtaattattagttttgagttctgtgtacttggaagagacacagaaaaaactgaaagcttaaccaaatgaggcatgcattacaatttcacatagtgctatgaggcctaaaatgtttttggttcctttgattatctctttatagacatgaagcttaatatagaagatttatctcaatatggttgtagaaataagcattggaggccaggcacagtggctcacccctgtaatcccagcactttgggaggccgaggcgggcggatcacgaggttaggagatcgagaccatcctggccgacacggtgaagccccatctctactaaaaatacaaaaaactagccgggcgtggtggcagcacctgtagtcccagctactcaggaggctgaggcaggagaatggcgtgaacctgggaggcggagcttgcagtgagccgagattgtgccactgcactccagcctgggcgacagagcaagactccatttcaaaaaaaaaaaaaaaagaaaaattggagaagataggcatttatgttcatcattttgggggtgatcaggttgctatggtgatagtaatcatggctatatgcacatctttattccctctctcaacatgagtctttctttttagacacattcctagtaattaaacttaaaataaattcgatctactcaccatctagtactaggatttatcacatgatttgtgttgttttgccccaaggaaaggctaacaggaattatgatgtcagaatataatcatgataatactgtacttaaattttctttttgcaacttaagagcaaaacacacatatcacagcctggaagaagacttgactgttgaaatgttcaaatcattgtagaggtggagaaaataggcagcacagattctatcttttctttagaaaagatgtcaagtagaatcataagtttcatgcttaagagggttttttttcccttcatatgtgactttaaaaaccatttttgccttagtgtaacttttaaaataccgtttcataaactaaagtagttgtctggaattccttgaagcccatggtttggcttcagcaggttttaaacaaatacactgtcagaaatcgatgtggatacatttccagcagttaaatgctctagtcacagtagatactttgtaaaatcaatagcctgaaatatcagaggattatagttgtatcagattccccaaatgcctaacattgttttaattactctaataaaagaaagctgagtggacttaaaaaaaagaaagaaaaaaaccttgcctataaagaatgttctgctcaagccaaagcaaatttttttacaagttctcttagaaaatctggaagtatttatgcattttcctcttcttatgagacaatgcctgttacccagccagttctgcattgtacagtgctctttataacaacgacccttagaacaagttgatcaaatatgttgctctagttgcactagcgataggggttagagatttagaactttttactttttgatgcatagaaataagcatatttaatgatctagtactgggacactaaagagtgttcatgagattttctagtttaatttggagccatagttgattcaggggctagaagaacaccattttgctcagaacattgtcaggagtcacttttccagagtggagatgtgtttatatcatagtgaaaagacagtttaagaggagcaaagaagaggaaagacgaagtttggattgatccaacaacctgttacatgtagtcagtacttttcccataggggacttcattctgattcttatgaaaagaagttcaagatttcaaaaaaaataggattaacattcctcatccagattcatagtattgatggtgtagcttttgtttactagaataccccaaggctttgtgccagaatgttagagtaatgtgcttctgaatgtggatggaggtgaggatggcacctgcatgggtggaataatttatgggacatacctgtacagtgtaggttgatggattataatgtgactttataatggtcacagcccagtacacccaagatctgcatttccatgaccatcttgaatcatttctgagatcttgcctattgataattatatcattcattatagctacccaatataatctagaatcgagccatttaagagctgtaactcttctcaggaaggtagagctgccctttgtgtgtacaggttagcaggaaagggctggcatgacgtagggtgaggaaaaggcagcccattattatggttatccttgattaggttggcctaggtcagggtatgaggataccaccaggcaggctgtggcagcatggaatctaatgtatcaacctggcaggcagggggcacctgaggaacaccgaccttcataggattgccctgccacgtagctccttggctgccctcagccctgccctggagctttcataaaatcatagaacttgggcacttaaatgagtattagcaagtagtctgtccttacaattttatgggttgatgcaactaacatccagagaggtagatcagtttgcagttgagtttgtgtgggaggtggggagtaaaactgaagattttagtgtctagtccagtcttgctactattttttttttttttttttttgagatggagtctcgctctgtctcccaggctggagtgcagtggcgcgatctcggctgactgcaagctccgcctcccaggttcaagcaattctcctgcctcagcctcccaagtagctgggattacaggcgcccgccaccaagcttggctatttttttgtgtgtgtttttagtagagactgggtttcaccatgttggccaggctggtttcgaactcctgacctcaagtgacccgcctgccttggcctcccaaagtgctgggattacaggtgtgagccaccgcacctggccagtctttctactattgcaccctgactcttaggccatttcttctagggatggaggattcacaagaaaccattgctatctaaacctgaaaggacagctatattctctgggacctgacttagttagagagtcgcatgctgtgtggtgttttgtgattgggccatggatccttgaggggaaggagcacagtgagctccattgctgttgcttcatggtcttggttctctggcaccaaaacatagcaccatgacaagtacgatcgtgatgtccccaaagtgaaatcatctgccgcttgaacgtcaatatttacaagttgaattattggaattccatgataccatgttgtgcttcttaagcagagttaaaatgaaatctatacaatgacatgccctccacagcattaattcactgagtatttctttactagccagagcacttttgagaaaacctgaatatttttagcaaggtcttaagaatatctttttcttttatttctatatctaacttacgtgtttattttatacatctcttatctgtaggctgaatctgggatattgtatatcgaataactactagattaattgctcttttgttaaataagcccaggtttttaaaggaggagcctgggggaagagatctaatacaagcccagtggggcttggccatatggctgtctcacatacagtccgtctcacatgtgttgtctcagtccactcaagagctccatgaaaaacggatgtctctagtgccattttatagaagacaaaataggcagagagacgttgagagttttgcctatagtcatggaggtggtaattggtaaagtgaagatgtgaatgtttttctattttcaaaagctgccctcttgccatttacccagttgtgggtcatccttacattgcttttcactgagttcaaggggaatgtggttgtgcagaaaagtctgtttcctgttcataatgtgctaatgctgcaaggcaagtagatatctgggagtttgctttgtgttcagaagtctttttgctgtggctggacagcatttgttgagataagatattattcgtgctgaacttaactcctttctgctgtttgtttgagaaaaagtacagtcaatgggcctccaatcatctaatttcaaatttttgtcctcttgttattcctgattatgtttatctccagtatagtttcttccttttcctccctgtgaatgatatactttgtcctggtaattcttttttacatttcaggggaagtactagatatagaacactttacctttataaaaacattatctctttctccttttcctcctcttcatcctcatcagtctttctgtacttaccattgtttcaaagatgctaattatttaattggaagcaatataaacttttttgctttgagaaaaggaactatgatgcttcttttcccctgtttcctggttgatttttatatccaactgtacatctaatctcaaatttggaaaaccctccatggtttagctccacatcttctctgactctgcacacccactctttgttccttcgtattgacctgccttcccctgtctttaccctcctccgttgccactggcttttctcccagctggtggttggtgttatgcttagctagagctgttccatctctttggaatctctctccccagtagagccattgagtcacttccttgtttcagttcttgcctaaacacagtcctacttactcttgcaagagttacaatgaatcagacttctgttttatttcatgttttccctcagtgcagtctctacaagtattttttgaaacctgtatcactttaacgttttgggttctctcctttggctctaaaagatgttctctactgaaacttaaaatattttatactttattatataatagtccttcatagcataataaaatgagttatatacatgtaatgaagacaattaataagagtatttcagtttatcattttttagtgttttaaatagtaagattaagtagtaggttcctgacatgtggctatctttatggagtggcccttttaatagttaaatatctgaagacttttaataaatgtgtcctgagagtttatcaaatggctagtactttaatgctggttataggttttacccacaccaggcaccagttgaggaggatgattggggcctggagtccagcccatgctctgctcatccaactccatgtcctgatgcaggtcacatcctacagctgcccttttctaatccccacacaggggttgatggagtcccagtatctgggattggacaagcatcatttaatctcacaatcctttggggttgggattactggctcagagaggttggatgatttgctgaacttctcactgctagtaagaagtttctgggatttcaatccaagtctaatgactccagtccagcactcttttcttaccaccactgctggatcctccttccccaggactctgcacagtgcagcaaacactcttggaatgagggtacgttgtaggcactataggtaccagcgattttaatacgtgaaaattaaatcttataaaaccttatgaaaccatattccaccatctatcacaatctcttcaaatcatcattcagcctctgaagcaactccagtggggagtttttaattgacaaaaattgtaatccttggttaccagataagttttgaactatctttcctctcacattgataggcagatgtaaaagtgtctatgatcacagcccaactttgaatatcagggaagtgctacagtattacctcaaaaatgagattaaagtctgaagatatgtgttcccagtcaggccaagatttagatacatacattaccctgcaatctgtaatttttgatgactagcttcaaaattaaaggtttttttcactattgcttataataattttgtgttgtaaatgtagtaacatggatatttgtggaataattgtaatgattcttgaacagccttaccttctgcatcacagtgttcatacagatgtgcacataggaagggttgaaaagttattttcatgcactcagtgttccaggaatcatgaccagtgcactgctgaatcaaggctgggagtagctttgtttgtttttcttccttttgccttatttgtataagtgctgtagttagaggcccaggcagcatgagcaactctagagatgtggaaatgagggaggaggagataagacaaaaggaggtggttaggaggccgtctgcctagacgcagtcctattatagatgtgagagcagcagaaacacttgagttttgctgtggtgtgtagtaacttgtatttcctagatgggataatgtaacctatcagtatgtagtgaccacagaaccttagaccttgcagaaatcgtaaaggtcatctgcttcatatcctgggcatccctgagagatgggtttccatggtcagctcctagtgaagtcagcatcttccactgttaaggagcattaactgttgaaaagatcttctgcttaatgaggttgaatccactctttctatgatttgtagcctttagtcctgccaatacaagttaagcatcccaaatccaacaatctgaaatccaaaatgctccagaatccaaaatgttttgagtaccaacataacactccaaggaaatgctcgttggaacaatttagattttgtacttttggatttgggatgctcaactggtattttcaaatattctaaaatctgaaaataactaacatctaaaatacttctagtcccaagcgttttagatcagagatcctcaacctggaccttcatcgtgcaacaggcttcctcttgctcagggtatctgaacactgccatcatgtctgcacgtagtctcaccgttccgcctttcctcagttgatccttacaggacctggttgccagaactttcatttctctgcttgcactgcttcatctaggtcatgcatgggctgaatcctgggacagctgtgtagggttgtagtgtcccttaatctgcagcccaaggttgtgtgagctttttgaggcactgtagcttgtttgacccaataggatttttgttttggatttgatttagctaaatattgggttgtaaatttagcacatttctccaggattacttattcgtaagacacatcctgaaatgataaggctttccatgttaatgtagtgaataattcacaaaggaggaattccatttgtgtttttaacttgtaaaacatcacctcaatctgtgcgtaaaaatatagttagcgtgagcctatatctgtgtgattacatctcaccagaaagcagaacctaacagtcatagacaaggattttctgaatgctgatctcatcctattccatgtgattctcttcagtgtggccttttggtgtgggagagagaagatctttcctctaccttcttttcctgtaggcatttcctacatccaggtgagaccctatggtgttcagtggtctcttgggtgagagccctgagtatggccacagagatctctcagatggagtttctggctgcacatcgaagcctcttcatagttaaataactgaagggcatatgtagaactttgagtcttgttataactgtgacttcatctcttgtagcttattcttatactgtgcagacccagtttcaagacacacacagtgttgtggtaccacctacactaccatttatttaaacaatttggatggcttatgctgctcttggctgtggacctgcaaaaacaaagccatgggataaagcggcctgaatcatgtaatgaaaaccttgtacctttctggaggccctgttgagaaaaaatgatttatttttgccctaccaaataaaacattctaggaatccaaggtgaaaattggattttaactgctactaacattttaagcatataaaatcagcaagtgttgagtgtttcgcttgattaggagatgaacctaaagagtccagtacaagaatgatctgcatatgatgtgaactggtgtcttacataaattttataaaactggaaataaaccctaagcatgctttggcagccaggttgcaacggtggggacctctgtgtttttacagaatcattttgttcccagtcttaggcctgggtcattgttcgcctttcctcccttcagtccttcatatttcagggttacacgttttgtgattaagctcaaggagtatggaaactacctgattccagccccaaatatgtgcctgtcttctctaaggttcccgtttgttctcacgttggatctgtctctccctcttcttctccccactctgcgtgtacgtgcctgtgcatgtttgtttcgtcatctctgtgactacctacccacctaccactttatcactctttttttggtccagtcttcccccgtgtctgagactgttcatctgtggccctgccgctgttccaacctcggggactttccctcactgcacgtggttaaacactttgctgagagccctgtcttcaaacagacttccccaggtcattgtgttggtatctggcacacaacgtcactcattgtttatccagttgtgttgttttataagagagtttctttatctcaaggaatgcgtgtcacgtgtctgcaggagttactgccccggtttcaagagatgtgatggtcttgggctttactgacttacactagggcttttttcagtgccttccccagaattacgtgttttttcaagttcatctaaaaaaaaaaaaagcaattgttttggtatgcctagttttgcttaactcagaatgtctttaacacctgcttttatattagggaagttcattttgtctcgtagggtcgtttcttatggagtctggtactttcgagagggcaattagactaacctgtttgattgacaggaccgtttacaatctactccactcacacgccttctactccctggggaatccgacaaacatttggggcctcaaatgggacatctggagtagggagcttttatctataataataataataatgataatggtaatgatagctgacacatgtaagtgctcagctataatgttcagcattgcacatgccttttttctttcatgtttcatgaccctaggagaaagatactattatgcactctacgttatgggtaggaaaatgtctaagataatgcgtgtaagaagtcctacagtcagaattcattctcaggcctctctaactcctgagtcacatttttaatcactatcatatactgctgttggagagcacacagcatcctgttgaaatcattaaaaataataaaaccttagaacatcaaagctatgatgtaactaaaacttagctgagccttctgtggtttggtcttgttttacaatttggatatgtagttacttagcgcctcagtcagaatgttgcatgcttggacctggcagaaaagaaacgctgcccctggaggcctgccaggtgactggtgtctactacttgctgtccttctgagggccaccacctgcctggaccttctgtcaccacactctgctcactagcctggggtatggatgctaaacttccattggttttcttttgttttttgttttttttttttgagatagagtctcgctctgtcgccaggctggagtgcagtggtgaatctgggctcactgcaatctctgcctcctgggttcaagcgatccccctgcctcagcctcctgagtagctgggactagaggcacgcaccaccacgctggctaattttttgtattttagtagagacagggtttcaccatgttggccagaatggtctcgatctcctgacctcgtgatctgcctgcctcggcctcccaaagtgctgggattacaggtgtgagccaccatgcctggcccctccattggttttcacatagccattgcttgcctggatggcctacaactagcttgttccttagttccctaggttgtttgttcctttcttcatgcagcgtttcctgagcatttgcaacgtgtactgtgtactggaatataaacataagatacatacgcatttaacaaaaatgcatctcagaggcagtagactgtatagacagtgctgtggggtaaaaaggagggaggaactcattggaattaaggagataggggaggtttcatagtgatggttcttcagagctattaatacatctcatgggttgaataaagtttattctgggaaagaaaaaaggggagggtgttccagccagacatgctccttttggaaggacgtgatttgttcagaaaataaagagccctttggtatgtctgcaggatagaggtggatggggacaagagattgccttaggtgggaataggaaggaccttatagatcattctagagtgtgccattttcagacaatggagagtcagtgaaagtttttaatcggtaatgtgaccagatttgtctttggaaagacaactctggaaactgttgggaggatttttgtagaggctgaggcagagaaaggcagaataaccccttggatgctctgtgtttgcacaggagacaaaaatgtggggtgtgttagcctgcatagcaggggtggagagtcagctggtcctcccctcaggctggcctttggatgggtccacagagcaggatctgttttcttaggcacttcctcaccccattgaggtggtctaacttcaggcccctgcctctcagctttttctcacttcctgtggttgaccaggagtcttacctggtcttaacactggacaaccagtgttgcaccagtagcctctaagtcctactcttctgcctgctcaagctggtctcgcttaaacatgctggcaccttcctagcttggctgacctccctgggtcagaatacttggctgcctggagccttcgtctctgctagagctgatttggcccagccagtaattgtttcttctgtcctgtctgtgcccaggccttggggttataggaagaccagaagcctcctgtaggtgggacctgtgccatcttctcacattttacacacatgccatacccttaagagttatgttccctgatggtccacacaagagatttaaacagacagatacaactaaaatctaaaaagcctatattgatcttacacactatgaggctcttattaagaaaaaaaggcattggaaatttaagttttatgaagtactctgagcagtgacagattttcttagactagaaaaacatcaaggtgctcccatttggaaatgtacttgttcatttttgtgttgtattgatttctgtccaggtattttctttccaagttttatagtttttttcctttctaattgtgtcgataacaagggaactggtttatagcgtggctgtgagggacagcagtgctctggggctgggcatcctgcactcaattaaccttcatatttcacacctaatcattgcagtgtggcaaagcgctccctggcctttcaaagcaagaggactgctgtggaactgtgggtacctcctggggctttaacaaatgccagaaatgccccaagaaaccatgtaagtaatgtttcctcactcctttgcaggttaatgtagcatatctgttttttatgattactcctttaatgatgaggcaatattagactttcaaagaactctcctactgaattctagaatgtagtactatgatgtgcatttccagaaaatttgcaagtctgaaaaagttttcatgtcaattattttgtaataagcacagttattaattatcctctttagttggattacttatggggaaaaaaagtcttaagtggtaatgagttaaaatggactttttgtctcaggggaagagaaaataagatctcttttaaaatggtaaataaatgtttcaaaccctgtaaaaagtacagttgttatttcctaggtttaaattccttaaatgagatttttattaatgtccacaacttatgttgtagtttttgttatattatcggttttcaaatttcattaaaaggaaagctaaaatggagaaataattggttgttgatttgtaaaagagaaatttataatcactaggacacaattctttcccattttttctgacactggttttatgctgtcacagacctcagcaacattaatctatattaacacccccaggctttgatttgcttttattgttcagaacatgttgatttgaataaatcagatttacacctttttaatactctattcctgacaataatttgtacctttagtttttcaatgtagtattaactctggataactgatttctaataaatacttttttttctttttgagacggaatttcactattgtcgcccaggctggagcacagtggggcaacctcggctcactgcagcctccgcctcttgggttcaagtgattctcctgcttcagcctcccgagtagctagggttacagacatctgccaacatgcccagctaatttttgtattttcagtagagatggggtttcaccatgttggccaggctggtctccaactcctaacctcaggtgatctgcctgcctctgcttcccaaagtgctgggattacaggcgtgagccactgcgcctggccataaatagtttttagagacagaggtgactgggtttaagttgagctttctgacccttattcatcatgtttttgccaagagagcaagtgatatttttgtcagtcatctttctttgcctcatataactgaagtttttataatttttttattctttgtactgcaagaaatttctcatttgctttaaatgaataatttttgtttactcctcttatctgttgatttgattgtattctcaaatgccttttaaacctctatattcaatctaggatttgccatctgggcattagtattccatatctctttcttacattatttgttcttctaccagtataacaattcattttaagtaattgtctctcatttggacttctttgtctcacaaacttacagattttctaaatgcctaaagcaagtaattttatttattttgttgatactactcatctctttttagaagactaacttgtggaaatgcccaccgaagttcctcataattaatgaattcttcatttacaaaaataatccatgtaaataaggacattttcagtactgagagaattttccaagcagatgttctaagctgattcgatgatcatttgcaatgcaaatttccaggaagtaggttgagtgtgatggttcatcgtcactggaagatccatttgcttaaaattattttggcaacctgaccaaagggatagctatgatgcatttggtttgatttaaaaattttagtgtttgaagttaggtagccctgagttcgactcccagctctttcatttgctattgagtcttagagctcattaagcaggaatctatacctaaaacgttgaaaaggcgttgccatctttttttttttaaacctgcctctttgtttaccatgtctgtctgtctgtaggaatattgaggaggatgatatattttccactgtttggtctaagaattaaggatgagggaagttaggttcatagaactttgttttggtcctaagtctatgttctctaatattaaataccttccccatctgtcttatttttctttttcattttcatttacccccttctttgtgtatcttttgcttagctgcttctcttctcttgtgtccaaaccccaaagtagcagggatgtgatagacattaaaggtaaagagattcctactgtccttttattttttttttaatccctaacttccactcttgaccttttgtcgtttttgtctagaattgcgtcatttttatctaagatgagttcactgatgtctgtggtttgtgagctctgtattttaatcttgataaggacttagttgaatgtgaaagtgcaaagttgctgtcacttttaactaaatgttggtgaaaaaaatccatatgttggctcatttaatgtataaaattgaagagactgccttcacttcaggaagggcaatgtggactatgaatgaagtaaactgttaacatcttgacatttattctgtttgtgtcctcttaagtgactcactcccaagaaacacactcagggtcacattcttcctgtgtcatttaaaaagttttcctttccttggttgggactcctctctaaatcatattcagtttggaaggaagcagactttccttggctttctacgctatggttttgtgttccacacctcttttttttcactcaaactagttcaaactttagttttcaagtggcttttatttaacatttgaagtttttgtttagccacatacagaaagacctttcattgttgatcattttttttgctgtgaatacttaattttaaatctgcaaatgatttcttaaatagtttgtgacccattagaaatgtgcctagcatgaacaagtcacttgtcctttaaaacttttgagaagaaaatgaacataaaatcctaagctgaggaggactgtaagagattgcctggtctggctctctgccttcaagtagatgactgctgaaagttctaaaacaagttcatatccatctcttttgactttgaggaatttgcagccagagatcccacagtctctgcaggatgcctgctctagaggtctatgggacaagacagacctgaggccaaggagctgaatggagggactcccacacgcccatatctcccgtcttttaatttgcctttcccagatgcctcactctgatcttctcttttaggcattcgggggaatctgaagagaggggaaatacagcaaagaaaagaattgaaggagaagagggacaccccagtacatattcaccctgttcctttagtggtgacagataaagagcatatggggaggctgaaataattttattttttaagagaaaatttccctttttattttctactttccccttttactcctctttcaagtcttttttagtggtttaatctttcatcccattttgattatagcttgttttctgttgcacagtagcctcttaatagaagaattccttactgcaggacatagcaatggcatttgacactttgggagtgcttatcacacttaggccctgtggtaggcatttttcatgaattatctctaaattgcagaagaattcttccctgctcagtagatgggaattaccctcattgtatagaatttctgtgtgaaacccaagaggcttgtttcccaaggtcacagctattgataggaagaggatttgaaatccacttctgccacatcccagaactttggctgcatccgctatgccaggtgctctctcaagtctcactctagagtatcagaatctcaggaaatagggttttgttgagaagttggtgattgcaacatttgtattgtttgcatattctgagtgtagcccttttaatttcctgacttcctctcatcacctgcctattcttctctggttcataatggtgagaatcatctcatgactgggatacccgatccagcaattaggatgagtgtataatttattgtctaaagtgggacactttggggagtaaagtactgttaattaactttgctggaataacagacatcacccagaatgttccaggacgtgtagtaaccctacctacaatggataagaaaatccaaaacctaaagcacatcaatggggaggaatagatcctttgtgatggaaatatgtaatcactaattagaagaaaatgtacaacaatcttaggattgtttcagttaacgtaataaagatttactgataatttcttgggactttattgcaaaataagtatcctgaaaaataagcagaatgggaaaaaaattatggagatatacattggtattggtttcttatattaataaatgaataagtaagtttgctgatgccttaaatggcttcagatatcacttacactagtctaagattgtaagaatttaagtatgtaacaaagcatttcttcccttacagcttatcatggatacaaccaaatgatggaatgcctaccgggttataagcgggttaacaacaccttttgccaaggtaagactaactgaattcattgatgtggactcaacagttgttttggctttttagaaacttcagttgtttgccacggcttgctcattcgcccagcctgtcacagtgaaccacctcatgttcactccttttggctaaggaaatgtaaggaaataagtttaaaatatggttattggaattgctttactaccactgaaacttgatgcaagtttttaatctaaaagagtttggatagaatttaaaagagtttggatcacattagagagcacactgtggtttccatgctagtcacctcatatcctttcatgggcgtgtgcacacatgtgcttgcaggcacccacatgtacttagcagttctacttcattgccaatgcatggttgggcaacagaattcccttttctcctctcatcaaaatgttgttggtcatctcaggaactagatatcagagtaaacacattttgcctaggcaataagaaaagctatgtagctaagtgtgaaatgccctgagtacttttgtttggtttatgttgaacagtacagcaaagttgtacaagcagggggaagctaggagattgtctggtacagtgtctactttataaatgagaaaactcaagcccagagaggttaagtgactttcttgtggcagcatagagctgagattataacttgagtttaccaaggcctagtttagtacccatatatgatatcatattttgttttagttactttatgggaagaccaatgcttctaatttccctttacatgtctaggatgaagatgttgttattagtaacttggaaatatgtatacattgaaactgagaaagcagagagcctcccagagtctgatagaaccaaaagccatgttgagaacatggcacatgtcttctgatttgtgttctgaggctctgtatccttcaccaccatatgtatttaggatacagtagattaaggtcatgttacagagtataggttaaccccctattcaaatggctcatgtcaaaggaatatcttgattacctgagaattttctcaagtagattgtctatcaccctattcaaatggctcatgccaaaggaatatcttgattttttatctgagaattttctcaattgtctatagtgcatctgtgtaacttttatgatatgtagagtctttggtaacataaaagaatttatttagaaatgcacatacagtctgtctttgaaagactttgtcttaaaaatattgtaagccctcatgtgtcacagaatgttgagaaaattagaattaaccacttaaggagaggacacccatgacacattttgagaaacatctgctaaacttagtaacatgggaatagtggattaatctacattattttagagtcagaatttaaggtatcattgaattaattagatggatgaatgagtaggttaaattaaataatgaatagattttaagatgcatgttttacaatataaaccaagttattgttttatagatttggataaaagtctatagccttagcacatctgtaggatgcattagtagaaatggaatgaacagggcagtggaagtaacaaccttgtacactgtgcccctcagactgatttggggtttgggtgttcagtgttcattattgtcttttggttaataaagtcaaccaagtttgtgaaggacctagaaacatgagtgtgtttagcacgcagaagtacagactgaagagaaatattatggctgccctataaacacgccttaaaatgtttgtaaacaggccactaaatgattaactgtcctacaaaacaagacatacctaataacaggggacacttcaggaaactcggtgtcgaggggctaaaacttatgtgaaaggctgagacgtaattcctttcttctcatgcacagtctctgtcccaggggactgatggtaatgatagcatcatagaactggaatgtgcctatgggccatctaaccttatatgctgttcaggataaaaatactcttatcatatccctggccaatagttattaagaagctatcagatcacctctgtggacaggaagctcagtacttccaaagacatttcatttcaaggttgttggggaactctattccacagaaaaggctttcttgtagttgttccgttaaactagaggacagaggagggtccttatttatccttcactaatccaatcctgcatagctaattgttagatacattttccagaatgtcagatgctcctaatttctcttaatgtcaaatggataaaatatacatatgttctcttggtatggtgtgtttatttgtttgccattttttaccattcatagatatttgaagacagaaggcttactctctcttagatagttttatggtgttatttcttccttacgtatttagcgtaattcacaggagaagacatttggtcctgaagttttcttttagaaagtgtttcggttatggagcaaattaatagctatactattattcagatttcccattactactttgtgtcagttttaataatctgtattaccttagaaagtgtcattttatccaaaatgtcaaatgtattaatatgaaatgttttcctaatatcctcttttctttttaatttatatagcaacccccatcccttttagttatattgctacctgtgctatatttgtttttcttgaattaggcttgccagtggtttatcaatgttaccaatttttcccccaaagaatcagttatttgttttgttgaaaacatttgtctatttcactaatttctgatctttgttttcttttcctctacctttttgttcaattgctactatttctaatttctttagatgcatacttaggtcattgatgtcagcctttcttctttttctgaaatgtaaataaaaggctgtaaatttctatcagtctagattctgactttaactgtgtcccttaattttgtgtcattttcttatctttaagttcaagttttaaaaaaatttccttttattttttatcagcatataataattgtacatatttatggggtatgtagtgatgttttgatacttaaaatgtatagtgatcagatcaaggtatttagcaaatctatcatcttgaacatttataattggaacattcagtgtatcttccttctacctatttgaaactatataactacaaaacactagaacttattcttcctatttaactgttgtattagtccgttttcacactgctgaaaaagacatacccgagactgggcattttacaaaagaaagagatttaactggacttacagttccacatggctggggaagcctcacaatcatggtggaagccaaggaggatcaagtcacatcttacatggatggcagcaggcaaaagagaacttgtgcaggggaacacctatatttaaaaccatcagatcttgtgaaacttactcactaccacaagaacagcaagggaaagacttgtccccatgattcattacctcctaccaggtccctcccacgacatgtgggaattcaagatgagatttgggtggggatacagccaaatgatatcagctgtcattttgtatcttttaacaaatctatctttaactttacctcccctctacccttcccagcctctagttatcttctgttctactttttacttcagtgagatcaacttttttttgcttccacttatgagtgagagtatgtggtgtttaactttctgttcctggctgatttcacttaacataatgtcctccaactccatccatgttacacaaatgacaggatttcattcatttttatgactgattagtattctgttttgtatatacaccacattttctgtatccattcatgtatttttggacacctaggttgattccatatcttggctattatgactggtgctgcaataataagttcaatttttaaaaattattctgattttgttattgacccatggattatttagaaatatattgcttaatatgcaaatacttgtgaaatttttcttgttctatcagttgttgagagaggtgttaaaattgcctgctacgattatggaatggatttttttctttcacctctggcaaatttcagtctgtgtttttttacctttacaatgggtgtcttatagacaacatgtagttgagtcttgcttcttttctacattctgatatctctgcctcttaataggggtgtttattgcagtataatctaaagtaattgatcctggcataccccaaagttggggcctagcctgagagggtttttggctctgctcaggaaagaattcaaggctgagccagcagtgaaagaaagcaagtttattagagtagcaggtacagcagaatggctgctccataggcagatcagggctatcccagaggtggggtggcccagcatagtagcagcagcgtacagcaacagtagccatccggagcagcagtccctgtaaattgctggctagctatatttaatactcactcttaataatatgctaattaaggggcaggttatttcgaattttctagaaaataagtggggagttcttggaaccacgtaagataacttctgggtcactgtcgtggcatttgtgaactgtcatagtgctggtaggagtgtctttatgctaatgagcagtgagggtgactagaggttgccttcatggccctcagttggttctggccattttttctgctacagcctattttgattagcagggtcatgattagtgctcagaaaataagtcctgctgatctcctacctcataattattgatgtggttagatttaggtctatctaaacatctttgtctgatcaggaattttttttgttcttttctttcccttttcttagaattccattttatctattggctttttaccaatatgtttttgcatcattttaccttttttttttgtcttttttttgagacggagtcttgtttgttgcccagactggagtgcagtggcatgatctcagctcactgcaacctccgcttcctgggttcaggtgattctcctgcttcagcctcctgagtagctgagtagcaccaacacacctgactaatttttgtgtttttagtagagatggggtttcaccatgttggccaggctggtctcgaattcctggcctcaagcaaatcacccgtctccacctccagaagtgctgggatcacaggtgtgagccactgtgcctggcctttttgtattattttaaagggattactctaggaattataatgtatgtagtaactgatagaccgtttgtattataattcctagagcaatcaggaatttgacagtttaagttttcatagcctatttagagttaacatagtacctctaaacagaaaatatagaaatcttgcctccaagtagctcctctttttggcctgaaaatcaatcccctacttatgccccatgccacacccttagtgaaaaccaccatgacagtctcccagacagtagtaggatttcctcttactctgtgttggaattatttattcacattatatgttgttgttcacctctttcttttcctgacaggctgatttctcagacatcaaggacccagtcttactcacttttgtgaacccagaggcccaatttttaaaaaatagatttgatgtggatgaagaaagggttcatttgttattgatgagataagaagctctttttttttttttttttttttttttgacagagtctcgctctgtcgccaggctggagtgcagtggcataatcttggctcactgcagcctctgcctcccagattcaagcaattctcctgcctcagcctcctgagtagctgggactataggcgcgcaccaccatgcctggctactttttttatattttcagtagagacggggtttcactgtgttggccaggaatgtcttgatctcctgacctcgtgatccgcccgcctcggcctcccaaagtgctgggattacaggcatgagccaccacgcccggccaagaagctcttattatagctttattttatttggtccagtaccaatgacttacaaataaaaccaacatatttgtagtgattcatgataaactatgtttgtaagcccagaagtcataaacttataaagagggaaataaataatgaattaatttgattttaataactaaatttactgtgtgccagatgctttgtttaataagcactttatatcagttatctccattagcctttaagttttctatttaaagtaggcactattataccccattttacaggagaaattgagacctagagaggctaagtcatttgtgcagcatattgctaataagtgctacatgcaggaattaaaccaaggtagaatgaggccagaacttatgctatcaaccgtcttgttctgctttagggaaagggaactaacctttattgatcatttactatgggttagtccatatgctatgtacttggtttaatcttcaaaacaatcctatgagatttgggcattattattctcaattagacattgagacacagagaaagtaaataactttcccagggtcacaaagatagttaataagcccaaccagggttataccctttttttttttttttttttttgagatggagtcttactctgtcgccaggctggagtgcagtggtgcaatctcggctcactgcaatctccgcctcctgggttcaagcgattcccctgcctcggcctcccaagtagctgggactacaagcacacgccaccacacccggctaattttttgtatttttagtagagacagggtttcaccatgtttgccaggatggttttgatctcccaaccttctgattcacccacctcagcctctgaaagtgctgggattacgggtgtgagccactgtacccggccctaaccagggttatactctcataccacctatggccacctttaccaattatatatttgtttatattttgtaaaatatcactaatgcagatactagctaattagaagttatgccatctgttgtgagagctaatagaagtcaaagcaattaatattaattttgttttatttcattaaaaagtgatggttatcagccagatgtaatggctcatgcctgtattcccagcactttgggaggctgaggcagaaggattgcttgaggctaggagtttaaaaccagcctgggcaacaaagcaagaccctgtctctacaaaaaaaataaaataaaaatttgctgggtgtggtggtgcatgcctgtaatcccagctactgagaagctgaggcagaagggttgcttgagtccgggagttcgaggctgcagtgagctatgatcgtgccactgcactgaagcctgggcaacaaagtgagaccctgtctctaaaaagaaagaaggaagggaggaaggaaggagagacggagggagagaaagttgtacaatacatttcttttactggctgattaatgttttgaataatttatattaataaaaataccactttagaagtgatagaagtgcaaatttgcaagtaatcacttgctatctattttgtatgttagaatggagacttattcaagtaattgcatgagtttttttgcattttcctctgtcggtacggctgactgacccttagcaaactttgttcatactgagcatattagatggttctgccttagtcaattcgctgatggtctactggtaacaccaaatcctggcttaggtctctggaggatatttgtaaagcagtgttatactttttggcaatgattctaaagtgaagtaacacacaaaattctatttcatgggtcctcaaggaggcactgctaaattacattacaaaggcatttgactcataatatgatttcattcagtaaatctattgaaattactattgagagaagggcttaatttcactccctttgtgatattgatggtcagtaaaatgaaatcgaacttgctcacattacatatgtacattcagttttcctagaaccttgaagctttttgattttgttttcctaaaggttttcaaaaggagcccatttagcatctaattgcttgtgccttccacattgttcttacagtctaatgtcttctcagtttacaaagcacttttaaaattaaagtggttaataactagaattacattatttccttcaactaagtgaactaatgtcctgaaacaacttttactaatgtgcactcagtaacaaagaaccaactgtatacatgttaatttgaggagctttcaaataattgccctcaaagttgttttttttcctcctctctagtggtgctgcaattatcttttcaaagggatgatttattacatatacacacatggagctccaaaacagccttgctactctcagcattatggaattgttataatttgcttcatttatcataacaaacaatatagttatatgctctgatggatctagagcagcatttgtcatttgattattatgctataaaggtctgatgtagaactagaattaaatgaaataatactaagagctcctacgtccatgctgcttttctttaatactcagtccttccctgagtggaaatactgagtaccctcttttgtccatattttgccataagtgggttcttaaaaagttagatgtaaatctaagtttcaaaaatagaatttggttctgaaagtacttggggaatcagtctgttgagtgattttattaaaagcaagtatctcttttgacataccaaagtcacttaccagtttcagtttacaaggataaaatcaacttagtattatttgctacatttttggcacgtactgtgggcaataccacagtacctcagtacgtgctgaatgtaattaaaagacatctacacttttataattcagtgtatgtatattcgtttttcatagatcatctcgaagactttttaaatgactcagtattccacaaacattaatcgctggggcactcctagctatagactgaaagtatgtgtgatgaatgatgggtaagacattgttcctgcccttagaatttagtgtaatgaaatcactttgaatgagcaggatgcaatgtgctttatttactcttcgaactagctgaattttagctggctccctatgagcccgttaaaggaaataggaaagagctagccacataactttctttcagcatcgttttattatactcgttctgctttaataaaataaatttatgaaaccgatacattgaggcacaagaatactcattaccaaaactttcagcctaggctccttttagataaaaagttcctcggagtgcatctgaaatcacattttgtttggacaaaagaagagataatgtacctgttttcagggggcatatctgttattaaatgagactccacagtcttgatcaatattctgcataaggactttttggctacaaagcgcttgtctggactgtagcttgcatttcagacctcttcttaatgattaccaaaaaaatactgagtgtgaactgcagtactgtgagcaggtaaaggcagattggtctttgaatgctttgagaaccctagataaatgagcactagaaagtgcaggtgagacccccaagaaagcctgcctggctggagaaaagaatgtgtcttgtagcatagtgctggattaaaacagacatgtagaatgaggtgaaatgattgagaatcttaaggcaaagctcttataattaatcgaaccatttgcatgcaattaattatgggctttgtgatacgtgctgggaaaacacttactggatttgttctgcttttaacataatgttaaagaaaaatattgtttataacatttgttaaagaacagtaagacagattttattcaggtaactgttgtaacaggtataagaactactgcagtggagttttggggtaggggagagagattgggctcaactctgaaaataaggaaaagtaaaagtgtatcaccaaggagtgagggtgagagtgtgatatcagtggatgaaaaattactaagaggacacatgaggggtaaggggggattctggctcaaccatcctaggagggtattcttgctgaaggcagatcagggtgaccagacattacctaggggttggtggaagatgaggaacccaatcagatatccagcatgggggattctggctaaactaacttaagaggatattagctaaaactggacaatgcagagacaaatacagaagcatacatgaagtcagagctagttgagaagagggttcagaggagcctgactagagtttgatcaaggagagcatctttgtcgatggaacactgaaaggccattatggcaacctcttggatatttgaaagaaaatggatttgtggcttagaccagagtcattattttacaggtattgtcaaaggtgtacctaatggaaataaagcctttttccctcatatagctaatagttaaatgaatttactgtcatttttctgatggcagtatttcttgtatcctgtgcttgtttcctgcatttgtttcttcttttggggaggatttgccaaataaaatccagaacccagttaaatttgaatttcagataaacaacaaataggtttttaaagtaagtacatctcaaattatttatttgaaattcaaatttgactgctatcttgtatttttatctggttaatctgtattttgaggttatattctttaacagatcctttagtgagggtcactaaagtatatactttatgtgtctgaaaatatctttattttgcactcattttataatgagactactcgtgtgtacaattccaggttgatagttgttttctagtggtgcttgactacattataccaaagtcttctgacttctgtgttttgacacctcttcctttgtagataatgtgtttctctcttttgagataatctcctaattctttatgttctgtagttttatcattatgtgtctatatttagatttatctttattttactcagtgtaatgtcactctgaaaactcatgtctttcctcaaatttgaaaagtgttcacctattatgtcttcaaatatcactttccaccatgcttttctgctgaaactctcattaaacaaaagttggagtgtgtttttcatggctcttaaaaaatcttttgtctttttattctctttttcgctgcattttgaatggttatctcagttccattttccaattttctaatttctgctttactatgcccatctaggctttatctcatttgttacatttttaattttaagactgtttttcatttccaaggtttctaataaattattgttcatagctacctgttcttgttttatattgtttaagtattcatttaactggttaaggtatgctaaaaatccttaaagaatcttggtaagaccatttcgtaaaattattctcatctagagaatatttgtgttcaaatcattggcttcaattagtttcttagcaaacaagcattaaaatttttaattgggttgataagctcactttgaatcagaagtttattttcatcctccccacccttttcctttttctgtctagcaattttatggaaatttccacttggagtttggggccgttggtctagagctagattataatgatagcttctgacccatggagcttttctttttatgatactgtttgcataagaatgtgataattttcctttttctaatattagtaaatttactttttgttcatgattgccttacacaacttttcaatctacttatttatatattttgctaactttttttttatttttattttttatttgtttatgttaacttttgttgaatgactattcagtggagccattgtgttaagtacattggagacaaccttgtgagataagtagtggtttgtgtgtgtctgtgtgtgtatgtgtgtagctccctcttttctagagcttatcactaccctttcaacttcagatcaattttatcttacgaactttcaaataattcagtaagtgttttctttagtgtctggcttctttcactcaacagtatatggccagcacaatttttatttttagaattctgccttataaagtgaaaatatccattgatgtttttatttaaacaccttttcccctcttccatcttgttcttctctgacttctctgcttagaccccattgccccaaagttacagctttgtctctaaagttgccttcagttgcattatcataagtgagttgctatgtttatttctttctagaaggtttttgggaatatataagagagtgatgtgggcataaagatgaaacttagacgagatcgggcacattcagggtggtatggctatagacacgagcattcctatacaccaataatagacagacagagagccaaatcatgagtgaactcccagtcacaattgctacaaagagaataaaatacctaggaatacaacttacaagggatgtgaaggacctcttcaaggagaactacaaaccactgctcaaagaaataagagaggacacaaacaaatggaaaaacattccatgctcctggataggaagcatcaatatcgtgaaaatggccatactgcccaaagtaatttatagattcaatgctatccccgtcaagctaccattgactttcttcacagaattagaaaaactactttaaatttcatatggaaccaaaaaagagcccgtataaccaagacaatcctaaggaaaaagaacaaagctggaggcatcacactacctgacttcaaactgtactacaaggctacagtaactgtatatgcagaaaacagaaactggaccccttcctcacacattatacaaaaattaactcaagatggatgaaagacttaaatgtaagacctaaaaccataaaaaccctagaagaaaacataggcaataccattcaggacataggcatgggcaaagacttcatgactaaaacaccaaaagcaatggcaaaaaaagccaaaattgaccaatgggatctaattaaactaaagagcttctgtacagcaaaagaaactatcatcagtgcaaacaggcaaactacagaatgggagaacatttttgcagtctatccatctgacaaagggctaatatccagaatctacaaagaacttaagcaaatttacatgaaaaaaatcaaacaactccatcaaaaagtaggtgaaggatacgaacagacacttctcaaaagaagacatttatgcagccaacaaacatgaaaaaaagctcatcatcactggtcattagagaaatgcaaatcaaaaccacaatgagataccatctcacgtcagttagaatggcgatcattaaaaagtcaggaaacaacagatgctggtggagaggatatggagaaataggaacgtttttacactgttggtgggagtgtaaattagttcaaccattgtggaagacagtgtggtgattccttaaggatctggatccagaaataccatttgacccagcaatcccattactgggtatatacccaaaggattataaatcattctactataaagacacatgcacacatatgtttattgcagcactgttcacaatagcaaagacttggaaccaacccaaatgcccatcaatgatagactggatgaagaaaatgtggcacatatacaccatggaatactatgcagccataaaaaaggatgagttcatgtcctctgcagggacatggctgaagctggaaaccatcattcttagcaaactaacacagaagcagaaaaccaaacaccacatgttctcactcataagtgggagttgaacagtgagattacatggacacagggaggggaacatcacacactggggcctgttgggaggtggtgggctaggggagggatagcattaggagaaatacctaacgtagatggcgggttgatgggtgcagcaaaccactatggcacttgtatacctatgtaacagacctgcacattctgcacgtgtatccaagaacttaaatataatttttaaaaaagatgaaacttagaatatattgttcttggtatatgttttggaaataatagtagaaaaccaacaggtaagaactaagactgcggtcaaccagacttgataattctgttcttcaaaacacttagaaatgtttaatattccttttgtttagcctgccagaggttaatcataattttctattgtattttcatttaatctcagaaactgtcatgtacttagtttgatgccagatcatgttttacagtggtcaatggctcagtgggaactgatagataatttactgatttgaaggtgttaactgttctggtcatcctcttagaactactgctgcactttctagtttaaatgtgcacagtattttcagtaagaatttaaacagtttttgatctggacctgagcaccctatttcagcatttgcaaatcaaattgggacccattcctgtgcattttagaattatttttctggtgtgtcctcttactatgctgggataggtttcaaaaaggaaatgtctgtttattttattaactcttcctcaggaaagacagtggtgaagtgagtcattagcacattgtatttttcaatagctctttgaccttaatctctgtggctataaaatgaatgggaagatgcctactgtattatgagtgatgaagaaagcccatgatggattcatgttactgtgaatatttcaaggagaagttaatgtaatatctgtagactacagtcatgaatccaagaccaacagagtaagtgtgtgttgctagcagcgtcgtccatgtgtagcacacatgtgtcaagaaataaatacaagctgttctctgggctctgataattcctttatcatgttaccccgaagacagaagaattggaaggaaaggagttgctgccacagtggtttgacttttttcagtgagtccagtgattgaatccatcctatggtggatggtcattttataatcatgggacagttacagggtggtgggtaggcttttaatggcagtggggcctagatagaagcaaatataatcacgaagagactcatacaatagtctttgaagctggccccagagagcagcatttcacaaaaatgtttccacagatgaccagttcagaaggatgttaatagattgtgtgttaaaaagggtcccacagccaaatgtgcagaaaaaccaagttaaacacagaaaaacaagagattttgccaaaggactcttcgggttttaaatatgcttatgtatatagaataggcagtgtttctcaaacatatttggctgcagaacccctcttttagcagaggtctcacaaagtctgtgttttgtgtaaaataccttgggtaaaattgctctagaacattggttttcaaatatttttttcttaatctcctagaataattttgaaaaagttatgtgttcacatatctttaagctgacatctacattttcattaaaaagtcaagtggatacaataggttaatttctggcacatttatattgtatgtgtgcattaaataatttcatcaaaactttggagctgcagaattggttcatgccattgataaacagtctctgccatttaacctaattggtaaagccagatcttcttatgaaagaaatcggactcattactttttctgtgactctatcctggggttgatatatttgtgaattgttcatttattctgtgcctgtgagaattttacctttcaagacagtgttcttagaaaggcctagaaagattctggattgacaagaggtatgccttgacttggtcaagagcaagaaggccctgaggaaaggggaagataggaaaggaagattggcaaatatattcttaggcagatgacttcaaaaagaaacatctgaaggctgaagatctatagattagttcccttaaaagtgtctaagcctgtgtgtaccctatagaatatcttcatgttccttcgtggtatgtctacccagtgcaaagttgttctttggaagtttaagaaatatatatattgtctaagtgatccttattaaataacttaatagtctgtctgggaaaagtatttgtattaagaggtatttttctgctttcaagtggaaggcatactgctaatggaattctgtcatggaatttatatttactagcaaaagctgaacacacacagatgaatctccagaaagcttcatattttcacacagtagaaagatgctcatgtcctgttcttaccttgtcctgactcctgttggacatgcctcatttcctgtataaacttgcgtcactaagaagacagtaaattcttactcactttgttaaacatacatactttcctgtaggagaagagatgcataaaaatatatttatttcccagaagggcacttgtgctgttcgtaatatattatgcaccaaatgtcatactttctttattccctggcattttcagccctggcaactggcagattgttttgaagtcagagaatatttaaactacaagtaaccttggggataatatagttcagcccctctgtgttacaggagaggacactgagatcaagagaaactcagagacttgctctgggtaacataacattttgtcctagttggaccaaaagctagatcttagtggaatattcctcctattattttcccccatcctctccatcctttttagaaatatggccttggacgaaattatctctgtaaaatggaataattattcttgtactgctcaccatccagaattgttgtgaagttccagtgagatacggtgtgctatagaaatgtaaagaatcctgatgaggtagaaggaagatgaaggtcctcacttcatcgtcaccttatcgcatcattcccatgtactgaaatacttaggctgttttatgttgggttgttcatagggagtctcttgttatgcatgtatacctgattactttatattcttctactacctggttaataaaagcccagccctcttatttctgttgtattagtttgaaccataggacattgccaatatttgaccattttagaagaagagcagttttagaagaaaagcagttttgtgttcctgaacttcatctgtgagctgaagtatgtggtaggctatacaggcagagatacctgtaaatgttttaaataagtggaaaagtatgtaaagctccttcatgttagctgtagtagcttcatggattttgcctactccagaggagcacatgggtccgtatgaatttctttcctagtttctgtttctgtaaacttctagactgcctgcctgaacacaaaagctcagatggggatagggaatggtgactggctgtatgtgggtgctgagccccttcagccatttattttggccttcattctttaactcaggaagttgttctgtatgcagtggttataccacttcttcaaaggacagacttccacagttttccagagaaatttgtcatctatagagggagaacaaggaataaattcatgtatttttcaaactaaatattaaaatacttttgatttagttagaatctgttgaggaaggtttgttgacgctttaaaatatgagacttggccggatgcagtggctcacacactttgggaggctgagcactttgggaggccgaggtgggcggatcacttgaggtcaggagttcaagaccagcctggccaacatggtgaaaccctgtctctactaaaaatacaaaaaaaaaaaaaaaaattagctgggcatggtggcatgtgcctgtaatcccaactactcaggaggctgaggcaggagaatcgcttgaacctgggaggcgaaggttgcagcgacctgagattgtgccgctgtactccaacctgtgtgacagagtaagactccatcttaaataaataaataaataaataaataaataaataaaaatatgagactcctgaaacactatattgttatttgaatttattccttcacaaataagctatttataaaatgacaaatattgtaatcaggttttatttgattaaagaaagaagatagctttaggcaatgaagtccaaatagaattctggtttaccattcacccgtcacgttccatacagttgttaagtctgaatagaattacggtttaccattcacccatcatgttccatacagttgttaagtctaaatagaattatggtttaccattcacccatcacgttccatacagtttttaagtataaatagaattctgctttaccattcacccatcacattccatacagttgttaagtctaaatagaattctggtttaccattcacctatcacgttccaaacagttgttaaactttggcctgatgatgtcatcacttggaatgttcttctctcatccagatacaatgcgttcagttcaaccaatgctttgttcttaacgtgtttgtgagtctctgacatcctttactttaatttagaaagcttgtgactacctgtctaggaaaaatcacttaggcagttgctcctgtttcttaataattagaaatgtcttattaatttattaatttctgaagtcctatgttaaaattatggggataagttgtttgttggctgggaaggggcacaaagaaccttctcaggtgatggaaacattctttttttttttttttttttttttgagacggagtcttgctctgtcgcccaggctggagtgcagtggcgcgatctcggctcactccaagctccacctctcaggttcacgccattctcctgcctcagcctcctgagtagctgggactgcaggcacctgccaccacgcctggctaactttttgtatttttagtagagacggggtttcactgtgttagccaggatggtctcgatctcctgacttcgtgatctgcccacctcggcctcccaaagtgctgggattacaggcgtgagccaccgcgcccggccagaaacgttcttaatcacaatctgggtggtggttacaccacaagtagatatgcaaaaattcatctagttgtatacttaagattgatatattctagtgtatatacgttaaatataggaaacagaaatctaatctctaatttgtagtagctcaggaaatataaaaaaatagatgaaccaaggcagttgaaggaaacagtttttctggaagctgtgagaatgtgtcacaaaggaaggcccaggcttcctgggttcttcgggccaaaattaggggaagtgttggtgccagtgccggtggcacaagctgattaaaacagtcataacaggaagagtcttacacgattcttcgtctttgtggatgtttctgtttcttcctgtctatacctgataggtttgcttggtcattttgtttgttttcttccgtctgaattcctgtcctccattcccatggcatcagagtcaaggcagtaagcagtgtggagagtcaaagaaggggcattggaagagggtactaggcattggttgtaaatcaggtatttatgagtctggggggaaacctctacattaacctggcagccagccgcaaggctgagatggtgctgttatagaaaccacctagcaagggaaaattctgggtcctcaatcttatcatggaatgtgtagtggtgcagccaatgaacaggaatacaggccattcaggggaagaggaatgctaataatcataccctagtgaggatatgaggggaaatagaagagtggaaattttgtccagccttcttgaccacaactggctggttacccaaacttgaggttttacttgggacatataatagggcttcacttgtaccgtgtaagctccaactggacttggcactcttcctggtccttcatggtggttttcttaaaaagaatgagttacgggggaatattttcagttacatgctgtacataaaagtgcattacagaacaacacacacttcaataaataatgagatggtcaggtgctgtactgtgtgccgtaccaggtgtcatctagctgtagcagtttccagctacgtgcaagttggaacaccatagaatttatacagcaaatatgcattaacttatcatttgaatgtcacggaaggtatcatattttatcactgaaattaacttaaaaattgcatgctctgagtaaaatatgtacgtatagatcacgatgcctacttagaacatgaaatattgatgttcatataatgttaatatttgcttaaatagtgattgagggctgtattttctttttatgtgatgatcctgatagtaatgttttgctaccattgtatccaactttttgattttcaattaattacctttgcaagtgactatataatctttctttgtaaaatcacttcatttatatctctcctctttcaaatcgctttgatttccccctggatctccatatgcagagtatcttaagtgtctatttgtagcagtgatttcctctttcactgtatttctgaatcttctgctgctactgggtatttctacttgggtatcccaatgtgaccttgaactataaaactgaactcctcttcttcctgccttctttcttcctcagaactccttccgcaaaaccagctgtgatttttttttccttttttcttagattaggagcctcccagacatccttgactcctttctcttactttctcatgatgtgtagtccagtcaagcaccatgcattttcagttgttcttaaaaaaaaaaaaaaaaaagatttgtccattctttatcttcctgattgttctcactgtcaccagcctggctgttaccaacctcatacttgcatgaccccttcaagtgatcagacttttaatctcttctcaacaagccatgtgttggccaggtgaattttcctagagtctgtctttgagtctttctttctcctgctcagaaacctttagtatatagctccctgttctcaatgaaactgaatccaaatgcagcctgaattgtaccagctctgtttccaactatttaccttcctgaatcttcttttccagccagtggtttgactcatcatttcctgagcctccatccactggccacactctgtgctcaagctccagggtttcccacacaagtcattccttcccttcctcgcccatccatccagctcctgcccagacatcagcactctaaagccttacctcctcctcagtgccacagtctgccccacctccagcttccttctgtggcttttactgtctgtataggcaatttcataatttaacttctaacagtttatgacagttctttcttgtgatgacttggactgcttttcacttcttaagtttttcaaatattcatatgtatagttagactgtcagtgcttctagagtgagagtctttgccttacctatatgctccataatgcctaacataaactaacactaaagcaaaagctctgtgaaggccagaatttttatcagtttttttcactagtaaatccttagcacctggcatgtagtaggtatgtaataaatatttgctatataaattgtaaatgttcaataaacattaactgatttaagattattcacacctgctacatccttttttcactataactaaaagattactatagtgaaaaaggaagtgaatgcaatgtatagccagaatctgctcaatggggcttgactgctccttctaaagaattgtgttttcctgcagatattaatgaatgtcagctacaaggtgtatgccctaatggtgagtgtttgaataccatgggcagctatcgatgtacctgcaaaataggatttgggccggatcctaccttttcaagttgtgttcgtaagtaataatcactttttattcctgttttggattaattgtctttggggtttttccaaaagaacggaaatactcagtggccaactgaatgcttgtaaatatacaggaaaacctcattaattaaaataacaagcaaggggcctgcctgatgtagtaaaataaattgatatcatggaaccttctctaaaatgcatttttattgtggtgataaaaatataatagctaaaactctgaatagagactaagcacaccgaggaaatatgctttgatgaaaagaaaagagagaattaaaatggacatatcaaacttttttggtacctgagagatgacagtaagtttttccttcataaatacggtattttaagcattctttaggttgaattgaactgtgtcccagcttctgcctttaattattccaaattctgagtcactggactctgatttaatgaggtttcacttctttctcaattggaagagtctggaaaatagttaccaaggccctgtgttttagattttctaattcagtcctaatttcagatattgtcttgttctttaaacccaccaaaatgaccctaaattatactgttttgccttaaaaatgtttctgagattttcccttgtttctgataagggtaaaaatccttcattaaaccacatgttctaatattggttctgaaagatagtttcaccaaagagatactccctctccgtgtaaattaatccatgtaatcactacagatcatatgccattagagaggaatgcattttaggtgtaaagttctcaaatgcagatttgagatttttaagaatgtcttatttttaaagtaatcatgcccattattataggtaagcactgtaagattttttttaaagagatggggtcttgctatgttgcctaggctggactcaaatgatcactgttcagcctgctgagtagcatgactatagacatgggccttgtagcactgcagatttttaaagattatatacaatttaaatggctgcatggcagaaaactattaggataattttaagagcaactgtgtattagtttctttcctgcaagtttttgtttttatctatctatctatctatctatctatctatttatttttgagacagagtttcacttttgtcacccaggctggagtgcaatggtgcgatctccactcattgcaacctctgcctcccgggttccaatgattctcctacctcagcctcccaagtagctgggattatgggcatgtgctaccacgcccagctaattttttgtatttttagtagagacagggttttgccatattggtcaggctggtcttgaactcatgacctcaggtgatccacccgcctcagcctcccaaagtgctgggattataggtgtgagccaccatgcccggccacttttatttattttttaatgtggctttggtatataatgagctgcatctttcttgtctagtttgaaatttgccatttggttgacatgttcttcatgagtttactgccattcatttttaacgaagcttatctctcttaactctttgccctaaggtgagatatgtagaggtgataaaataaagacaaatgtagtaaaataaaaatgacagtctcatttattacttttaggtgagtttgttgagtcttttgaaatgttatcactaattactactcttttcctttaaaaactgtcaactgcagattaggaagttttacacgtaagtcctcttttctgtgttcttttacaaacagttctgatcatgaagcagacagacacctaattataaggctttcctaacgggtggtaaaatcagaccataaaattacatttgcacacaaattacctttgaaactgatgcaaggatttggaaatttcaggccaaaaatcacattgttgatgacatccagataacttaggggatcatttttggctgatttgaatcacatgaataaatatgttaaatcattttataatttaaatgtaaagattgtagagtttggatatagagtttgttgtgaatgctttttccacccttttataatttgacttgtagtctggttacaattcttatattgaaggttgctgattaggtaaacttgcagaactagtcacaaaacgctctgtgaaactttgaccagatctgatgtctagagttgagggcagacatccaggttttaataagattatagaaatctgccaatgagatttttgaaacacttgcacatttccttagcatttattttccctgtcattgcccaaataattctgaacttattaaacaaccatccattcttatttgaaaaataaataattcaattttatggttcagctacaacagctgaactgataagtattaagagacgtttgttgctagttaagtgttccagttgagagttcgaagtgaaaacctgggctctttaccagtgttgagtgagaagatttatttctctttcctctgaatttaccacatgtaacatcacagagacatgtagagttcctttaggatttgcgatttgaaccagtccagtctgattttcaggtgaattctgtgaagagcttgatgggggaagtctgaagacagaaggaattagggaagagggtgatacttacagagtaaaggaaataaatgaaaagataatggtatttttggtagtcacagggaagtagcaggaggggactggagatcacacacacgcacacgcacacacacacacacagacacacacacaggcactcaacacagtggttgctaaatgtttgctctggagagagagaaaaccagccagggatgaagcctgcaggcaaatggaggacaaatgacaacatttgctaggacagcatgaatttaggccatatccagagcatacaaggtgtggctgactctctgaactcctgcacatggttatggccaaggaacaacgggaagcactttctcttcttgaatgcactgaactgagatgaaccccccagaattccttgactgcagccaaaggttgcaacaatttcactttctctccttgccgcttgccttggcttagccaagctaaaaggaagaaagcaggcaaatgctggcatttgctgcctctgacctctatgtttgaggcttaggatggtgtaggagcattctccagacatgttgctacctgatttatggggaaaggtggaaattcgaggacttttcagagcaaattcaagaaaagtatcatctttgcaatccaagtaggaagactttctggctttctgaactcctgcaggaacttcagagctccaggatgagtgctgctgagaatgtgtccataggttcagtaaaaaggcccagataaaagaattctgagcctgggcttttgccttttcgtagtattcttcacccatcaacttggagctagttgacagaaatggagggttagagagaagatgtgctcaggaacttctgccgtagtcctggaagtcatgagagaaagggcaaatgccttttaattaagtacatcattcatttgtaatttcctgagcatctttatgagaaacataccatgcttatcttatacattgggaaactaaagctaggaaagtttaagtagcttctcacacagctagtagctgagagttgagatttaaaacaggatttgtgcctccaaatttagggttctagatcaggagttggcaaattatagcccatgggaaaaaatctgtttgtttttgaaaataaagttttattggaacacagccatgtccattcatttacttattgcctaatgctgcttttgtattacaaagacagagttgagaagttacaacagaaatcatatggcacacaaagcctaaaatacttattatctgatgcttgacagaaaaagtttgctgacgctcaagctaattaacactgtccaatagaactatctgagatgatggaaatattctctatctgtgccacctcatacagcagccactagtcatgtatggcctgtgtaactgaggaattgaatttttacttttatttaaattttatccaaggagcaacatgtggctagtgcctaacatattgagtggcgtagttttgtatcctttttggcaagccaaatgggttaattactgctagctttccagcttttccgttaatatgggctttccttccagacttgatattttttgcccatggtaacattttctccagagcaccccggctgggagcctgtgtcatcttggactcttttgtatcttttggtttcaaaggatgacatttagtcttcataatttatcttatgcccgttcttttctttctaccttctctgtggccatctcaggttaggcccctagcctccctcacttggaggtctcatggcaccgtggcccggaggtgagacagatctgtacaagctgcttgctcccagataattacagtaaacaaaaaccatgacaataataatttttattgcaaacttcgtaaatgccaggcactgtgctaagcactttatgtgaattatcccatataatacttacaagatctctattggatttgttctgttatttttcctaatttagaaatgaaggaattaaggcatagaggggttagggatctttccaacagtcatacagtccataaagggtagagcccagatttgaaactggatctgtctcactccacaagctgaacctttaatcaagaaatggaaaagtctgaaatgccaggaggagtaagtcatttatttaaggagaactgatattttaatctcacctgccacactatagaataggtgacgtaactgcaatggccttgaattattgtttcttttattttggttctccacgaattttttttttttttttttgagagggagtcttgatctgctgcccaggctggagtgcagtggtgcaatctcagcttactgcaacttccgcctcctgggttcaagtgattcttctgcctcagcctcctgagtagctgggattacaggcgtgcgccaccacacccggctaatttttgtatttttagtagagatggggtttcaccatgttggccaggctggtctcgaactcctaacctcacgtgatccgcccacctctgcctcccaaagtggtgggattacaggcatgagccaccgcgcccagccatgaaatggtttttaatgacacatttcccagagtgcccagtggttcttactgccctaggtaagctgcctctcagactcctcaaagcagctttacctgcttcctagacctgtatcctaacactcatccccatagatactaagctgtaaagggattaaatgctaatgtggaatttcatccaagaaatgattaaggatattacagatgtgggtgggagtgattgcagactagtaaggttagctagacttttaaacccttgctcttttctgaaatcctccctacttttcaacttcttctaagtaccagattaattaatatctgcttaatatttgtcattcacattttaacccatttatgcctggtgttccattattggaatgctgagcttgtgggagttatttatatcctgctcaaggtcatctcagtaggtctgatttttcacacacacacacacacacacacacacacacaacacacacacatttacaacctccagcataaatgggttaatacattagagtagtatgtctttgaaagtataatgtgagtttattatacaatcctataattaaggccataattaaatataagttgcttaatatatcactgaggaacccgaataatagtatcttagctttttactcttgttttgtaattgaattgccatcaccatgggctgtatggttatgatttggtactatacttgggtacagagctatatgcttgttaccagtttgaaaatttgtcttatgtctgtagccaagagcaaaaaaattactttcctggtggatgtggcattttcagtaggttttatgcttctgaagtgcttttccttttagataaagtatcagaatctttttgccgtaattttagtaacacatcctgcacaaaataggatctgacaaagtactgtttcagtgtacaaacatgtaagagcctacaggcaccctttattatcactcctcagttttattcgattctacagctgcttcccctatcccttagaaatcttttggtatttctagttttctttagtacagcataaaaccttatgactcagtagaatatataatcacatgtaccatattttaaataataaacgtagtacactaatgtgttatcctttacaattaatcttccagtctgaggttaaagatattcagacaataacaacaccaatcacatcattctgggtagcatattgtttctgggtttacgcatcatattgaccggagtgtgaaaatactagagatgtttaataaacagaatgcaagtcatttgaaatgacaaaaagaacaacaggcaatttaggtcgtaaaataggggcagttttaaatggcacaccctgtcaggtatatgtggcataaatgaacagttttggcttcaaatagttgtagattaaagaaaatgtgaatcatgaaagcatcagtaaaatttcggtttgggagaggctttaagatggttgactagaggcatctggtgctcaccccctccacaaagaagaaccaaaatatcaagtagataatcacactttgaacagatcatctaacagagaacactgaggtttaacagagaagtcacaggaaacacctaaggcagggaaggagagggaaccaagggagcctgctcagccaggattagctgggagcctggggaggctccccagtgtgaggaaagggtagatgagagacctccagtgatccacattcccatgtgaattcctgcaatcctagccacaggagagcccttcggccctcacagactctgagacttaacatagggagctgcctagagacctcgtgatggaattgctgccgagagggagctcatgcatgctgggtcccacacacaccttctgagtcttaagcaggtaccaccaccattggcacctgagcactcctctcagaggcctcaggtcaggcccacccaacgtaccactaccatcacagctggcactcacctgtatataccacctgtgggcctggggactggcctgcccagctgctaacaccagcatggactgcgtgagaagcagagggttgtctcaccactgctgctgccatcacctatgctacacccactgcccaggagcctgagaacctgcctggctaactgctatcactgctggcacctaagcaagccacgtagagacccaagaattggcccacttggacccactaacaccaatgccagtgtacgctgccctcgggcccaaagacaaacacatttggcccacctctgctactactggggctgaggactggcccacctggtagcctcatcctcggcaaaattttgcacagaatctactaacaactgcatcctaaggcactgaagaatcagagacaccactgatgctatttacaactgaagaaatcttatggagactacactactgcatgtggccagaatcaaagccaaagtgccccacccaaacagcaccacagataacatcttcaggaagtcctcccctaaaagagatgctagaggaggctgggcgcacggtggctcacgcctgtaatcccagcactttgggaggccgaggcgtgcggatcacaaggtcaggagatcgagaacatcctggctaacacggtgaaaccctgtctctactaaaaattcaaagaacaaaattagccgggtgtggtagtgggtgcctgtagtcccacctactcaggaggctgaggcaggagaatggcgtgaacccgggaggtggagcttgcagtgagctgagatcgcgccactgcactccggcctcggcaacagagtgagactcagtctcaaaaaaaaaaaaaaaaaaaaaaagatgctagaggaattgggtaagggaaaggcaagtcagaaaacctcatttgtatggtgatatgatagagaagagctttggttgggtttggggaatgggcggcggggggacaccaaacttattcagcacctttggcctgacctggacctggttctgtagaatacactccatccatatttgcattagaagatgaacttcttgaaggcagggctgtgttttgctgattttcatatttgccatgtgtgcctagcagagtatttagctgttaggttgatgaactcttatctactaaacgtatagcagaagatgaggattaaagtttaggtattggatggctatagccttgtatacttttgcagtgttttccgaagagctgagcacatcatctcttccttctctggtgtactgtctggctagaacaggggccttgtgtggcactcgaaatcagaaaccactttctgcctcccattcatgttcactggcgtagggtgagacctgatgggccctgcaagctcttacttccctgggatgagaagagcagaggctggcttgcagcatcagccatgttcctcattctccaaagtgcctgattattcactaaatgctgccctagagttatctctactgtggttaaatatagaaaactaggtagtgattttggcagtaggtgactaggtttatttggaaaggtgggtttttgttgaaatgtttctcttcattacgcacacatacctaattgcatgcttgctaaaatggaagaagagaccagagagggacagggacaatcactgtcacgacttttggtgccctgactctaaaactcacatggtaaactgatttttcttcaagaaaggtgatgctctaaatctagacagatttatcctgaagtgtggtttttaattcataccttagggttcattttactatcatttggaaagccaatgtagttttggtttctcatgtaatgtcgggctttatctctctgcttcagctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacaggtaagacatgcccagctgtatgcgcacatagattcccagccacatgagtacacgggacaactttggcaccttgggtcatttgtggtttctgactttaatttttaataatacattgtaaatatttaatcacctttgtagaaactgtacacatacaatgttgaatcagtgggaaaaaattatgtgcaaagagattttcccatttctatgtgatatcagacttccttttgaatattaagaaaagccattatattttatcttcaatttccaggactctgagtctgatatttaagtgtagagagaccagaaggctctgctgggccatgcgctttcctaatgattggctgctcatcaattcacagtaactagactttgtgcaagttgactcatttactcatttattgagtatcgtgcttaatttctttaattggaaatggaggaaattatattcatgattgaatttacgctatgaagattaataacttaaggacagaacttgccaaaactcctgaaaacttctgtgggagttgagtattaagaagtagattattctttatccttcaatttggtacataattgccttatgccctgagaaggcaaatttatctctttaaataccttctaccaatgaaccaccaacttctcaagcaggatcaagtagagttaagtggaagagaaagaaatgtaacctgaaagcgttagacctgatattaacaaggaatggcttcaatgtcacttacttggggtggacattaaatagtctactcaattgcatgtttgataagatgctttctacctaggaaagtgtcttaactctcacagggccatgtagtgtcttaaagctgtaacttacaccatagcagacaagatttaaatataagtatcatgactcacctttgttcatggttagaaccagaaagaactgtgttaaggcaaaggataatacaacattgatggtatgttggtagactagataattttaggcctccaaaagatcctagtaccctcttgtgctcttgctcttgtgccatctgatgcacttttttttttttttttttttttttttgagatggagtctcgctttgttgcccaggctggagtgcagttgtgtgatcttggctcactgcaagctccgcctcccaggttcacaccattctcctgcctcagcctcccaagtagctgggactacaggcacccaccaccacgcctggctaattttctttttgtatttttagtagagacggagtttgactgtgttacttgatctcctgacctcgtggtctgccggcctcagcctcccaaagtgctgggattacagggatggttccactcattattaaaaattaataatcaagtaatctttataatttatagacacgtttctcttgaagttcagtttttaaagctttcagtttgtgaatttattatgcgtattattttgtgtctgtataatgtgtttttaatttttttaaattttttaaatgtttagcttttaagttcaggggtaaaagtggaagctcaattttgatagctttataatccttacatgaagcataaattgagatggtgactggaactcagggatactcctctctagtactatcaataaatttgaaaataatattcaagataaaatttttgcacttaagttttggttatatggtgattttcactaaaaatatttagttcgttaattctttaaacttggtttttttttttttttttttttagggagtttgttgttgtttttctggttttgtttttgtttttattatactttaagttttagggtacatgtgcacagcatgcatgttagttacatatgtatacatgtgccatactggtgcgctgcacccattaactcgtcatctagcattaggtatatctcccaatgctatccctcccccctccccccaccccaccacagtccccagagtgtgatattccccttcctgtgtccatgtgatctcattgttcaattcccacctatgagtgagaatatgtggtgtttggttttttgttcttgcgatagtttactgagaatgatggtttccaatttcatccatgtccctacaaaggacatgaactcatcattttttatggctgcatagtattccatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactggatatatacccaaatgactataaatcatgctgctataaagacacatgcacacgtatgtttattgtggcattattcacagtagcaaagacttggaaccaacccaaatgtccaacaatgatagactggattaagaaaatgtaaacttggtttttaaagtcatgttttcttctggaaacatgtttccaagtaaaaattgtttttcctagttaaacataagaatgaggttctaccatttagtgtgtgatccttagaaaaacagtattttagcatactataagcagtatttttagagtttcctttttcttgagaactaattttaggtcccagacattcaatagaagatctcttgttcagtgaaagtgagaaatgacttattttatattcaattttaaaagtagaaataaaaaagttaaccataagctccttggtgtctacatttggtaatttgcctccaacaccaacaccaaagggattaggtggatttttcctctgaaggccacacactgccttacccttcttctcccccttgcctttccccttcactattcatggggattatgccgtggaggttagcaaatcacatgtgctgagtctacttttttttttttttaaagaatacaaaaccactttttttctggcaatggtagtgattgattccagggcacagaatatctccttggcctctgggtagttaaatgagctggtcacggccaggcttttgcccagttgttgttcctttacttgaaaatagctgcatcttgatttggcatttcccttctttcttgatttctacctatcatctccagcatgtctcactctctagactcttcctcactatcccgagattctccccttcagaaacacttccccttttccgtcctccgtaatctacatcctcttaaccagctgatacatggcattttggtggagccctttgtgttcttcaactggaagcaaactgtgaggatttcggcatctcatttccctgaatagtgattttttttaaccttatggctcttcatctaacttagacaaatgtcactgagttcttttttaataactaatgaaattacatcaaagcgggaaaaaaagcctgatttttgctgataagacatatacatgcaacatgagatatataatacatatagtgtcttctatatataaaatatctcctaatatataacctaatatgatatatagtattttctaattggttgctgatatatatgggatggagggctaactatatatatagttaccctctgtatccatggttatgcatcagtggattcaacccaattggttggttgaatctgtggatgcagaactggatatggagggctgatcatactatgcaattttatgtaagggtcttgagcattgcagattttgatatccacaggggttatcctagaactaatccctcatggatactgaggaatgactatgtaaataatatgatatataaaatatatgctaagtatatgctatatataatatgtatattctgatttgggtaggataaggaattaacagatggaaaaatgtttagtaaaaaaaaagttggatttttttctttaaatatgcaagtttatcagaaattcgagcaatttgcttacattttgcacctgtttttgaagttttaaaatgtaactacattagtgatgatttattaagagctattcatcatgatattttcctctgtataagtttgcactgttagatttttaaaaggaatattttcccatcccaaatctagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaaggtgagagcggtaatggatcatggactctagacatctatctgtgtgtctttgctttgatttccctgtttataaccctctagaacagagtttctcagcctaagcactattggcattttagagtggagaattatttgattgggggctgccctgtgtattgtaaaatgtttagccactgctatagaataatatgtacctagtagataacaatattccatgctaattttagaatgctgtcctgatgtttgggggctgctttatcttggcgtttatatctggagagtaatttagatccttcagggaatagccctaatttcatttcttgtctagaaggccatttaacaactatttatttctgaagtggaatccacagactttcaaaaagttaaagcattaaggtctaatgggcagtcaaggataatggaggatgaaatgaaggaagctaagagattgtcagttgaagagatctggtgatcacctagtgtggttcttccatttaccctctgagaaacctgagacctagagaggggacatgacttgccagatgtcatatagagaacatgtaatgggacctgtgaccacggagcaccttttcccaaggaaatagtttaaggcttatacttgagagggagtctagagacaatggactttgactctctctctggcattcaggctgtggggtcatccctatctcttgatataaacccagcaatatctaatacttcacatatcttgcttacaaagatgttcacctcagaaggaacaaaccttttggatttgtatggaatagacgtattttctctaataaagctcctgttggcttttcacagttgattctgaggtcagaattcagggggccatttttgggtgctgttgaggagatagagtgcccaggctagtgttgtgttgggagtttgccatagccgccttcttggtgaggcaggctttttttctgagctctgaacgtttgtgtgttctggcctatttgattctatgctttcactcactgcatttcttccttggtgaggcagaacaggcaaaacctcagctggaatcaacagtattaatcagtttgcccctggacacttagtatcatgaccagatgtttgcaactgttcattgtttgcacaggcaggaggaaatgggccgtagttccagattttgcctcaagaccttcttcgtggtaggttaggcagaatagaaggttattgactttctccaaccccaagaatattgcagcaatgattttactttgtctggtaccctgattgctttcaggatttaatgctcctgcccaacctgtaaactaatgtttttacaggagacattgattgacttatgagaaaaatcctggtgaatgttgatccagggctttagaactaatatgaaggactgattaatgaaaagcaagtctttaaaaatacaaaggcatcaccaacaccctcacaataacgtttatgattgtgtaatgtataatttgttcagtatattgatgctaatctctaattggctcttcctggcttgtgagattctttttcgtaatttagttagcatatctttttgaaaatattcacggggcttcattaaagattggaatacatcaagaatgcagcacatgctgtcatgtctcttactgaaataagtgacattcttttttaacacttgacaccagaaagcatttcaaacattatataccataaggataaacctttaaccaattaatgaaaatgtttgttttctaacatatggaaagttccacataactgagataaggcataaaatgttgtaccagaaagtattgccttcttcttttaattttaattctgaaagagtttgaaagacttgttcacatcttctccatgtgctccagtagttgaggagtaacagcactgagagttctctgttagtcatgtgtaaaattccctaaaatggcagatgatcctaattctgcatttgctttagtctgattcttaatccttttgcagagataatggacttctattgttttttaagaattgaaatataatagactgaattgtcttaaatggtactaataccctttttcttttctggttttagtggcaactgcaccccctgaaaaggtaatttattcattgcttgcaagtctttttttttcaacgctcaaagtgattttctattagaatatgtatggattttttagacttaaatatagtaacatctctattatgcatcatttggtttgagttaatatagcattcagttattccaaaaaaatttattgagccattgtcatagattgggactcttctcagtgttaggaaaacaatagagaacaaataggacaaaaatctctactttcatgaagcttcaattctcgtgagaagaaaatgggaaactaatgggaatcaagggcataaatagaattcaatgtcacctgatggcctggaccatctgtgaaagaaaggctgtgacatgcttagataatcatgtattcttagagcacatatatagttagtgaagtacttcttagttcaactaaaatttaacatacatgtttgaattgagtttgagtaagaacagaacttacacttaaaagttacaatcaaatactagaatgttgctttttgaaaagtcagtctattggcttttgggcatagatgggggctatgaattgtgagacattttagtaggaaatgtaaacatttactggatctaagtcctatttatgtaatattgttccttctctgaatccggctttctttctttaataaaaacatccattttcattaaatgaatgaactttatgtcagagaactactatgatatattgctagactaaattatcgttgcattttgaaatgggatctcaatgcatgtaacaggctttaattttctttttatctccttctgcataataattacatgaaaattaggtaattattaaatatttatacatttatgtaccattctttaagctgacaagaatgcattattagaatttagatgaggcaatacatacatgagttattttaaatagtattctaaatcttataattatgggatagagtaacatatatgtcataacataagtgctgaaataagaaaaagagacttacaattttggagtgatagcactcgtccagaaagaggttatagtattttgagaccaaaaaatgtataacagatatgcatactttgtgtgtacttttgaagctcttagcatctctaaagatcagtcacagcgagtagtttgcaattttgttgattttgaatttagtcctggttgatgtatggaagtaattatttagcttgtaggtgggccagccagcatcctggcagcctcatcacgactcagttcttctgtctttatgattgaatttaataactctcattaaaaatctaaaaaacccccaaaattttcttgtatacttttactgcattttatttggggaggagatagtacgaaaaatgcaatcatagcctttgttgtcttggtacttaaaaaagtctcatgatgttatgtgatggatgaagaaaagaaaggatacccagagatgtgcaaaggtgtggtagaggggacagcaagggtcatgaaagacttggtcagaaaccgaattagggactgctttggaaggcttagagtaccaaactgccattgtaatcagtggggaaataccctgcttctcgactggaccgtatttgttaaatgtagaagtggtgtagattaggaagtctgctgcctcacggtgatgggggaaattctgtaaactgcagtagtggattaacacctgatcctggtctgttccttgttggcattggccatggctgcagggaatggggtgcaattgagactggttgaggtcatctctagtaagtaatagaaagctagttttaagaagacagaggaaatgtgggaaaaactattaagtgctcagtatttgtaggagctgaattttggtaggtctactcaagttaagaagaaagaggaagccagttagattattacaataaactgaaaatgagagtgagtccggcctagggtggtgggatctatggatatgaaaaagggtgaacaactgtaagaaaaaagtgtcaatggacggggcttgcaatgaaaaatgaaagagggaggactaaaaggtgactttaaacctggatgggacagattaatgactgtggcactggtagaaatgaagttggaatgagagcctggatggttttggaagggtaggctggaggtatctgtgggatatctaaatggacttaccctgtaagcatttgtgcttgcaaagttggatttatgatgagatatccaggcagactatcttagaaaaagcagaaaataggtgatacttgaagccaggagaagaggataagaggttaacagaggccagaggagtaagctttctggaagaggacagaaccaagtaactcgatgagtacttgaatgtagtgatatgagctccctggtcacatctggtgtgagtgaagtcacagatccttaactaggctaattgttcagtctgcctgagccctgcacagttgtaaatggaagctgagccacggatgatggactgcttctttgcttgaggtccaggggacaagcgtgggcaccaaaatgtgtgatgaagccccaaatccttctccaagccagcacatttctgttgctctgcctggctaccactgttcagagagctggagttgtaaagttatcagacgtgaggttaaagaaggccatagtaactgactggtttaaaatattttaacttaccatgtgttctttgttatggcacatctgctatatccattatttaatctgcaaactgtggctggtcatcttagtggggcagagccacatgtgaatgaggcaatagtcctcgttgggggttagttttgccctgttgcagaccaaatatggacccctgggccaagacatttacttacaagatcagactttgggcctcagggaaatggctgaagatatgtgcgtggattagcaccactgggaaaaatttagggctttccatagtagcaccacatcaaaggttcttttttttttttttttttttgtaatttcacacaattatacatgtaaggtcctatgatatttctttgcctttctaagaatataattaattacataaaaatagtaatatgtgggaaactaaaaataatttccactttcaattcttttttttttcttattctcttttaaaatacaaccatccaggaaataccttcattggatcaagagaaaaccaaacttgagcctggtcaaccccagctgtctccaggcatttccactattcatctgcatccacagtttccaggtagcctgtgttgatctgtgctgtttgtcagagtattctgaataaaaatgtaagacgggaaatttttgtctttgactttgtgtagtaaattactagacttcataactgaagttcagtgttaagtatagtaatatacttatataatgttagcataattacagcattgtaaggattgtagtgggaaagataggttttttttttttactgttttctgtgatcaggagtagtatacactattcagacattattgaaggttatcatttgatgaacgatcatttttcttggcttccgcatcactctcagatattcttgctaaatgttgaacccagagccttgggacatagaacagttctttatatctgacaaatgctgtgatatattgctagactaaattatgcttgcattttgaaatgggatctcaatgcacataacgggctttaattttctttttatcctctgcttcctcatatagtagtgattgaaaaaacatcacctcctgtgcctgttgaagtagctcctgaagcttctacgtctagtgccagccaagtgattgctcctactcaagtgacaggttggtgcagtatttttacattatatatcacatggaggagacgtggggctgagcttcattttaaatgtagtatccattatataagcttgctcatggcagggttagccatactagcaaatatttggaaatcatctaaatacagttaaaaaggaggagtatgtggaaataaattatagtatatatgaaacagaatatcacatagtattaaaataatgtttgaaaagagtagttaatatcatgaggaaatatggcataatctgttaataaatacagaatacaggctgggtgcggtggctcatgcctataatcccagcactttgggaggccaaggcaggcagatcacaaggtcaagagatcgagaccatcctggccaacatggcgaaaccccgtctctactaaaaatacaaaaaattagccaggtgtggtggtgcgcacctgtagtcccagctacttgggaggctgaggcaggggagtcgcttgaacccaggaggcggagattgcagtgagccaagatcacgccactgcactccagcctggtgacagagcgagactctgtctaaaaaaagaaaaaaaaaaaaaaggactgggtgcggtggttcatgcctgtaatcccagcacttcaggaggtcgaggtgggcagatcactaggtcaggagattgagaccatcctggctaacacggtgaaaccccatctctactaaaaatacaaaaaaattagctgggcctggtggcaggcatctgtagtcccagctacttagaaggctgaggcaggagaatggcgtgaactcaggaggcagagcttgcagtgagctaagattgtgccactgcactccagcctgggggacagagcgagactctgtctcaaaaaaaaaaaaaaaaaagaatacgatgtaatgattaccattttacttttaaaatttctacaaacacggaaaaagaaagaaaatgcatcagtgttctgttctcaccagttaatactggatcatggataattatgttctttaatatatttttattttcaaagttctgtataataaacatattattttaatcatgagtgaaatagcataaaatgttttatattctgaaacaaatgcaaaattctaaatgtccatatccttaatgtgtattgagctcttataaatcaataggaaaaatactaacaatagagaaatggaaaaataatataatcagataatttgtaggaaaaaacaataccaagaagcatgtaacagaaaatttcgactttcctggtaatcaaagaaaggcaaactaacctaggataataccttattcctatcaaattagtatgtaaaacccaatcaaatttttttattagggtgagattgagactctctcacattgctaaagggagtatgtgttggggttctccagagagacagaaccaacaggatatatccagatatgtagaaagagctttattgtgagggattggctcacaccattctgaaggctgagaaattccaggccaaggaaggctggtgttatagttctagtgcaaacccaaaggcctgagaagcaggggagttgatagcataagttccagtctgagtctgagtctgaaggcctggataccgggcataccagcgtctgagggcaggagaagatggatgtctcagctgaagtagagcagattgccttcctcagcctttttgttgtgtttgagcccagcacccagcagataggatacccacccacgctgctgagggtgatcttctttacacagtctaacaattcaaaggcctttttcttccagaaacaccctcacagacacacccagaaatatgtgatcagctatctggacatcccttagcccagtccagttgactcatgaaattaaccttcacagagtataaagcacaaattggcaatatgtataaaaaacttcagaactattcagaacttttgacccagtaattctattttaagacatcttgtctaaggaaataatattcccaaaggctgtgggtaggagtttatatgagtggttacctatcacagacaatgtataatacagaataaatagaaataactgtacattcaactacagggaaatagataattatgttacatctatacattggaacattatgttgccaccaaatatagtatttttgaagaatttttattgaaatatagcaggaagtagtcatacaatattgctaaatttaagatgaaggataaaaaactgaatgatatagagtattataccagtttttttaaagacatatatacactgagaaaatgctgggagaaaatacactagatattagcagtggtttttttttagtggcatctgagagatttaagtgttttattttagatttttttattttccatattttctaaactgaacagttatttttagagtcagcaaaaatgtcactaaggggcatcatcatcaactttaactgaatttatgataccactgcaggatgaggttgacaatgtgttataggagctaaatggaagagtttggagcctcctttagaatattccctcctcagaaacatgttatggttcctttctaatagaaatgttctcatatgttaagcttttggccacttagtgagtcagtagaacaggagcctcgcccttcagggtgcagctacagtcacctagccacggctccagatctagacatccctgcactctaaggggctgggaagtccctctttcaccacaggctcagaagtgcctgctgtcactccttggcctctccccgctgccagcgcctgctccagggtggagcaaagttgtggccaagcccaagtgctattgcaacccagccagttgtgcatgtgcttgggtgagtgttgacatgccagtcccctgtcgccttggccccctctggacattgggcaccaatgagcatgggagggaagctgagggtaagctgagggtagctcagtgtgggcttgcaggtgcccctcagcatgaatagcctgggtgtgtggacaacatgttgatggagggaggcagacaggttcctgggtggaaaggggtgagtcctcagtgaaaccccaccttcaagccaggaatggcctgaagcctgggggccaggctgccagttccaggtgtagtccacggtccagagtgaagacttcatcgataacagtttggccaatcagatggtgtttttctaggccctccatgatcacccatggaccaatcagcacacacttcctccattctgagcccataaaaaccctggactcagccaaactcacacagatgtcaggagtaccagctgtgagaaggagctacccacttcgggtctcctcagcttttcaggatgacgtgcccgcagaaaggagctacccactgtgggtatcctgagagctgtcacgtcactcagtgaagctcctctccaccttgctcaccctccagttttctgtatacctcattcttcctggatgtgggacaagaactcagagcccaccaaatggtggtactgaaagagctatgacacaaacggggctgaaacatgacccccccactcaccatgttgagggtgccgagaaggggagaagagctgtggccctttggggagcccaaacctaggggctccccaagccagggctgtaacagcctctttggtgctgtgtggtttctggcatctccgagctttcgggcagcactgtgtccgccatctccagatgctggtgcctgcagcagaagttactggcagtatatctggtccagccacagcctcacatgaagcctgcacctgtgccagcacctggagctgcccagtctgctacagcagctgggatgcctggctgtgtgtagtggctggaccccatgcttgcttgctcacacacccctcactgctccacacctggcttgcccttggcaagtgtgggatctgggctggcagcacaggccaagcacagcctgctgggctgagtgggtagaacaagctcagtgggtgcaagcaaaacttgggcaaagatgccaccagccacagaggttctggctggcaaagtgataccccaaggatcctgtgacaaaatgatggtgattttttttaatggccatggctaaaattgttattctctattctgaggtcatgtatgtatctacccactttattgagcacactgataagagactgctttgtgctgcaaagtatacaagcaaataatacactattttggacagcaaggatcttctaattgtttatagtaatgttaaaaagaaaaaaatgcagtaagacattgtaatttactagttctttcaaaatactgcatttcagttttttcaatgtgaagataaactctagttttgaatgggcatggctgacttaaatggacaaacctctttcaaactagctttgtagaggttaagttcagttaggtaaatgcagtttcaacatttaaatgtagctgtgtgaagggtaacaaattgaagttactcagcttcaactgaactgcagagctggttaaaaaaacaatgcaagtagccttgctataggaagttgttaaaacacaacttgttagaggcttaatttgagtttggcagaaatacagggctgacatctgctgtcacatgtttgaagcatgaatatatccttccaagaaacaagtgatgcagattttcttttcatgcaacagttgtaggtacttccactttctgtagtaaaagaatatttctgaaagaatccatagggggaacagtatagatagtctttgaaatgaagtggtttgcaactttagagctacactatacatagtgatctgcattagcacaagaagactgttttgtatcaaatataatttaaatcaaaatgtgtatgttcccatcggtttcatatgggagccaaacacagatttaaggagcaatctcatcagttctctcaggaatattgcataataatgtttttgtctctaaaacacagaggaggtaaatattatttgttactgttagtttctcccatgattgaagacagggatagaacaatacgtaagagtctaaaatgaataccatcagctccacattgtttagtgattatatctttacgatggtgaaattggaagtagccttttcacatttagctaaacacactttgacatgtgataattataaagtgagccacatatctgcaggaaatacgtgtgatgttttccactcttaacagctgacttggtggctcgcaacattattggcataccattttcaagtgaattatatgtttcagcatataaattcttgatttagcatagtgtcttaatagctaaaggataggttgggaaaatcaaacttttatttctctggcagatatttacaaagtggaaacatctgtttcaattgttgtgggacaatctatgctcactgtggggcagttaggaagccagggcatttttgtaaacctttccatgagttaacatttgatgccttcctctggctcttcccaagctttctccatggctcttgcagactggtcagaaattattctttgactgagttaactgccttgtggaaacctctgtaattatcatggcccagacatttaaaaaaactatttgctcatcagatcttttccagaactcagaaatgacccaaaaatgtttgtccctcaagcatattaccagtgtcattactgcctcaataaactgtgtatgcggatagaaaatgaactcttttatttccatgtgaaatcatcatgctttagtatttccagactccattcattcattcattcattcattcattcattcagggaatcacatgatgaagaaaaaagctaaaagtcagtatagtcattttcatattttgctaaaagctttctgtttcatttaattttagaaaatagagtaaaaataccacactgttaaatctaccattggccttgttgctggtataaatagagtatttggttttccatcactggctttctgtcatggccctttttccatattctagatggactccagcaaaagaaatagaataaggtccttgacctggtgaagatgaggttttcagggagcagatatagtagggaagagtagggctgtcctgtgaaccaggtggcattatgaaggacatgtgagagagtccagtggggagcactcacttaatcgtctctctgcaaagccaagaaagccaagcatgctaaaaagacaagacattcccattcaccagcatacatacccctgacacaagaaatgagtgctgtctatgtgaggcttgactctggtgtatcagacagagcccagtttctagagtttatattgacacagtttgctcaaagaatcatattcttctacatgaactgatctactcggtgggaaaaggtttgcatgccgatgtgtgagtgaccacttaggaaaaatataaagcatcttgtctttgccctaaaaaacagaaaatgcagaacacttttcctgttctttaagacaacattctcaggacttgtgtactgtctatgtgctcaggaatgaaaacctattagaaaaggagagaaaacacaggggagatatgagggagacatgttttatatgttttaaagtataagtaccagtaatttatttttttacctgatattcaactttttttttttttttttgaggcaaagtctcgccctgtcactcagggttcaagcgattctcctgcctcagcctcccgaatagctgggactacaggtgcccaccaccacacctggctaattttttctatttttagtaaggatggggtttcaccatgtcctggctggcctcaaactcctgacctcgcctcaagtgatcctcccttctcggcctcccaaagtgctgggattacagacgtgagccactgcacacagcctctgatgttcaactttttgataagtagtgaatagaaagcagacaggggtgttttgaaggtgtgatggttgttttctgtctgcctacaagagtggaatccttggctcacgcctgtaatcccagcacttggggaggctgatgtgggtggatcgcgaggtcaagagatggagaccatcctggttaacacgatgaaaccccgtctctactaaaaatacaaaaaaattagccgggcgtggtggcgggtgcctgtagtcccagctacttgggaggctgaggcaggagaatggcgtgaacccgggaggcagagcttgcactgagccgagatcgtgccactgcactccagcctgggtgacagagcaagactccgtctcaaaaaaaaaaaaaaaaaaaaaagaatggaatcctgcctggcaaaggatggaagggatctctgaggtcaaactgatgacagttacattaattaatcacttgtgtaaaaatgggaagaagtagaaatcaagtatgtttcagaaagtgtccctctttcctttgctgtatctcttagtaccctctagtggtgtcagcctaacattttcttacatgtaacgtgatcctgacagacatgttcagcgtttgcaagccacgtctctatatacttatgtatgaggtaatcaactaaaaatcaacaaacattttttatcaaattccaacctcctagcttctatctaagatattggattggtgggaaaggccattattactcattttattcctaagactaaagagttatacttcttcactatttctcctacctcagagctgacttttgagaagaaacactttagctatgttggcaatttgtggcataggaatatatcacattttaattaagcatcacatatatttgaagacttgttcacacatataaagaagttccattctaaggctgtccctgccaaatgacaaatacttggtaatcaccaaattggtattgtgggagtgggttagtgactacttatcaagcttttcatgaaaaccccagatttatagcctcttaatttgttctgaacccttgccctgaatatattaattcaccttctaattttttttttttgcaaatatggtcaacatgtctttctgctttatgaaaatgtcagagatgagtataaagataggtcaataaccacccgggaaaaaacccaagaaatctaaacaccagtaacttgcaaaggaagcttctatgtataatatagagtcgtgtgcatctcatgctgtttcactaaaaaattcctataaacagaagagaattcttacctgaaagtccatgagtataacctggtgaagattaccttttaccttcagattttaggtacatacaagttatatttttaaggaagacttttcagattatgaaagtgccaagacatgcttagtgtaaaaattttaaaaagtaccaaaaaaaatgaagaaaatgctaatcctaaaaaccataaaacttggatctacttccctccaaccttcttttctgtgtgtattgtagtataatggagattatattctatattataatttgtgcctgtgtttttttaacaaataagcattttcctatcttgttaatgattatatgctgtgctgtatgtataattcattgttttgtgttattattgccagtcacttaagtttaggcagtcatattaattacccatgtttttagccttttgaattatttttcctataatttgataatattttcactataaacaaatgtatcttcctgaaagtgaattaacataactagactcacaaaaggtataagtaatttgtaaatacatggggtgtgcatacatttctcatacatccaggtgactttgtgtaaaatgctgaagttcatatgcttcctttttcagatgacttgcatgagtagtctcaaagtcacagcacagtgaatactttatgaaaaatgaagcatgtggttttggtttcggagagcaacctcaaccccaatttaggtcatttccatagtgaatctgtgttaaagcactgttttccacatccttttactgcagaatagacagtgtgttattagcgagaatagcccacctgcttttcttctcattcaaaccacagacctctctaacaaagctgtgctcctaggttgtcatgctcagaggcgccaaactatttaccttggagggtcgcttggcctcattcataccagcctctcttttgagccttgtttactatacgatgacagataatagcccaaggtagtattggtataaatgtgttggtttttaaatatattcttaaatgacttcaatatgaacaataatggtaacttttattgagcacatataatatgccaggcattggctacatgcgttatttagagtatctctttcattctcatactttgaagttggaactctgattatttccattttacacatgtagaaaagtgaggcatagaatggtgaggtcacttgccccattctgcagaactgtaaagggcagcagcatttgtgcctgcactgtcttcaagccagtgcttctaaccaccagctgtgccaccttcactaggccattagaccttcttacaaaggacattggaaacagaaaatcttaaaggagtaattaatctcagaaggccccctttgagtccttgggtttttttttgatggactccacctaaccatggactcctaagaccctccctccactgtagtgtatgtctgtgagtagactgaggacttgaacagggctaatctgtacaggatatagagaagaagccagtcttacacagggctcagtaagggagtaagggaggaatttagcagaaaagatttgggaaaagattctactttaccagtagaaataaaatatgttcattttgaaattggcaaataagagtaagatacaccaagaagtttttctttgtttagaagtgggaggtctttggggggattaatgataaattttggaggagattggatgtatttgttgaaactcaaatatggcctgctaaagaatggaaagttacaatgtgtttcttatcaatagataagaaatctcttacctattggtgattcagactctatcatctaagatgaactacaatgaatagaaactcattaataggccattttggaagctgttttattaataattgattttcttacaacttacaacatggcctttttctgagtttcttctcacttcagttcatcttaaaaatggctttactaggaactattgatgtccttggataggactaactaatccattataaagtaatcacatgaatttatacttgatgtcagaggtcacctttgtcttctaaatgtagagctggcaataatttgctagttggtcaggaaactcaaagtaatactttgagagtagcagtgaaatctgttcatttctgtgggttttttcacattattttatttacttttaaagaaatcaatgaatgtactgtgaaccctgatatctgtggagcaggacactgcattaacctaccagtgagatatacctgtatatgctacgagggctacaggttcagtgaacaacagaggaaatgtgtgggtaagagacaatttgattgactaaattattaaatatcaaacatttgaacattaagaacatttttttcttaaaccaacttaaccattttgggaaagtgttactggtttaattttttgaaagtttatcccttagctaagggagctcaaaaaaaggtttgctaaacaactggaattctcttacctctttgttcaacatttgtttacctcgcaaatgtaatatatttacataaaggtgaaataatttccaaaagctttttgggtaaagtaaacaaaatatgaattacagaaacagctacctaaaaacatgtatttagcaaaaacaaattaacattagtgtatactgcagtaaagaattacattcatttatgtacataagacttgatttttttaaagggattttaaaattgaaaatccatatatgctggcctgaaggtgtcagtcaatttagaaatttagggatctcatatatgctccttttggaaaaaaaaaaagtatctcagaaagatatgcagtagagttaaataaatcattttaatgtgactctaaatttaatttctctttttttttttaagaaaaagaaaattcagcactaaattatgaggccaataggaagcaacaaaggaacatatctaattaatacttctttagtatatgtgaattttgctgtttggtgtgtgtgtatgggggagaaaggagacagccacctggtccataatttggctatttccttgtcatttgtatacattatatgtgtcactttcagaacctagaatattaagttagaaaggcaacagagatgacctaatccaactccatccacatgcacggaggaagagtctctttcatggcatttctgactccctactgacagcaaattccattgcttggatgtctctcgttatcaggagaatccttctgtgttgacctgaaatctgcctctttgaaacaccagtgtcatggttttgtagttttagcctttgaagtgatacacagtaggctgcttctctcttccaggaacaatccttcaagtacgcgaggagaaagatcgtgtctccttttgctgttgtcctcagttataaaggttgggtggtacccagggaatagtatgatggtattttacagaacagggaaactaagttcttgctacacagaactaatatttttatatgtatttttgttaacagatattgatgagtgtactcaggtccaacacctctgctcccagggccgctgtgaaaacaccgagggaagtttcttgtgcatttgcccagcaggatttatggccagtgaggagggtactaactgcataggtaatggcagcattcttcctgcttacaaattcttagatctgagtttttagatcccctaagactatcatcagttcagtgcttatccagacaacccagaattttttattaaacaattatcatgacagcagtctgctagatcccaggtgatataaaaatggatttttttcccctaacatttttgaagaaagagtgtcatatatgtgcatagacaagatacattaaatgttacttttggaccaccctgcatgaatcaaaactggatgattttgatgtgtgtcaaacaaatcaaagggaaagtagaaatcagttactggccaggcgccatggcccacacctgtaatcccagcactttgggaggccgagcctggcggatcacctgaggtcgggagtttgagaccagcctgaccaacttggagaaaccctgtctctactaaaaatacagaattagccaggcatggtggtgcatgcctgtaatcccagctacttgggaggctgaggcaggagaattgcttaaacccaggaggtggaggttgcagtgagccgagatcacaccattgcactccagcctgggcaacaagagcgaaactccatctcaaaaaaaaaaagaaatcagttacttcgttattatatttgagctaagctgggagatgggagaggtttgaaacagtatttggaacacaaaactcaacaatgctatctgctcttcgtagatgttgacgaatgcctgaggccggacgtctgtggggaggggcactgtgtcaatactgtgggggccttccggtgtgaatactgtgacagcgggtaccgcatgactcagagaggccgttgtgagggtgagtcagctgagagtgttcagcacacatgacggtgatgtgcagggttggtaggcaccttgcctggttcttgtttccttcccacactcagtgcgtgacaccagtttatccaagctctttctgcttcctagattcacaggctctttgcctcttcctttcactggctcttttgggattattttccatcttcatgctctcattatttttcacctcaatatctgcctctctggtatttggaatgaaatcaccatagaatgattaattgcatcatatttagtagaaacacagacttaattacagagtccggaccattcatctgggaacatgctgcaggtgtaaccagtgttgattttttgtttttgaccttttcacctacttacattcctttgtctccaatgctttcttttacatgtgttctggtactttctcacagactccccaagaagcatggtctgacaaactttggtcagattccaactgtgcttaataaaatttcctcattattgaccacagcaatgagctttctctcattataaaaatgttataaaaagtatttatagcatggtcacaattattatccttttcatatttcttttcacgtttgtgtccaagttgctctggttctttttgaaaccaatgtagtgaggccaggcacggtggctcacgcctgcaatcccagtgctttgggaggttgaagcgggtggatcacttgaggccaggagtttgagaccagcctggccaacatgctgaaactccctctctcctaaaaatacaaaaattagctggatgtggtggcgcacgcctgtaatcccagctacctgggaggctgagaaacaagaatcacttgaacctgggaggcagaggttgcagtgagctgagatcatgccactgcattccagcccaggtgacagagaaaaaccttgtctccaaaaaacaaagcaaaacaaaacaaaacactatggcactttttttgcaattattttcatgaagaaatacactgaccttctgctaaaaacctgtcatggaaatatgagggtgaaggaacacgggatctgtgagggcacgggagcatggtgctggttccttggggttccctgcctggctgtcagcagagcctaatagatctgggctctgttaggtggggcaggatggactaggttggcacagccagccctcagctgtcccctggcttctgcctgttggttttcttcactgctctaatgacccaggcctggagggagagctaattagacattttttggcagcctacacttgcccctcctgctggtgtcttgcctctgccccttgggttctaatctagagagaagtgggagtgttttatgttgctggatctctgatcagcatggagttttgtaccctccccgagggccacgaggctacagaacaagcacaggtgtaaagtgtctccacgctgctcttccagggaactctcctctgctgaagagatgcagcgtgggagcagctcaccacgcccacagtaactgcctgacctgtagccactgactttgcccctttgaaacgtagtacatcatctgtaaaataggaaccatgaagttaactttccaggttttcatgaaaataacttcatgttgccataacttgtatgatgcctgtcactttgttagttttcaagaagttatagtttctttaaatctccccccatccctgactccttttgtgtttgtatagatctcaagcacctctgtagttgcggggagtgctttaaaaaaatggggtgtttatttgacaagcatttatgtgcagagcagtatcccccaacccccaacaaagaagtcaaatactgatttttttttccctttctttctttctttctttctttctttctttctttctctctctctttctttttttctttctttctttctttttttttttttttttttaaagacagtcttgctctgtcgcccaggctggagtgcagtggtgcgatctcagctcactgcaagctccgcctcccgggttcacatcattctcctgcctcagcctcctgagtagctgggactacaggtgaccgccaccatgcccggctaatttttttttctatttttagtagagacagggtgtcaccgtgttagccaggatggtctcgatctcctgacctcgtgatctgccagcctcagcctcccaaagtgctgggattacaggtgtgagctactgcacccggcccaaatactgattcttaagttctacacacgggtcaagaatggaaagataagatacttaagtaataggatggaaaggaatagaaaataaattggaaaattatgtacttaaattggaagcttgtaggagaatattcggtgatattcaatatatgaaaattatttgggagaaagatgactagcgttccctcagtaaataatatataattctatccccatgaaaagtcttgaaaagaagaaggagccaagaaacgcggctgttttcaaatttcatcatggactagaaccaaacgtccccgggcttctggcacacagaagattttctcagctgtcactaacgaagttgctttcaaatagcaccagtctccaaggagtctattgtagtttacagacattatctcatgcatccttactttattctgttaaggtattataaggcaggtagttcctaatttatagaagaggggaaaagccgaggtgagagcaggtagaaattcagggacattatcttgtattgctcaacattgcaccctatttattgggctagcctgtctcgatggcattctctgatttagcagttgtagttctatttttttgaaatatcccatccagaggagaatgtaatgctatttggaaaatgaaactggcaagcaccatctttttgtagaacaagaagtcccagaacatctgacctaaaaaaaccactatgtatcattggccattggcaagaatttttactgatagaaaaaaaattacaacactgacctggtgcttattttgttaatatcatctttaactttttcactttaagtatcttttcacatgtctaatggtatgcagtgggagataatttttaagtatttactagaatgtagacatcacatacccatggatatttagtggacccattatatatttctttctttttttgtttctctagtttatgtcctgaaaatccgtttatattttaagtacgattaaaggtcatatatacattgtgtattgggatacttaaacattaaatccactcatataaattcaagatccacctcagaaaaaacacttatttcaaatgcagctagaagccatggtgttaacacttattttaaactgttgaactctctcttatatctttttcctcattttattgtttgacaatttttaaaaatgcctcaagctgtcgtagttatctcctcacagacttaaccatattttaggagatttttttctccccaaattggaaagaatgatgattaatgacttcagttagctatgaatatgaaaagtaaggtgtatttttaccagaaaatattaccatatggtcatatcaccgtgttttctggaaaggcttggaagtatgtgatgagttcactctctcctcatgtttttttttttttccacctccaaggaattcctgtcatatgaaaggttttaaattattccaacctaggatattcttgggcccatgaagccaaagtgagaatttccctagagcatccaatgtttgcagagagaacctctagctgggtggatacatagcttcctcacactcacccccattctttgtatttctttctggaaagctgtgctattacttgaaaggtttcatgtccagaaattggccctagaggagctgccaactcccagagtggagaggccaggtcctgctagttgaagaattggggccaggttcttccttggaatgtatgcaaatattttaatccaggtatgcttgaccatgcattattgccatgtatttaagtatagacccaatgtctcacttacccaattattgtttttcccactgaaatgtagatataacatgctttcccccgctgccttcatcacaaagtaagattttgctttggtattctgataaaatgttcacgacctaggtttttgatttttcagatattgatgaatgtttgaatccaagcacttgtccagatgagcagtgtgtgaattctcctggatcttaccagtgcgttccctgcacagaaggattccgaggctggaatggacagtgccttggtaggtactatagtgtacttatcaaagatttgtttcttctgcatggcccattttctgatagagtggtgtaatgccaatggagccctctttcaaaatgaaaaaatgaaatcttacatcattctaagaaaagttcccagtaacttttaaccattgagaaaataagaaaatgacttagcataaaggatgtaagattctcgatggggaaaataattaggattgaaacaaactgatattcctaatgagataaatatccaaaaccaaataagatagtaaggtctacaggaaggaagagagatggagagcaaaacacttaaaaagagagaagaagcatctaccacagacaagtagaattaggtaacacacacacacaaattttcaacagaagtatcaaaggtagtgctttaggcactgaggaagacagagtaatgtatttgctttgattctaattacccgtgctgtagttagctctgccccttaatggttttcatttgtgtctaccatgtaatctttttccctaaaacttgaactcttttccactccataccaaaactctgaatatgtgagttaaacttttcattcattcattccttctttcctttctccctcaaatgcttaagaacttactataggctatgcatggtggctcatgcctgtaatcccagaactttggaaggccgaggcacgaggatcacttgaggccaggagtttgacaccagcctgggcagcatagcaagacctcatctctacaaaacattaaaaaacttacctgggcttcgtggggtgtgtgcctgtaatctcagctacttgaaggctgaggtgggaggatcgcttgagtccaggagttcaaggtttcagtgagctatgattgtgccactgctctccagcccgagtgacagtgagaccctgtctctaaaatatgaaacaaaaggcaaaacttactgtatatccccagagttgtactaagttctgggatatattgagaggaaaaactgatatgaccccttccttttggtacttactgtctggtgggggagactgacatgcactcaaacatctcacagataaatgcaaactcacagatttgagacaagcactagaaaggagggttctatgatgctgtgagagcatatggtagaacgagctgcccttaggaaaattcttgagttgaggttcaactggtgagggggtgggagggagaacatttcaggcacagtaaacagcatatgcaagaggctcgtggaagaagaagagagcagaaggccagtgtagctgaaggccagagaacacaggaagatttgctgcaagatgagaggacagaccactgaaaaatttaaagccctcttagtcctgttaaaactgacggtcttcattctcatagccctgggaagacatttaggtgttttaatgggggttgcagaagtactctcagttttaaagctttagtctcatcaccaaacagcatcagctcagactctgtagctggtacggagagctccgtgtcctgagcccctaggcccatccccaacccaagagtctctgctgatggagttgtgagatgtagtctttgaagaaaagatttttattcattagttttttatttgataagcaattgtttttgtaactggtgctgaccaaaaagtattaatatatatggtttcagttttcccatttggcataaatttcatacttgcctatcaaggttccatgcgtattctcattttcacatcctgataaataatccaggagcagagccggaactctaccttaaataactacaattcataatagtagtgtaaacgcagccctgattcatgaatttattagtggaatgtgactgatcaaattggcaagtgattgttcttcaatataaataatactaaatgaattcttatacctatatgtgcatatatatatatatatatatatatataaactttagtgatagaagcacagcacctcatttaaaactaattttactttgtcaaccagatgagtagaatcataagcagaaatattagatcactgcatttctcaattcagccaaagtcccacatttagccccttgttttgtttttgcgttgctgaggtcatgtatttcctattgttaaatggaggcagtgtcctttatctttctgctttgggtaaaattttaggctctacataatctacaaatgaagccactcccccaagatttaattgcagttccatccattgttcatattggacttgcagctcttctaaatttctcatgagggcctttgcaggttatactgaaatagattttccatcttaattttttatagtagtagagctttcaaatgtcgagaagttgactgtgacaaaaagcagatattgcagcatgcctttctacttacattgaaccaatgggtgggttggaattttctgctaaactctgaccatgttaatgactgcccagccctagctttgtacttctggtactctaaaatacctttcagaaggtgcagtcttgtcttaagcctagttttgagttgagctcatcactaacataactggatatatattcattcatttaacaaatactgagtgtctaccttgtgccaggtatttttccagaacactggggattgagagtgactaaaataggccaggcacggtggctcacgcctgtaatcccagcactttgggaggccaagacgggtggatcatgaggtcaagagatcgagaccatcctggccaacatggtgaaaccctgtctctactaaaaatacaaaaattagctgggtgtggtggcacgcgcctataatcccagccacccagtaggctgaggcaggagaatcgcttgaacctgggaggcggaggttgcagtgagccgagattgcgccactgcactccagcctggcgacagagcaagactccatctcaaaaaaaaaaggtaaataaataaagtatataatttcatttttaaatgctaaaaactattaagaaatatgtcaaatattaacattaattaacactggttgataaatgatttttttctttatatttctcagaattttctaaattttctataatgagagtgtctctgtctctctctctcttttttttttttttttttttttttttggagatggtgtctcactacatcaaccaggctggcctggcctcaaactcctaagctcaaatgatcctcccacctcagcctcccaagtagctgtaactacaggtacccaccaccacacctggcttatgttactcttaaaatnnnnnnnnnnnnnnnnnnnnagtgtatggtgaatatcttccatagattgatgacaagtatgctcctatgtcagttccttgatgaagtcaatggccttgagtgtctgactatttcgcttttaccggctgtatgttactatgtgttgggaacttagtaccgtgtactcggtaatgtggggtcgtagtatgtatttcttatgataggttagagtttgcgagattatttgtgttgcacgagattatgagatattgttatggcttgccacataagtgcgagtttattggttatataggttatgtcgagaacggagtctctgattgttttgcccaggctgtaagtggagtggcgccatctccagctcactgtaacctcctactcccggattcacgccattctcctacctcagcctcctgagtaactgggactagcagcgcccgccaccacgcctggctaattttttgtatttctagtagagatcgggtttcaccatgttagccaggatggtctggatctcctgacctcgtgatccacccgctcggcctcccaaagtgctgggattacaggcgtgagcacacgtgcccggtcattaaaaagtttcctgcaatcacaccattttggtgaaaaatcctacatttgtcatttgttagttgccatctgtagagatgataatgtctatctcacagggctgccgtgttccataaatgttagtgtctttttttctaactctcctctcactgagtacatgtttttacattgttataatcaaacatgtacaatgttttatataacatttcttaaatttcacattatgcttatagttttttttctaaactggtctatcttcacgttgatttgactctctttctattgaatgacttcattaagcattgctattcaacccctatattctgcagggattttataccagttacactttctgcttctttcacagactaaatgatgaacttggtgaaaccgttaatggcctctttgtattcatgacatgtaagctggatcttactgattgatgcttctccttgatttataaattagagcagaaattgttttgggcagaaataggcaaaatgttagcaggtgttttctgagggactacattttttccctagtgtttagctcaggtcatacaatccctcatcctcaatagtttattatccacttcaaatatctatcatttcagactgtacctaacacacatcatccctaatgctttttggcaactcttgttggctcttctgttaacgtagcttcttctttcaagtcgtggatttcattcttctctagagagtcacgttcgtcattcggcactgtattccttggacctgacattcagcctggagttgctgcccactcgatccccacctttaatgactatttcatcactctgggttctggccagttccaaatggctatttcaaccaagtcctttcttaagggaagccaccctgtcaggtactcaatttacaggttcttcttggcttgtggagatctggcctgattgaaacccgatgagagccatcccccaaggaaactctctaatatttaattatttaaagatacatttgatattgctaatgtagagatcttagttccctgaatttagacagagtttgggctacatgacctctctgaagcttagttttattatctgtaaaatggggattgaaatacttgctgtttaagctttcttgccagaatgaagtaagcaatatgaagcacctagtaggcatctgacatatggtggaaccccatccatgctacaaccctttttccccaactattaccctcctctatactgctcttgtcctcaaacataagagatgcagtaataactggtacttggtaaagtaagttatgtatcacattctttttttttttttttttttttctgagatggagtctcactcttgtcgcccaggctggagtgcaatggcgtgatctcggctcactgcaacctccgcctccagggttcaagtgattctcctgcgtcagcctcccgagtagctgggattacaggtgcccgccaccacgcttggctaatttttgtatttttagtagagatggggtttcaccatgttggccaggctagcctcgaactcctgacctcaggtgatccacccatctcagtccccgaaagtgctgggattacaggggtaagccaccgtgcccgggtcacattcttctatataactatattctctttggctttttgaagctcatgtcatatagttttttaattcttcttatgtcattggagcattctcttttctttctttctttttctttttttttttttttgagacggagtctccctctgttgcccaggctggagtgcaatggcgcgatctcggctcactgcaacctccacctcccgggttcaagcagttctcctgcctcagtctcctgagttgctgggattacagctgcatgccattatgcccggctaatttttgtatttttagtagaggtggggtttcaccatgttggtcaggctgttctagaactcctgaccttgtgatccaccttcctcagactcccaaagtgctgggattacaggcgtgagccaccgcacctggccttttggagcattcttttatgaatgtaaataattttgtggttcctgttcaatatctcccatccaaatactaactgggcccaccctgcttagcttccaaggtcagactagatcgggcacgttcagggtgatatgtctgttgactccttccaacttcttagtgttcttacttagctggaatatacttcttgggagccatgatacttctctgtagggtcattagtgattcctaacaaatgttcaggcatctataataatgctgctatttccattcctgtactttattgtctctgctcaccttcacaaggcagaatatgccacctattggatatatgcagctagccttttgggggttgtcttgctttgtagttcagtttgtgatagaacttgagacccggtaacacaaaattctgagattttgtcagtgtaatctttcttttttaacccctgattaagttgagaatgactttctgactcccatttaaactctgtgaatgtaggtcttgggtatttgaagaatttagtatcattcagtctacttgacaactgattagctacagtcttaaccaagacctggcacagagaacttgaagaataaacttggacagaaaacatggagaactcattgttctagaagttcttttcacactaggctttattttcagatttgaagattcagtgttaactttcatggcttatatgaatattcatagactaatccaaaattgaagacttggtacagcagatatttgttttatagaagattgcaactgagtacagcatgtacctttttcatattttatgtgcaaacattagctttatccctacattattatatgctaaaggatgcttctaatcaatcactaagctatttattgagctgttgtctgtgtatctatatgccagagaagattggcagttataaaaacacccacccaaatgtccaacaatgatagactggattaagaaaacgtggcacgtatacaccatggaatactatgcagccataaaaaaatgatgagttcatgtcctttgtagggacagggatgaagctggaaaccatcattctcagcaaactatcgcaaggacaaaaaaccaaacaccgcatgttctcactcataggtgggaattgaacaatgagaacacatggacacaggaaggggaacatcacacaccaggacctgttgtggggtgaggggagggggaagagatagcattaggagatatacctaatgttaaatgaagagttaatgggtgcagcacaccaacatggcacatgtatacatatgtaacaaacctgcacgttgtgcacatgtaccctaaaacttaaaagtataataaaaataaaataaaaacaacaacaacaacaacaacaacaacttttgaaagcaggcagcatggtttgtgggaacattaattattataacaaaatccttctcattgtatagtttatgaaggttttgacatgatggcatcatttgatcctcacagtagtcatctctgtagtacaagtgtggaaattgattcccaaacaagtgaatgggctaactaaaggttataggtaataaatgtcagaactaggatgtgacctctgatcttttatctctaaatccagtgttttgttctgtacaatgtctcatgtacccttcgtgtacacgtaagaaaactaaagaacaaaacaatataatgaagacaataaggaaaataaaagagcatagaaaggagaaagccacatgggctggaatcatcccttgcaagcagcagtaacaatggcttgaggattctagagtttgagacagcaagtctgcaccatatgtagtggcagttgagttttgctgaaagataaaatgctcctttggaaaggtgaggtaggaagccaataatttggtgggattagtgattggatttttctgagatcatccttggctctttatgtaggatgtgcatagcattcattggttcttctccagttctgcaaagccgtgatgattctttgaggattatgtaacaaatgtttgtcagcagctctgctgctactaccacatattttaacttcatcagaattgacagagggggtgtgagattctgaggatctactatacctcaaatgcagttgaggtggtttcatcacactggctggaccaacatctgtctctcattttgccatgcttgcttttctgccaaatatgttcttccatcttctttaatataaaagattatgtgtgaagaatagttgaggagtcgctggagtaatgacacatttggggtaggggataatcctgtgttttcatgtagctgtagtgctagaataagatgctttatccctatctcaagtggtactcactcactgaagcctgtattggtgattaaggaacaaattgaatttggatagccttagagaaataattggctatgttgacatactcatctcattgaaagtacaggaagtaatacaggtaaattactgctccgggacaaattctagccaaccccaagcagctgctacatgaaatgtaagtgagcacaggctggggagaacatgactgggtgacatcagccactgaataccctctgtacatggtgggctgtgcccaccagggaggggcttgagacagtctggtatgttcccaggatattaggaagggaaattttaaattttaaaaggttcttcacccagatgaattacaccccaaggcaacgagacaatgagccaggtgggattactggccagctgggagtcatctctgtgaaattgtggagaattgatagttaccagaggatacggagagagtaatgttctcatttccccgcaaaaagaaaagaagttggaggccaggtgcggtggctcacgcctgtaatctcagcactttgggaggccgaggcgggcagatcacaaggtcaggagatcgagaccatcctggctaacacagtgaaaccccgtctctattaaaaatacaaaaaattagccaggtgtgctggcaggcacctgtagtcccagctactcaggaggctgaggcaggagaatcgcttgaacccaggaagcagaagttgcagtgagccgagatcgcaccactgcactccagcctgggtgacagagcgagactctgtctcaaaaaaaaaaaaaaaagaaaaaagaaaagaaggtggagttctgggaattactgaccactgagcttcatgttaatcttgacaaagaactgtagaatgcatgattcaaatgatgagatgaaacattttaaaaaggaagtgatgattataagaaccagtcaggattcgttaaggataaatcatgctagactgtcctgactgcctttcctgatacagtgattagatgagtagaccaggaaattctgtgggcatggcacatctagttttcaacaatgtacttgttagagtctctctgggcactgtagatgagaaggatcaatttggattgggtgataggattgtaagatggatgcatacatctttgaactatctgcctaccaagtctgacctgatacctcggcaagtttcttaccctgggaggtttaattaattcattgagtggcaaatgccaaattgttatgtctcaaaagcccattggtaaattgtttgagatttagaatccatttttcttttctttctttttttattttttaaagtgtcaaggtcttgtccaggctggagtacaacagcatgatcacagctcactgcagtctctaactcctgggctccagtgattctcctgcctcagcctcccaagtagctgggactacaggcacgcaccaccacactcagctaatttaaaaaaaaattttgtgtgtggagacaggggcttgctgtggtggccagactggtctcaaactcttgtcctcaagcagccctcccacctcagcctcctgagtttctaggattatagacaagagccaccacacctggctagaaccaattttttttatcaacactgttttttattatatttcctaacagataaaacgcaaaggcctgttgaactcattatgtatatgcactggaagaatttgggtaatatgaacattctgtaagaccatatcttagagtaagacaaattttgagctctaccatgaaaaccagaggcataatcatctccctctgcttcagggaaaaggcaaccatggggtggatggtggggtgggtaggcaccacctgcttccttcataacccattttgtgttgctgtaacggaacaccttgagactaggtcatttatgaagaagagaggtttattgatttagctcatggttctggagactggcaaattcaagatcagatggccacttctggtgagagccttgtgctgcgtcttaatatgctggagaagtggcaggtgaagcaagtgcatgcaaagagagcaaaacacagaggcaacctcactttataacaatccactctcttgggaacaatttcattcccacgagaactaacccagtctcgagagaaagacattcatctatcttaatgaactaatcacctcttaaaagcacgacttccctatgctgccaccttgacaaccaagcctcaacatgagttttagcagggacaaaccattttcaaagcatagcacttcttatggcattgatgggagatcttcccaagggttggaagctagaactgtgggggccaagccttctgctatcattaccacccagggccccacaagtttgtgtccttgactaaactgaagaacactgaaagtcatggaaggtttttaaagtagaggagccaacaccatttatcagatttgtattttagaaaaaagtttattctgtctgcaagctggataatggattagagaagccaagtcttagacaaacaaattaaaagactgtggcagtaactcgggtgagaaagaatgaaagtaggtgatttgagagatatttgaagggcagattggtatgcctgggcaataacaatgtgaggaaagagggagagtaaaaataaggactcaggtttctgacttgggcatttgagtagataatggtactagatattggtgtgaaaaataacataaagaaaagacagaggaggggtcagttttggccataaagactcagaggtacctgggggacatcaaggagatgtccagtagacttaccagctggatgcatgcttctacagtttaggagagaaatctgggccaacgatataatgctgaattaattttacaccatttgcatccaccaagtgtttttacgtgtggttcctctctggagaccttccttctttgtagagattctttagtgatattttactgtcttgctattttctcaggagcatagtctcattaaggcaatgtactttcagttcaaactgttctatctacggtgattggcttgacagaattctggttccatgcaattatgtctataataagtaaagaaagaataaacacatcaggctaccctagatatttcaaggcattctgcttcatcattaatcatgagtagcctagaaaaatagaagttttataagtatctcctaaatggtaatctgcagtgtctgttaatttactttacctagagaaagtatggtcttagaaattgattttgctgttatattctacagccttataaatcactttccctggtgcatgaataattaaagagagcaatccatacatttctgagcttgttaacatttttgaaacaaaaccagatactaaacatgacattttcctgttgctgtctggaatttctatgcctggtgtctaggctcattcccattatttactttggctccaatgcttggcttcttctttcaagttgtttgccttcagtgtttacagaagtggattcccacaaccaaggaaagggtggttaatgagtcagtctggaagtgctatttttgttatcgtggactagagtcagctcaccataattagtgatattttgtgaaagcaacgcagagcacctaggcagtgccatttccttggctcttctcagtatgtgcagggaacacacccgtgtgcacactcacagatacgtgtttgccacattttagtacaactccgtttctgcattccactgtaagaaagaatacagtcttaatacagtgcaaatgcatgcaatctagactctgggtttgtattgtcagtgtgcttgtgactgccttaagagggtagaaagctttgctgctttcgtggtgtagtgagcattgaaaagtgaaacagatgctgtcacgtgtcttttcctccttgtttgcctggcttaggcttaagatgctttgattatgttatagacccctataagattaagcctaattgtgttattgtatgtgtagttttagcattttgtgatttaagtttttcctctttaagttcttgcttattgatacctcactagtgtctgtcactgtgacatacggtggacctacccagggccattcaaatggagcacagaacttacatgtttatttatttttgaaaaatagtaatatgtagtagggacttaatattttttaatgaagtagattttagatgattattttcaatataaatgctgtgttagcaaataataaaaacaaacatcaattcatacattctctctttctttaactgtttctatcactagatttaactttgcctgtgacagaaacttacagtcaggttaaaaggataggcttgggttcacatctcagaaccaccattttctatgtggcgttgggctggttattgaacttctctaagcttcagttccttcctccataaaatggttggcccataaggattttgttcggattaaatgagatgatgtatgtaaagcttttaatgcccacatgtagcaagtgcttgataaagattaggtgctattattattatctacctcttcagcgtgtgccctaccttcaaactgcccagtaggcttgtgtttgtcccttagattacttggtttttatcatatggattcactgccattttagagctttttattggactctttttcacctttctgttaaaacttctctgtgatttctctgggtcatgagtcatatcttttgcttttgtgaactctcccatcctattgaattcatcaatttccaaaatagacctcaacccatctttggttctttggaaaatgctttcttgtagagatgttgcactaaatctcccgtctcttccttcctcccccctacaacaagccatctttacttcttgaatttattcacagagcatatttggttccgagttactttcagaaggtaagttaaagtatagaaccgtcatccatttagctcacgacaagctgctttttctcctttgggctaatttgaaagtttatctttaagaatctgcctggtcttctgaaggtctactgtttccatttctaaccaaatttaactttatccatgttttctttttcttctttttttgttctttccattacgcaacattcttcaagatgtggacgagtgcctggaaccaaacgtctgcgcaaatggtgattgttccaaccttgaaggctcctacatgtgttcatgccacaaaggctatacccggactccggaccacaagcactgtagaggtaaatactgtgatcaagtttcccatttttatttaaacttcatttaaatatagattagagcaattagccttagaaaagggaaccctgctacctgtgtttattttgaccgagcgacttagagcacatattggttggcttggctgaaagtggctccttgctgtggttaaatacagagcatatctatttacataaagggaaacgatgtatttttagagagtgtctgtgagccacagatcggttcatctaaatttttttttctcattataaaagcaatacacacagttgcacaactctgtgaatatattaaaaaccattgaattgtacattttaaatggaattgtatagcatgggaattatttctgaataaaattgatatgaaagtaaccaatatacactcattttagaaaatttagcaaatagagaaaaaagaaaagtaacaatcttacataatgtcattaatgaatattcatatttcgtggatattgtatataaagatgttctatgtataattttatatcttgctttttgccatttaatagtatacctaccataagtgttttacattccattcataactttttttcaaacgttatttttagaggctgcacaatattctagtatattcctatatcacagttttcttgctcttctttaggtattgaacaaacaaaaaattttcagcttctcattagtgaacaaaactggtacaggtcttttttttttttttttttttttttttttgagctgaagtctcactgtgttgcccaggctagagtgcagtggcatgatcttggctcattgcaacctccaccctccaagttcaagtgattctcctgcctcagcctcccgagtagctgggattacaggcacacgccaccacgcccgactaatttttgtttgtttgtttgtttctttgttttgggtgtttttttgaggtggagtcttgctctctcccccaggctggagtgctgtggcatgatcttgactcactgcaacccctgcctcctgggttctagcgaatctcctgcctcagcctcctgagtagctgggattacaggtgcctcccaccatgcccagctaatttttatatttttagtagagacagggtttcaccatgttgggtaggctggtcttgaatgcctgacctcgggtgatctgcccacctaggcctcccaaattgctgagattacaggcgtgagccaccacacctggctaggtctcttttaaaaataaacttttgtctgaactttagaattatttccttattcataaaagtggaattattgggtaaaattttttttttttttttttttggagacagagtcttgctctgtcgcccaggctagagtgcagtagtacgatcttggctcactgcaacctccgcctcccaggttcaagcgattctcctgcctcagccgcctgagtagctgggactacaggcacccgccatcatgcccagctaatttttgtatttttagtaaagacgaggtttcaccatattggtcaggctggtctcgaactcctgaccttttgatccacctgcctcagcctcccaaagtgctgggattacaggcatgagccaccacgcctggcaaaaatgttctgaatttttttactatttggttttttttttaattggcatgtaataattgtccatattgtacatatttatggggcacacagtgatgttttgatacatatattgtatcatggtctttttactatttttacaggagaacattctcatttcatatatatatttattttaattctgaaaaggcttaatttttttatatgttcattccctttagcgattctctgaacacttctaatttttaaacatttattttatatacttaacatttatatttgtttttaaaatttccattaatatcatttctcatttatccggctttttatttgtttaatcaatgtatacgaactctttatatatgtaatacatatataaacgtatgtacatgtggccggacacagcactttgggaggcccaaggcagatggatcacctgaagtcaggagttcgagaccagcttggccaacatggtgaaaccctgtctctactaaaaatacaaaaattagccgggcttggtggcatgcgcatgtaatcccagctacttaggaggctgagacacaagaatcacttgaacccgagaagcagaggttgcagtgaactgagatcgtgccactgcacaccagcctgagtgacagagcaagactcaaaatagagtctcaatgatgataataataataataataataaatatgtgtacattacgtatacatttttggtggtacactgttgtaatttctccaaggcttccctaattttcctttttatgattttttaaaaattttttcttatggccaaatctgtggatttttttcttttctgcttacttttacatctaaaagtatgttctagcaaagggtaaaagaggaaataagtaaacattttcttcttaagtgtcttgatgtaagtgaaggatgtagggtgataattaatttctcactatggtaggcaagtagtaaatgaataccctggtatcctgtaagaatcgaggcctcttccactggcagtagggaacatgcaggcatctggatttgatgccttgctccaataatacaacagagcaacagtggatcttggccactcctagtggaacatctaacgtgggcacacctccatttctcctggtcccttctcttttggctcacatccacagtttcctactgattccttaagccaggtatctcctcagaccaaattaaatatgagaagcatctgaaaggtattatttcttcccccatacactggatcaatggtggatgaggatctcaagccttaggagtcatggttaatctttgattgctatatctagtttattttcatatcctgccattttatcttctttcatcctaatctgcctaatttttttcatctgcttgttgataaaaactcttgtaatctgtcctcctctttcatagtccaaacttacttgtcacagttgcattcttcagctagcattctctgacctatccaaatcaatgtcacaactgccctgtgaagattcttcacagggcagtacttggacccaagtacttgttcaagattatcctgcctttcatattcatcttcttcctcactgcttacctgatgtggctcttccagtggttcatggtatgaccttgggtgaataatctcaggtttccagacattgtgtcatccctaaaattaggggatcagactctctaatgggatgctcaaagtagcacatgttgaatgaatggctcattaccactgtcttgctcttggctgttgccatcccagctgagcctgggaaagattggttggggagacaagacaactaacagcaatctaatatccaagattataatatatatataatgtctaaagtctagtatttagttttgtttttttaaaaaaaggcagcatatcggatgctagtcctgatgcgtagaagctgtgtgagcttggataagttacggtatcttacttcactaagccttacttttctcatctgcaaataaaagggagcaataatggtacctgctagagttgatatgaggattgcaggaaataatacagggacagagatcatgtagagagaatgagttaatgcaggggcagagcatgacatggtggtggtggtgtttgctaaattagaggcataaacaaagtttcgttaaagccaagaagtgtgtggctaactctgcttgtgtgcgtctgggaaagcttcacaaaggtattgctatttgaacttagtcttgaagtactgaatacaaaggggagtaaaacttggcaggcagaggaaacagcatatgccaaagcttagaggtgagaaagggctattacttccacttggcatttaaccttgacctctactccgattctaatggcgtcttcccattacagcctgggatgcattacctcattcttcccacatgatctctgtccctgtattatttcatgcaatcctcatatcagctctagtaggaagcattattgttcccttttttttgcagatgagaaagctcacacagcttctacacgtcagagctaggatctaatatactgctttatttatttatttatttatttatttatttatttatttattgagatggagtctcgctctgtcgcccaggctggagtgcagtggtgcgatctcggcgcactgcaacctctgcctcccaggttcaagtgattcttctgcctcagcctcctgggcagctgggactacaggcacgtgccatcacacctggctaatttttgtatttttagtagagatggggtttcaccatgttagccagaatggtctcctgaccttgtgatccgcccacctcggcctcccaaagtgctggtattacaagcatcagccattacacccggccctgccttttcaaaacaaaacaaaacaaaacaaaaacaaaaaactaaacactagactttatttggatttcacaagtttttccagtcacgtcctctttctgttccaggatccaatccaggatactacactgcatttagttgtctagtctccccaatgaatctttccctagttttcatgatcttatctatcttaaagagtataggccagaatcctgtagcttttccccactctggatccatctgatgtttttctcatgattaaactggggtcatgggtttttgggaagaagaacacagaggtgaaaggctctggtcctcacataatgtcaggtgtacattcacatgtcgggggtgtgtgatattcttggcacaaaagaaagaagacatttgtccagcattcctattttattagaaagctttcttttggctcagaaatgctatccctcattagaaaagaaaaatatttttatccctagaattaatctatctttgttcccttggtcattttaaagacccaaagatcaccttgtgcaagataactgtgttgcctcaagttattccaagtgtatgtgtcattacttgtcatgaattactcctgacattcttagcaacataaatgagtcagttacgtaagatgtctggcatagcctgatagtccttggaatggagggtctatctctgttgcagacatcttcacatgggaatgcttaatttgttgtcttctatgagaaagtcaaaaagattccaaagcactaaaaatgttgtcagatgttatgtgagatccagccagctacaagaactattgttggtcttcagttcgtgaactgacatctcaagtattttatagaatgtgctaaaagaaaatagtgacgtaggctgatctttgctggcaaccattcctaaagctaagagacttacagtgtttgaaaggtataaaataatctttaaaatgaaagttaccttgtttattttctctatggacagacaatattggcagccaggaattatttataaatcaaagagaccaagaacacaattggtaaaacaaaagtttttaatcaactaaagtaattgctatgaaatattaaataaaataagaaacaaatttttgaactccaattacattaatactttgagctatttcaggaaactatgtcagtatttcagtagcaatttcaactatttcagggagggataacctgatactttgcttatatctggatacattttaaaagttaatgccccattagaggttaagaaatgaaactttgcggctaggtgtggtggctaacgcctgtaatcctagcactttgggagaacgaggcaggcggatcatgaggtcaagagatcaagaccatcctggccaacatggtgaaactccctctctactaaaaatacaaaaatgagctgggcgggaggctgaggcaggagaatcgcttgaacccgggagacggaggttgcagtgagccgagatagcgccactgcactccagcttggcgacagagcgagactctgtctcaaaaaaaaaaaaaaaagaagtttggctcaggagaaacaggtaattgtcaataatacttgagtgaaaggcctatacagttaattgagttttcctggcagacacttttagatgcattttaaataagaaaatttgaagaaaaccacagtcatacattgatctataggacatggtttttaaaaaacaaatccctctattttatttattactccctttagattagggctcctttctcctcctgtgagtatagggctaaagtgttttatatctattcccttcggtaatcttcacaacaaacctgtcatgtaggtgatgaagatcagttgtacctaccatgttttaataatcataaactcttataagttggctagccattcagcagaacattctgaggctgtatttgcactgacaaggcaagacagaattatctgcttaggtcggaccaatataatggccaaacaaaaacatctggaagactctactcttaccagacgtgttcaagttattgatgaagccagtcctttgcttcagttgtataacttcgtatacatgacattttctaggacacttattaagaattatcttctttctcagttagtgattttatcttgtcaaagcatgtttaaaaatcctcacttatcactttctcctttggtattcagcagtcatcataatactaccatttctcttggctttccttgttactttgaaaatgagccagagttctttatacaactgtttggccttatagttcaacttctagacaaagtagaattatctgtttccttccataactgcctatgtttttggttttgtttttcaaattcctagtcgagttttccttctgacttctttcatgcaactaaacaggtctgcaaactatctgagcgacattatattgcatcaggttctgccttctgtttgcagctctaaaatatttcatgttgtattccaagacactgatggtgaggagtatgattattataaatagcttattgatttattgtctatttttagttatttctattctatagatcagtatactgaggttgatacaacagcatgggtggagtgataaatactaaagtgtgtagtgccagacataagaagtactattatttttgttacactaatcccagaatgcattgcagggagcactgcattctcctgggtagtctctttttcagaaaaattgccgttgttgtgtttgcagatattgatgaatgtcagcaagggaatctatgtgtaaacgggcagtgcaaaaataccgagggctccttcaggtgcacctgtggacaggggtaccagctgtcggcagctaaagaccagtgtgaaggtaagagggtagtaacatgaactactgaaacttcagcttaaagcacctggtctgaaaaaggtacgctcaatcaagtgagtttaccttttaaaaattacccagataattgcattatagtgccagaaagccaggacttaaacataagttaggaaagtcaataaaacaagattgaagacagttaaatttgaaaacctatggcattagctatcaatggctaggcattagtattaagaagaaaaattattgctttctgtgtaattctttactacagaaggtaatttccatttaaacatgtaaattaatttaaagtttttatatacttggatttcagcaattagaaagtcattatatcgggctgctttatgctgtggaatgttaataaccttaatttttgtatttaacgttgaaaaattttgtcttttaaaaaaatcgctaaagaagatttctcaataaaactgtaataatgtcccccttagagagaaagtttgcaaaatatgttctgttcctacagctgatagtgaggattctggatttgctagggttgaccttagactttttaaagaaacatttcattgaattgcacacagaaatacttcacttcccaataagtatgtgcttcctgaacttgaagatattatgatctcacctgtgtcaaccacaagtgtccagagttcttgagaggaaacgccatttcttatttaagaacagaatccacactgtataaggccattgtttcataaataaacaatatccacgtcttcatgtatactctgaatatttgagaagcaaaaaagtctcctgagatagtattacaaaagcgacaatacatgatggtcattacttgtatcaacattgtctttctagaatttacactgatccaattgagactgattgaaaatgtttttgaagcaccacttccacagtttctttgtattctcttgctcatagacattgatgaatgccagcaccgtcatctctgtgctcatgggcagtgcaggaacactgagggctcttttcaatgtgtgtgtgaccagggttacagagcatctgggcttggagaccactgtgaaggtaagaattgctcctgatttcagaatcataaaatgcccagatcggagggaaatctgggcatcatctcagccttgatctttgaacctcatctcttgatttcatagtgaagacattaggtccctgcaaagtgtcttccccggggtcacacaaataattcaaagaagggagtagagtccagattatctttgcactgcttggagctgtcttttagacttgtgccagccaaaggcataaaagaatcagtttaactttaccagctatagatggtttatcctgggtacatagttctgaactgtaacaccttatttatgcagaaccaacttctaaatgttccaaataagtaaatacaacttaattttccaggcaattagaaggtttttcagagccaaacatcaattcagtttttggctttttgcataaaatatttctgaaagatatcccacatgtccagtatcgtgcagtcatcaaccactttcactacttgtttggctaagaagctctctgcagtggttgggtgactgaaccaggcctgcttatggagcggggaatatcttctcccagtgggcttctttttcacttttaccaccggtctgtcacttgtgacctttctctgcattcattgtccacctaagtaacaagctttttcccagcccacctgaggtttcactgcatttagagcctgtcagttgtgaaaccagaaatatgcatgttggcagggttgtgtctcccatgcagggtccaagtttttgaaggagggtctgaaccccacctttgagagaagtggatgagccttttggtgaatggtttcatgacacacacatttcagcagccccagatcctttttcactaccagtccagtggattgggaaagatctattgtcatttacagcatctacatttctgaccagagaacttggcagaagcagtcacaagtggctgagccccatatcctcctgctgctgggagtgtaaatgacccaaccctcgggaaggcaattttggcagcgttttaaaggccttaaagtgtatactgttaatgaatcagtaaatcaacttctaagattttatcctaaggtgatcatgttcctcaaagagttaataacaccagtgaaaagttgtaatcaatatacctattgaggccagatgtggtggctcatgcctgtaattccagcactttgggaggccgaggcaggtggatcacctgaggtcaggaggtcaagaccagcctggccaacatgctgaaaccccgtctctactaaaaaaatacaaatattagctgggcgtggtggcgcccagctaatatttttacacacacacacacacacacacacacacacacaaacacacacaaacacacgcacacacacccctattgagaaataggtcagataagtgataatataagataggactatgtatgaaaaagttgtgttttaggaactctctaatatatgggtaaatgataatgattctagatagtgacatcccaaggtgggagggttggtggtgttggagggagacatttatggaagaatctattctagaactaagtaactggtaaggtatattctagggcagtggtccccaacttttttggcacacagggaccagtttcgtggaagccagtttttccctggatggggttgaggggatggtttcaggatgaaactgtcccacctcagatcatcaggcattagttagattttcttttttttttttttttgagacggaatctcgctctgtcacccaggctgagggcagtggcacgatctcagctcactgcaagcttcgcctcccaggttcacaccattctcctgcctcagcctcccgagtagctgggactacaagcacctgccaccatgcccggctaatttttttgtatttttaatagagacgggttttcaccgtgttaacctggatggtcttgatctcctgacctcgtgatccgcccatctcggcctcccaaagtgctgggattacaggcgtgagccaccgcacctggcctgcattggttagattctcataaggagcgtgcaacctagatccctcacatgcgctgttcacaagagggttcgccctcctatgagaatcgaatccagctgctgatctgtcaggagatggagctcaggcggtaatgctcgctccctgctgctcacctcctgcagtgccgcccggttcctaacaggccacggacccgtaccggtccatggcccagggattgaggacccctgtgctagggcactaaaaatgtaaactgaccatcagcatctcctctgtcctgattcctggccaagccaagaaggaactgcaccattgattaagtcttgggtaactgatgttcattggagggcatgttcctcgctttgtctcttttaatgtgtaagcattttaacagaagtctaaggtttttattccaaaaacatccattgcatgaaaagtcaaacaaaagcttttagcaaactcgttcttcattattaatgtatataagatatgactatgttccgtaagaaagcttcttttggaatatataatcaggcccttttaaagtcaggactagtttctctagtgtactgggttataaataggactggagtccatccaactaatttagagctccctttgaaactatgttagcacctcagcctgctaattcccaactagcaatgtttccgaccctccccagtgatatttagccataattaactaaaccgtgactgttcacacgcctctgacagctgtgcaaggaagagccatctttcttgttggcttttatgtttacacgtgtaattttcccctaatggttctggcaaagaccttgttttcttattgtcctgtcatcctgctggcctcctcgtagagtcagactcccaagtgttgtgcctgcttctgtgcgctactgactccagcatgcttggtagctagtcattctgtgataatgaacgtgcctcaattgtcctcattcttaggagtctggagcatctcagctttcaaaggctctgcctgtgacttgttccctccaagcacagtctttaatctcgtgtctaccttaacctttccccaatccctcactaaggttgctccctgcagtcctttacaaagctgagaagatgactcattacttacaatgtctttccctttccctctgtgccctttgctcttggtcatttatttgtggacaaaattttaaaaaggtggaaaggtgggatagtatttctttccaaatcagagtcattcatacattcacttatgtatttgttcaaatatttatttagtgtggagcttgtgccagacactgttctaggcatagggcaataaaccaaacagaaatttcttcccttttgtagcttacattgtagtgtgggagataacgaaaaaatacaataaatggctgggtgcagtggctcacgcctataatcccagcactttgggagttccgaggcaggtggatcacgaggtcaggagatcgagaccatcttagccaacatggtgaaacctcatctctactaaaaatacaaaaaaaaaagaaaaattatctgggtgtggcggcgtgtgcctgtagtcccaactactcaggaggctgaggcagaaaaatcactcgaacccaggaggcagaggttgcaacgagccaagatcacgccattgcactccagcctgggcaacagagcaagactatgtctcaaaatatatatatatgataaataagtaaaatatatagttcgttaaatggcaataaattttacagagaaaatagagcggggtatatggggagtgttgaggaagggtggtgattttaaataaagaggcaagtagaggcctcgctgggatgataacacttaatcatttatgggtagagcattcagttcaagggaatagcagatgcggatgcccgaggaaccagctatgtggagacctgaggggcaccacgtcagcactttccacttttgatgcccaagatgaatatttgaaggaagatatctgaaaggcaattgtatctatgcatttggaatttaggggtgagttctaggccatgaaattaattgggaatgagtgtagctagaagagagataaatcccgggccctccaacatttagaagtgaggaaatgggtaagaaccagcaaaggagattgaggaaaaagtggcaagtgaagaaggagaaaacccagaatccaagagaagaaagtgtttcaaggaggagggagtgatggattgtgtcaaatgttattgctaggtaacagaagaaccaaaagttaaccatgggatttttagcaagctggaagtagttggtgacctcaacaagctcagtcttggtagaaagatgacagtgattcactgttcctgcccttaaaaccttttactctacttctaggaaaaatatatattttcgcactaccccaggtggtggtacgaaatagtaccatgttgtgctctcgtaatgttcaaccttcttattgctttgaagacagataaaggccttgcaaaaaaaaatttaaactaaacctaaccctaacatatgctcagctttctaatgtatataattatttataaacactttaaataatgctcttttccctcacattcattatttgtcttagattttggaaaataaatgagaatcaaattgctttaaagtagcatgaacagagccgggcatggtggctcacgcctgtaatcccagcactttgggaggccgaggcgggtgaatcacttgaggtcaggagttcgagaccagcctggccaacatggtaaaaccccatctctactaaaaatacaaaaattagccggccgtggtggcaggcgcctgtaatcccagctactggggaggctgaggcaggagaatcgcttgaacctgggtggcaatagttgcagtgagtcaagatcacgccactgtactccggcctgggtgatagagcaaaactcagtctcaaaaaaaaaaaccaaaaaccagcatgaacagagcaacatgcttccattatgctgaggcaaacatctaggttatgaagtgttttttcttgtagaaattcatattcccaggattctcttatgatcttttttgaattgagttttttatttaatgtcactgatcaaatatgcttctcctcgcttcattatctccatttcctacaaagcaaagaaagaaaggttaatggaaaaactgattgtcagtcgggtgcagtggctcacacctgtaatcccagcactttgggaggccgaggcgggtggatcacaaggtcaagggatcgagaccgtcttggccaacatggtgaaaccccgtctctactaaaaatacaaaaatcagttgggcgtggtggtgggcgcctgtagtcccagctacttgggaggctgaggcaggagaattgcttgaacccgggaggcggaggttgcagtgagccgagatacaccgctgcactccagcctggcaacagagcgagactccatctcaaaaacaaaacaaaacataactgattgtctactttacacccattaaaatagttgtagagctgtcagagtaaatgtggaacaatcggagttctcatatgtttcctgtgggaatgtaattgctacagccacttcagataacagttgttcaaaacttaaatataacctaattccatgacccatgcatcgttttcctgggtatttactcaaaaaaggtaaaatcatatgttcacacaaagacttatgattttagaaatatttatagaaaccttattcacaatggcccagatggaaacaacccaaaatgcttatcaaaaggtgaatgagtaaacaaattatggtgcattcatccaatggaattctacccagcaataaagcccagagaactactgatacacacagcaacttgggtgaatctcaaaactattatgccgagaggaagaagccccaaagcacaaaaggagtgagagggaatgtattggggatggaaatgcctgttccttgactgggatggtggtcacaaggatgtgtatacatttgtcaaaactcattgagctgactcttaagtagatcaatttattttatgtacattatacttcagtaaagctagaaaaacacattaaagaaaaagttgagaacctgccttagttgagacaaattcacatcacctatgttttatgttttagggtcagtacccggaagcattttaattctgggtgaacagtcattataataacgtggttttatttgatagaaagaagtgataaggcactctcttatttctcttttgtttgccctgtgaatagtacagaagcctgttaattggttgattggattctaggagaaaaatgaaattcggtatcaccgtacttgaaccagacagccgggcgtattagacagatggcaacagtctccatattcacttcttcctggaatctctcatattttggcagcaattacaattatttgcaagaaatgccataaaatgccaagttctgagaaaacaaagaaggttttgtttcttagctttcttcgttgctaataacttaaatcctcacattcacaacagaagagggctcatggagtacattaggaataatgtgctttgactaggggtaaacatggtaatcagcagcccttgagaaagatctgctcgcattcatgcggtgaaggggagccattaattgtctttcattctcacagtcaaaactcgttattggttatgtataccacttttagttgcgcatttgctatgaatttttttaaacatttttaaacattttttaaaatccaggctacctcaaacctgtttgttacagctgctgaataagtgacttaaactaggtttttgatcttgctgttctccttctgttcaaaagtccctcttcttccgactcccccatattctaccctactgtgaaatttactataagtaaatttacagatatgcttctgttacacaaaagttttattttaaactttatgatattctttgtctaaatgcatatgacccctaaagttgatgctactactttgtcagataattatattttgtgacaattcttatgttacattggtttggacttataaaacaatgtaatattttatgtttaataatacaatatcatttgtttattttattgttaataatacgatatagtttgtttctttgaacaaacatttctcttggggacaaagaccatgctgaaaacttttaaatttttttctataatgcataatacagaagcttgtataaatagatcaagtgttgctcaagatacacttaataagtatttttgaaatattttaagtctttatcatcaccaacaatataatcaagtaaattattatttgctacagaattttgacttttcctcttccatttaatttcatttgatgtttaaaagttccatttcttggccaggtgtggtggctcatgtctgtaatctcaacactttgggaggctgaggtgggcggatcacttgaggtccggagttgaagaccagactggccaacatggtgaaaccccatctctactaaaaatacaaaaattagttgggcgtggtggtgggcgcctataatcccaactactcgggaggctgaggcatgagaatcacttgaacctgggaggcagaggttgcagtgagccaagatagcgccactgcactccagcatgggtgatggcaagactccgtctcaaaaaaaaaaaaaaaaagttaaaaagttgtcatgtatttaaaattatgtattataaatgatgtaaaatagtgtacctttacatgtaagagaaatgtctaattttccgatatgtgatttatttagtctttaaaaatttttaaattggtttttagatatcaatgaatgcttggaggacaagagtgtttgccagagaggagactgcattaatactgcagggtcctatgattgtacttgtccggatggatttcagctagatgacaataaaacatgtcaaggtatttcttgctcttttttccccagtcattatttacgtaattcttcaattctgccatgttgccagatgatagtctgtggttttgccatgtgatttatatgtaaataatttatgtcaatttttgatattaaaatagctgtcttgggtccacatcaagtgcaggaaggtgttgctttgtccagcatagtgtcaactgaaactcacacgagtaagagctgtgtcctcactgcgtgcttccgtcacctgtactttactgtttattccatgctgtaaccttggtactgggttctaaattatctttatagcatcttttatgggcatattttattttgtctcataggtggtatttatctgtccttttctgactctatttttatccagtgcccgccattgctttttttttttttttgagacagagtctcgctcttgtcacccaggttggagtgcagtggtatgatctcggctcactgcaacctccacctcccaggttcaagcgattctcctgcctcagcttcctgagtagctgggattacaggcgcctgccaccacacccggcaaatttttgtatttttactggagacgggggtttcaccaccttggccaggctggtgttgaacacctgacctcgtgatccacccgctttggcctccaaaatgctgggattacaggcatgagccactgcacctggctcaccattgctttttctcttcctaaaaagcctcactaataatttggtcaaaatcatgaagaagaggatcttatattttttcaatgtgctgtcatgtttaatcttccaaactgtacagtgcatgaagggtactaatgaaaacacagcaacacaacacaggtactaataataacaatcacagcagctgtaactgagcttcttcagtgtgctgagtactgtaggtatcttggtatctcttcgaattcttacagcaacttcagaggtagcttttcttgtattcattttgtgcatgagtaactgaggctccgagaagttagggagtatgctgctctctaatgagtggtaaagttgagatttgaacccagggtcttttcccactactcttccctacattgccataccaattattgttacatttatagccaaaagaaagaagaaagtgaaattaagtgatttctctcacaaggtagcccattgagtcatttcaacaccatagctaaaaaaattaaattctctaggttctgtatcccaacatttttagctatacctgacttgccccacaagctttcctctatttactagtgttagtaaacccatgtttatattttccatggaaaattcacacttattttacctttatatctgtttatttttgatacccaataaatgttatttttttcttattgtttatctaccattatggaactgtgtagtgtatcccaaagcataaataaataaaaaaaattgttggagttactttttacccactattactgaatatgtatgatttttttaaaattctggattgccataagttatatctcatctcacatgtcccaaataacagtcttcttgtaggagaagatggtatctactctctaagatagtggcactggaattatatatctatattaccggtcacacccagccatgtgtcagagatatgaaaaacacggacctttgccacaaggtttttaaaaattaattcctttactgatccaaagatttaaatatacaccttcctgcacttgatgtgtacccaagacagatattttaaaaatcccaagatttaaatataccatgtacctcatttgagatcatgtatttatttgccatcctcatgcaataaggtgaaattcaattttttccaatgcagaaattaaatgtgcttggacttaatgcaaaagagaaggaatatttgaattataaatatatgtgagaatatttccactttgggactattaccttttaacaaaatgaatcttgatttatataaaaataccaagagatggaaaaaaaaaaaaaaaggaaaccaaaccctgactcttgtttttattataggctttttggcttaaaagtatattttcttttctaattcttctcgtcacaatttgttttggccaaatacaggcaaaaccaaatcttaataaaaatggaccaagatttcatattgcataaatttaacttctagagttcagtcacacggaactaatttagttatctgattcattaattgcactacttcattctctcaatatattaaatttgtgtctgtggtttgatatcacctctcaaatatgtgactactccaaacatagagagttttattgactatcaatcattattaaattgacttcgttctctgtcacatatattcctattttccagaataagttaatatgtctgaaaaatgtaaatccaaataaatgagaagcatttctgaagtaggtcttagtactgtttaaagaatagtgtctgtgaatctgttttatcacccaccacctcctgttagaagctgtatatgatggcatgtatatactcacctcgttttgaattatcccttttcgctctttcactagaggcagttttgtgatctttcactctgcctgaagttagtagcctacttttctctaatcccttgatcatgtcagcattctgtggagaggtgtagatttcagagtttgtttaaattctgaaaatgtaattgatggcaatgctaataaccatggacatgtttgaataacagtgtgtgataggcataaactttaaaccttacctaatgttctgaaaatacttctatattcagtaaggcattttcagttggaagcgtgtttaagattttctttcccatacaaaactaatgatgatatacagacagtatggaaattccatgttaatagtctctttagaaatgtggcaggatacatttgagattcagaatgcagttcagtttcatgttttgatttacgcatgccaaattatgaatttctgtggaatcgcggacccatgaaagaaacccaacttaaatatagtctggctttcagcttgaagttactagcagcatagtttagaaatgcctcaataagtacaatccaaattgaatgcatatgtttccctagttccaaatattcatgttgttctttcttagcagtttcctggaaaaaaaaaaagtctaggaattcatcttcagttcccgtcatcaaactttttagacaattatttgtgttaatcagtgacttttttgatgaaaaaactttgtgcacattattccctatgcaaagttgcaaagcaggtagtttttaaagggccacactgaggcataggataaaataagaagaggggtctcaggtagctattagggcttaataagatggatataggtcctgagcttgatccccaagccagtggaacttcatgccaccttcttcctcagatagaggtaattcttgggcagcaggttggaaataaagagtggatctgaggaccaaaaggaggtcaaacttcaaaaaggatggccaatctaagatattaccaataggtagagaacaaacatagacaatgtcagagattttatcaaagaagtaaagaatttcacagagtaaaatcatattgagaaatacataagtagaaaatgattcattgaccttccttgaaatatctaaaaactagtgacagtaacaagaataggagaattgttaagaaagtatgagtaattcctgttgggtttcttatttttattcagcgatggacaggccaaataatctgaattatgttgcagatggaaggctaaagagttcaagattaataaaggaagacgtttaaaccaataattgccagaatttctgttgcacgggaagatcaacaagtcaaaaagaagagcttcaggagattctggctgtagggaaagggatgactttattgaggaccactgggtcagtggctaagcgtgttgtagcagccaataggaagaacatacattctgtaccttttccctgtccttattaagctttgcagtattcatgtgggttcctgtactgaagacctcttttgtaagagataaagggagggcctacgagacttggggaagataggaaaacgaccttagtggaggtatgcctcctgaatgctgctgctaaggacatgggatcatttttatgacccccaattaactaaaagaaccttcaccagtcaccattcagttagcggagaaggaaaataactgagaaattttgtggtggacaaacattcataagaccctgcaatgtacccaataggagtcaggaactcagagcttttcagctgagatcgtttatcaaggagccatcagtgtaatgagggacacagatgagtaaaccaacaattaggcagttgcatgtatcagaaccattgtgaacaggtgaaactttctctaggcgctttatgttgtcatcttgggcactgttagccaatataattagaactggtttgaaagagccttttacttatagtaaacagtccatgtgttatcagtgtttggaagtagcccttgaccctggccacggggagcacaattacactgaggacaagctgagcataaagtcgacaacacaagtgtatggcatgatctgttcatgagtcttcttaatagtagttattgctttttgacgcttcattgtgtggtaggcactgccctgagccctcattcgctgatttcatcatcggaaaccatgcaaatacgaattttcatggtctaaaagtccttctcagccaagcatggtggctcacctctgtaattgcggcactttggaaggcggagacaggaggatcacttgaggccaggagttccagaccagcctgggcatcatagtgagaccccatctctgccaaaaatttaaaaaatttgccaggcatggggccagtaccttagtgccagccactcgagaggctgaggagagaggattacctgtgccctggagtttgagactgcagtgagccatgatcatgcactgcactgcagcctgggcaaaagagtgagaccctgtctctaaaataactaaacaggccttcttttacttgtattttatttctattacccatttccaatgagttatagattggagtctatttcatttatatattcagcagacatttgtgaagtgccatttatgagccaaatactataaataagacatgtctagccttgcccttaagaagcccacatcctagggatggataggcaggaatgtaacaaggtactacagactataacagctgtgtgcatggcaatgggagagggcaaagaaggacagcattctcaccaatgaagagcatctctcagagttgtggagtattcctcaagccccatatgtctaaaataagggtagctttgggttgaacctatgaaattgctttttttgcaggtcaaaaatgattgtacattggctatttcctaactcaacctaaatagtttctctctcataactcagcttgtcctgtggttgatttatggacaaatggtatagttgttccactaaataaatgtccagccatgtcataatagatttatttgccatctgtttgatagtatatgggaatgaaaccgatttttttcaagtttttaagactctattttaaattacagatattaatgaatgtgaacatccagggctctgtggtccgcaaggggagtgcctaaacacagagggttctttccattgtgtctgccagcagggtttctcaatctctgcagatggccgtacgtgtgaaggtaagataaaccatacgaaatcatattgttgtgtgataaaagagagaggagattgctttcacttatacaaagacttgaagacactaagaggtactgcataattcagagcctcaaagcatgtatgcatcaaagtaaaccatatctgaaagcatagctcaggggttgctgggatttacgaagaggataacctaaggttatgatgataaaaacactcacagatggctccacgactggtactgaattaatgagtggaaatgtgcaaggactgataggagacatgtaggagacctaaaggaaaactgtggcaacttccctttcccctgggactctgcttcttttgattgtgcttcatgtagatcgtcttgatcattctgtgtgtaaaaaatgtcttgcggctgggtgcggtggctcacaccagcacttttggaggcccaggcaggtggatcacttgagatcaggagttgaagaccaagcctggccaacatggtgaaacctcatctctactgaatatacaaaaattagccaggtgtggtggtgggtgtctgtgatcccagctacttgggaggctgaggcaggagaaccactgtaacccaggaggcagaggctgccgtgagccgagatggcaccattgcactccagcctgggcgacaagagtaagactccgtctaaaaaagaaaaaaagaatgtcttgcttgatttttctgtatcactgtgaacagatcttctagaattcttcccctaatatccttatttccaaggcagtatatttacttacctaccagtatttattatctcctaaaagctaattaagttgtaagatgttaagataatgctcttggcttcctacttacaacctctgtatgtttgcaagaatacagcactggttattttcataagatttgtgttcttgatgataatttacctgaaccattttaaaagtaaactgaaaagattcccataatcataatttcagttgatctcttttgagaatctagattattgaaactcagctatattttaaagaagtaaattgcaaaagttttgttctgggtctaacatagtgcccagattctttgctctaaaaaatagtgcaacaggaagtatctgctctccttgctagtaccagaatggaaccaagccgtgtgccagcaaccaggttcatctgaaactaattattatattgggaggaataaactgatcttgtaaagagcagaagattgttgaaattactctcctgctgagcagacaaaacatggatgccagatttgactagaactgggagagagagagttcagggtggattgagcaaacagattgaggggtttggaagggataggaagttgggaaatggaagaaagcatcatagtaatgtgggtgatgagagatttagaagaaatccctgcttcagtggttcaagttttatgtaaattttatatttggggctttgagaccagagcttttagcaaagacactccatgaatgcatacattcttctgcagagattacagtattcctcagcttgagggatagggtgcaagcccatccgagtcactgaggaaacagatttgcagaattcctaagctctagaaggatgcaggtttgcttctttgcttagctctaaatcatggatggtaaaggcttgcttcctaagaaatggtctgtggtataactactgatggttgtgccatgcaaaattatattcagaaaaaaaaataagtgacctcaagtgctcactagtcaaagctgttgttccaaaagaatatactaaacataaatatattcacaattattttgtcttttgcacttactaatgatttaattctgtacttttttaacacagatttctgcaacttgagagttgcataatcactgtaatttagttgcagctctaattttgttggtcatttacttggcaaagacttgaatttaaaaatgtggttttaggaaacttgtaatgctttataaattactgtactcattgagtatactctttgtgacacctggtctgtactgccttgactccagaacctggacaattttataagtaatgaaatacaagttagaatattatgttggtattatacatggtagtataactagaactctccgtaattattatgcatgttattctctttctggagtaagttctgcatgaattttattttttatgggcttaatccaatattctaaattggtccaaatttccctttgttagactcagtctgacacttatggcagtagtgctatgtcctgatttctacctctggctgtgctgcaggacaaagccagctcatgtgatcagtattcagcagtgaggctgatgtgtgattgaaatttagcaatggagcagttgtacatagtacttgaattaacactgagaagtggctggcattcttatctcatgtccatttactgattttcttctgagcttctgtttgaggagctgaagcctcgttgacaccagggctgacctgcccggctctaagcagggctaaataactcccacatagctgaaggaaggagggcccttccctgatttcccgtgacttggagaagtgtcagcatctggtcgtagttaatgaaccacaatgaagaggcaaactctgtcaacatgaattgtctttaagtgtagcatggcagcttctatagcaataaaaatggcaccactggctccttcctttctcttacatgtatagattgagtattcctcatctgtaaatccaaaatctaaagcactccacattctaaaactttatgagtgcagatgtgatgctcaaaggaaatgctcattgagcattgcagattttagatttttggattagggatgctcaacaggtaagaataatgtacacattccaaaattaccaccaccccccaaaaaaaatcccaaatctgaaatacttctagccctaagcattttgggtaagggatactcaacctgtatatggtactctgggatagatagctgggagaggaaggagaaacaccgtggttctcccatgtaaggtaaagaatggtgtaattcacagttcaagtgaagtgggaagtaggtggtgggtgggcagctatttgtcatttattcactcacgtaaccggtatttactgagttcctatctggttccaggccttgttccaagggtaaaacatacaattcttgcctccatgaagccgacattccactaggggaattggggataaagaagccaatggtatgtgtaggatacattaagtgtttataacacagcatagttaccctttctggatataaataagtgcagagtgtaacgtgtcatatataatataatacacaggatatttttttcaaatcccagacttagatgtcaggaaattgcaggggaacaggactcttctgattgacttctgctacacttccctttcctctctcagttatagttcatctcctcctgccaccttcctttcacgctatagccagagcttttatcttgtgtattaaaacaaaggaaactttttctttcactcaactcgttgttttatggtccatttgatcatatccatttgtttagcaaaaaatcataattcttttgcctttttatttctgcccttttttattgtggaattttaattcacatgaaaaatactcatcatcaagcctgggcaacatagcaagactctgtctctacaaagaaaaattttttttaattagctggacatggtagctcatgtctatagtcccagctactcaggggactgagacggaaggatcgcttgagcccaggagttcaaggctgcagtgagctatggttgcaccactgtactccagcctgcgtgacagaaccagaccctgtctcttaaaacaaaaaatctgaccaggcacagtggttcacgcctgtaatcccagcactttgggaggccaaggcaggtggatcacctgaggtcaggagttcgagaccagcctggccaacatggtggaaccccgtctctactaaaaatacaaaaattagctgggtgtggtggcaggcacctgtcatcccagctactcatgaggctgtggcaggagaatcacttgtgcccaggaggcagaggttgtagtgagccgagattgcgccattgcactccagcctgggcaacaagagtgaaactacatctcaaaagaaaaaaaaaaatccttatcattgcattcataagctgatttgagattcggtctcttcatcatcagtagaatgtgtgtgggagaaaattagggaaacttaatggtaatcagattcctaggggtcaccacgtctgtccccatggcccatggggaaaaacctcctgatctctgactttgtgtcacctcttttccatgcctccttccttgctgcacttggccaggaacaactgcgctctcccagtcgtgtgcccaggctgagcaagggcttgtgtgactgccgtggagtccggcacaccccccatctctaggctccctgtgcactctatcctgttcacatgatacagcggccatgttcatctagcagggaccccaaggagcccagccacacagagggagcaccagcagcttataggacctggcacttttccctctggtgttggccaggcttggttagtcatggctaattaggcctccaaaccatggccaaaatcactccctgaagtattgtcttttagaaagcatcctcattcattccttcgtttgacaggtatttattaagtgtctacctgtgtgccatccactgttctaggtactggggccttgtcagtgaagaacagcaaaagatccccacttacttagaggcaataactaatagataactaagatgttagaaagtgtgataaaggctgggcatggtagctcacacctgtgatcccaagcactttgggaggctgaggcgggtggatcacttgaggtcaggagttcgaggccagcttggccaacatggtgaaaccctgtctctactaaaaatacaaaaattagctggttgtggccgtgcacacctgtaattccagctactcaggaagctgatgcacgtgaattgcttgaacatgggaactggaagttgcagtgagccaaggtcacaccactgcactccaccctggtgacagagcaagactgcctcaaaaagaaaaaaaagcgtgataaactctgtgaaaaaaaaaaaaaaagaaaaggtagagcacaatatgggggacctgaagggtagagaaagaagtggaaagctgctttgatgctaactggggtggtcagaatcggcttttctgcttctgtaagtgaaagaaatactgaaattttctgagtgaagaaatgaagccatatgaagtgcctgtcatgttcaaactggtcttctactggcgaagtgataaaagcccatcaataaataggtaagggagcatgagatggcagccgaggactttcttgcagctgtcaacatgaattctattgtccagacaagaatagaaaatcagataaagtacaacgccaagagttgtaaacacttgatgtaaactatggactttggatgataatgatgtaagagttcatcagtcataacaactgtatgtaccagtctggtgcaggagactggcagtggtagatgctgggggctggtgtgaggaagacaggatataaatgaaaactctctgtgtaatcttattgggaacctaaaactgctcttaaagtctttttgaaaactcagacatatttttggcattaccttttttttattggaaaggaaaaatgaaaacctttcattttattaataattctatattccactcctgtattttcttctcttggatgatgatggtgatattatttctcacttttcaaaataataccctggactgagtatgggatcagcagcttctcctcctagttttcaaaaatgattctactatttgattgaaaaattgagcactgcaagactggaagagggcttcttgtcacatctagcctgaactctgactcccacagtatacccaaagtattcaggaatcaagtcctattgctaaacatctatagagactctaaccccataaccttcttaggtatttactataaatcactccttgcttacacattcatctgaaatggaaaccggtaaaaattgccaatgcgttgacgtgtactgaaagtagtgatatcacaaccgagagaaggtggattcaaactctcaggctaattttgtattcattgggaaccagaaaacacaagaaagacaacattgccaaatcaaaaaagtaacaaattgggagcagacgtggggtttgttttcacacttctaggtacattttctatgaacgggggagaatgaaagcataaagccgtggacagtgccccaaggcagttggtggttttgtggcatggatatagaactttatatctgtcaccaaatagaaaatgcttttgaaaatgactcagccaagtgggatgctgaagaactctgatgcagtaatgtgttacatgtggtgtgcttagcccaagattttcaggtttttaagagttttcgggtctgaaactgaaaactgtactaagagatgatgattttagtatttcttagtagagagaattttaacaacagaatccactctcttccatgtgtaaaaagaaaaaggatcatacaacattctaggtaaagaaagaaagtggcttccagctataaaagctactgttcacactcactcttcctgtgaatgtacttctgcagaagtgagtgaaaatgaatgtttaaatcattagggagaaagctgaggaaatttttctggaatgagttgcttttggacttgaaatgcagattttccatgcattgcttgattgtcttccatatatcaacatttgtataaagaaattcataatagtagcaaaaaatttgagatctcttcctaagcctttttttttttttatcactgctgaccttttcaaaccccagagctatggaaatcatctgttcatagaaggagaagtaaacacttgccttgcagccaaaaaataggcagaagactgccagaaagtgaagtctgtgactaggctagctgaccttgcataccgtatgctgacatccactcatgctctggtgctgggcgtcctacatctgactcctttgatgtcaacaacccgagtcctttttagatcatggaaggttattgtaagcagtgtttttgtacttgagacctaaactgtaatgcttcatacacatattccagaaacagttactttttagacatgtgatagaatattaagcaactatcttggtctcccactatgagtggactggagatacattatatatctgattgcatgattttattaaaacagtagcaagaataatgtataatagcattcactgagttcttattacaagccaggcactatgctaagtgcattgcacctgtcttctcatttaatcttcacaataaatctgtaagtaggttaagtattaattggtttaattttggctgcaacaaacagcttagaatgagggcatttattatacgaatgagaagtatagtacaagattgttacctcttgcctcctgtaggtccgtatttaaatgctgtttccttagtgaaccggtttctgaccgttctttctcagattcactcaccgtgtaatgaatgaattaattcacttcctgttcttttttccttttgctttttttatttctttaccaccttattctacttctttaccttgtttattgttctttgtcacactccattgctagactttaaggccagtgagatcgggattgttttctgtattttttacagctctgtatgccattgggaatacagatgctactcaatttatgatagggttatgtcctcataaatggaaagtcaaaaatgcatcaaatacacctaacctaccgaacattatagcttagcctagcctgcttctagcacattctaaacgtgctcagaacacttacactagcctatagttaggcaaaaccatctagtacaaaaaaaacccgattttataataaagtgttgaatatctcatgtaatttattgtactgaaagtgaacagaatggttgtatgggaactcgaagtacagtttctactgaatgcatattgctcctgtaccttcataaagtaaaaaaatcgactaggcgcggtagctcacacctgtaatcccagcactttgggaggccgaaacaggcagatcacctgaagtcaggagttcgagaccagcatggccaacatgatgaaaccccatctctactaaaaatgcaaaaaattacccagatgtggtggcacacacctatagtccagctacttgcgaggctgaggaaggagaatcgcatgagcctgggaggcgagtgagctgagatcacaccattgcatttcagcctgggtgacagagcaagactccgtctcaaaacaaacaaacaaacaaacaaaaaatcataagtggaactatcctaatttggagaccatctgtaattagttggggcacaatacgcatttggcaaatgaatcaagggaggaagggacagtctgtagctcatcctggagtactaggaaacattcttaataagattactccaaactgaatgtgatgtacacttctgtgaagccttccctattttttgaagacttaattctctaatgcacaccctgcataactactgggtgtagtagtggctaagaagttatgctggtgagtttggctacatgggcttgaactcttgttccagcacttctaagctgtgtgaacttggtgagtgcttcagttccctctctgtatagtaagaataataatagcacctacatggagttgatgtgtgttggcaagtatccgccgagaatggagtagcccatagaacatactcaatgaatgtgagctattgttactattttagcatttcttatactggtaccttagttacagcagtccttccttatctgcagttttacttcatgtggttttagttaccatggtcaaccacagcctacaaatattatagtattttgagagagactacaatcacataacttttgttacagtatattgttataattgttataattgttataattttaattataatataatcacagtatattattactattaattcttactgtgcctaatttataaattaaactttatcataggtatgtatgtatgtatgtatgtatgtatatatatggaaaaaaacacagtatatatatatggttcagtactatttgtggttccaggcacccacgggggattttggaacacatcctccaccaatgaaaaggaatgattgcattgtcattggtttccttattatgtgagcatctaaaaggagggaaacatttaacaactattttatttttatattgtcaatgcttacaacatatataacatgcagattaaatacatacttgtgaatgaaattgtatggtatttccaagttcatgtcctgatattgatgaattactgtattctatcttttttttttttttttttttgagacggagtctccttctgtcacccaggctggagtgcagtagcgtgatctcggctcactgcaacctccgcttcctgggttcaagtgattctcctgcctcaccctcctgagtagctgggactacaggcatgtgccaccacacccgactaattttgtttgtttgtttttagtagagacagggtttcactctgttagccgggatggtctctatcttctgaccttgtaatccacccacctcggcctcccaaagtgctgagattacaggcgtgagccaccgcacctggcctctatttttaaaccccatatttattttaaatcatatagaatatagtgtagtaattcatttatatataatttgctttaattcttcaccctttgttttccctgagagtttcatatgactcttttccattcacccacaaagtagttccagctttaagtcattccctgtatcaagggctagtaagctgacagccagcactgatgcttgtttgcatttgagcattggagctcttatttctagaggtacactgtctattttctgtggttttataactgatctttcttggcctcctatttgaatatagaaagagaaaaattagaaaatatagaaaaaagtgagaattttttggctgattttatgttgcctctgaggcctaagtgtcaaaaagatgaatctggggtttgatatgtttggcctgtctgtagggctttctcccagtcctcactggcagcaccttttagtgtaagaaaagctgtatgaaaagagaaagcgtacagcatggatctaaatttagaagacatttatttttcttaatcccagatataaatacgtaaaactattacattaattccgagactatccagtggttatatataattatgtaaagacaaagtaatagagccttttaaaaacttagaacagtgtaaaacaaaatgtatatttcacatttatcttttgtgagtaattggaagaaatttacgaatgaagttaagattttcccttaatacctaaagaactgtttctgaacatcgtggaatttatttataatggagctaaaacactccacttttttgacattgttccttatttcatagtaaactgtaattctttacctacaggtgtagaaaggtggattttgggggctttcttctttttttcctttaaaaattttagaagtatttcttttctataacaaattcaaaccttcctcatacactttttctgttttataacactgtcagcccatggtagaaagaaataggaagaaaatgtctttaaatttagaaatatactttggttctctttttctgtaaagaatcacagatgacttatagtgtttatagtttttgcttttgttaaaaaaaaaaacagtgttttgtgtttcattaaatatatactacttttcagtctaattcagaatattgctttaaaatgtcccagatactcagttttgaattttcatgtataatatcaaggttttattataattgaacaaacatctggcacacacaatggctttctcacgcagcacctctcaactccaccccgtttctccattcatggagtggggaagatacatgcccagcacaaactgcgtgtttgcaaagctgttaatgacataaatgtcctttccagatacaaaacctgagctttgtgagctccctcaatgaggaaaactgtttgaaacaaaccactttccccattttcctggtcattcactgaatgagcttgttgatacagttcgaaatgtaaatgctggcatacttttattggattaaaaaaaaaacaatctaaactgacttcagtcatgaggatattcattcttgaccttatttgggatgataaagagagaatcttctatacatttaccctgcttttttgtcttcaaagcctactgaaaatgagaatgagggatataatttatttatttatttatttatttatttattttttggaggccgaatctcgctctgttactcaggctggagtgcagtggtgcaatctcaggtcattgccgcctccgcctcctgggttcaagcgattctcctgcctcagcctccccagtagctgggattacaggcacgtgccaccacacctggctaacttttgtattttcttagtagggaagggtttctttcaccatgttggccaggctggtctcaaactcctaaccacgtcagtctcccaaagtgctaggattacagacatgagccattgcacctggctgatataatttaaatactttaataattcttaggactcttggctgttcaaaaaaatcaagatgtttaaaaatgcattttagattttactcctctgtaaaaaaccatttgctgtttatttttaaacgtttgaaaggacatgtggagtggggaaaggaaccaggccttggagcccactctcagtggttcagatagactctgggaagggggtgagtccagtgaggaccctggagacctggactgatccagacccagtgtctccttatgaatgctttacagtaaactatgacctatcttttgaacatgaaataggtcttacttccgtcttctatcattttttaaaacattcataattccaaagcctgatgtcttagaattattactaggattgcattctcttctgaatatataacaatgctgttatacttctaagaaaacgattttttttaatgacataataattctccatcaccttctacaagactaaagaacaatagaatactgaagacagaggattcaaataactcccatgacatagagtgggtcatgtacaaatggagttgagtttttaaggaaagatatagtaaattacatatgtttcttatttttgcttatattcctattttaaaaaaagtagcttgacttcattttgcagttggagaaaaataagttatagggtattagaatgtcttccaataagcagataggaagtggtggtcaagatgactactcagagtgccttaatatttcagtctaatatatatgccacaatacctgtaacccatgggaaatagaaaagcaaagttagcttttgaaatggtaagagagtctctaaccaggaaatgcagcagtgtggattatctctttttttttcagtaaacattcaagttggtgtttaaaatgcatgtagagggccgggtgcagtgactcacgcctgtaatcccagcactttgggaggctgaggtgggtggatccgaggtcagcagttcgagaccaccctgaccaacatggtaaaacccatctctactaaaaatacaaaaattagccaggcatgatggcacacgcctgtaatctcagctacttgggaggctgaggcaggagaattgcttgaaaccggaaggtgaaggttgcagtgagccgagatcacgccactgcactctagcttggacaacaagagtgagactctgtctcaataaataaataaataaataaataaataaataaaataaaaataaaatgcatgtagaaaagtgcctaaatcataaggccaccacttgacaagcatttatagtgagcatacctggtaaccagccccctgaacctccctcaaacttcctcgtgattattccccaccctcatatccaatactcatacatagcacttaccactatcctgacttcattattgtagattcgttctgcctggtgtattagtctgttctctgctagaacactgctaggaagaaatacccaagactgagtaatttataaaggaaagaggtttaattaattcacagttcattgctggggaggcctcaggaaacttacagtcatggtggaaggcaaaggaagagcaggtaccttcttcacagggcggcaggatggagtgagcgcaagcagggaaaatgccagacacttaaaaaatcatcaggtctcatgagacttactcactatcatgagaacagcattggagaaaccgctcccatgatccacttgcctccacctagttctgcccttgacacatggggattatggggattacaattcaaggtaagattttgggtggggacacagccaaaccatatcacctgcttttgaacattagctacatgtaatcataatatgtactcctttgtgtctggcttcttttattcaacattgcatttgtaagcttcgtctgtcttgtcatgtgtagtagtccatttattttcattgctatatagtatttcattgtatactacattatgtatccattctactgttgatggtcatttggcatgcttcctatgtgaggctgttgtgaataaacttcctgtgaatattcttgaacatgacttttcatgggcataatcactaatttctgttggatatcactaagaagtataatttctgggtcataaaatgtatgtatgtttcactcacatatatatagccagtttttcagagtaccagtttacactgctaccagcaaagggttaagagtctcagatccacattatcatcaataattggtattgtcattcctcttaaggtttagccatactgagtaaaggtatctcattatggtctcaatttgtgtttcccttgtgaagatatatctttaacaacttatcatacctttattggccctttggatattgtttctgttatctaattctgcataagaaacttcttccaaatgaagtgctcaaaacaactattttaatggcaacttcaggtgaactcaagttgttaattttaatgaagtccagtgttttaattgttttatttcagatcagtattttttatgtccagaatctttgcaaaccctaaagtcattaaggtactgttatgttgtcttctgatagctttattgtttcacattttaaatttggatttgtaaggcccctgaagtttttttgcatatggtgagaaataggggtcaagatttcttcatttcctaaatggacatcaaattaggtcatcactgtttattgaaaagagtgcctttttcccactaatatgaattttttttattaaccatagagtcagatatatatgaatatatttctgcattattcatattatttaataggtttatctgtctttgtaccatttgtacattgtcctagttacagtagctttataataaattttaatgttttctgctgtcagttctaacttcttcaattctgttcttgagattgtcacagctattcttggccctttgcatttctatataaattttataatcaggtgatcaatttttacaaaactctgctgggattttgattggaattgagttgaatcaatagatcaatttggggaggtttggcattttacagtatttagtcatctaatctgtgaatacaacacacccctttattagggtttccttcatttgtcttagtgttttgttggagatttttgtataaagtctttcacagcttatttaagacttattcctaggtcttcaagatttgcatgtggttgtgaatggtattaaaatttttttacccttataattgtttgttaccagtatatagagctaaatttgatttttgtacattgaacttgtatccatgaccttgctaaatctgcttgttaattctagcagtttatatgcagatttctttgcatctcccacatatacaattatgttgtataagtaatgctagttttattccttctcttctggtaagcatacttttatttccttttcatgtcttactgtactgtctaggacctctactgcaatgttgactagaagtggtgacagcttgcttgtctctttcctgatatcagcagcaaagacatttaatatgatgcttgccataggttttttttttcttaatagatattctttatcagataaagaagttcccttatatatctagtttgctaatgttctttatcatgcttggttttgaattttaacagatggtttttctgcatctgttgaaataattacattattttcttctttattctgttaatgtggtgaattacattgactggattttaaaacaagataaaaatttgttttccttatagcagtctaagcttcagtaatctagggctgataatacaggtctataatacagggacccagacaatatctttttttttttgctttgttcttccggactcaggttttctctatcatggtctcaaaaaaaaaaaaaaaaatccttgaagaattcaccggtaaagtcatttgtgcctggaatgtttgtttttgtttccttttgtttttgtgcctatgcattataaacatttttaaattgcagttaagatttcattaatagataaaataatattcaggcttttgacttttcatgtcagtttcagtaagttttgttttccaaggaatttatccatttgggtaaaatttcgtttttatttgcacaaaattatttataatatcctcttctctgtatatatgtagtgatcttttttaaaatttcagtaatttgtgcttatgtttcgctcttgatcagttttcctagggttattagtcatttcaaagaaacaacttatgtggatttgtttcctttgttttctattttattaatttttgcttttatatttattattttttctatattttttatatttacactttggggtttaaattgtctttatttctaactacttgaagtagatctttaaatcattagattatcaatcttctaatatttgtatttataggtatatatttctttctaagaatggctttatctgctatccataagttttgatatgttgtattttgttatttacataaaatatttctaaagttcattgtcatttttttcctttgaccaatgaattatttagaagtatttcacttaatatccagatgtttgggtattttctggttaactttttgttactggtttctaccttaaaaccactatggccagagaatatactctaaatgacttcaatccttgaaatttgttatggcacagaatattatcaattttagtaaatagtccttgtctgcttgaaaacaatttatattatgcggctggacctatatgtcaattagggccagtttgtaagttgtgttgttaaaatcatctatatccctaccgattttttgtctgcttactatataaatgactgaggagtatgtaagaaaactacatgtatgtaagaaaactcggctagattaaaaagcattttaaagggttttatgtgtatttttttgttttgagagttttgggttttatttgcttgtttgtaattgcaattgttgagaattgcagtgacctcctaacttaaatatgtgtatactattaattaataattatcagtagcattttatcttacataatataatttcaagcaaaacacttcatcttaaaacaagattttattttcattcagaaaaaataaaacgttgcaagttttcaatattttaaaaatatttatgaataggtattttatttttgtttgtacagttgtatttcactcaaatgtttattcctgttagggtggaatatatatttatacacaagcaaaataattaaaatacttatttaagtatcctcaaatagtagattgcaagtatgtgatttttctgattttaagagtaacataagccaggtggtggtggtgggtacctgtagttacagctacttgggaggctgaggtgggaggatcatttgagcttaggagtttgaggccaggccagcctggttgatgtagtgagacaccatctccaaaaaaaaaaaaaaaaaaaaaaaaaagagagagagagacagagacactctcattatagaaaatttagaaaattctgagaaatataaagaaaaaatcatttatcaaccagtgttaattaatgttaatatttgacatatttcttaatagtttttagcatttaaaaatgaaattatatactttatttatttaattttttttttttatatggagtcttgctctgtcgcccaggctggagtgcagtggtgctatctggcctcactgcaagctccacctcccgggttcacgccattctcctgcctcagcctcccaagtagctgggactacaggcgccccccaccatgcccagctaacgttttttgtataggattaatgagagggaggaggagggaagactgttttgactgaaggatctctctaaagaaacagcatttgagctgagctcagggcaaagcctctgagacagagaacttggtgcactcaagggagtggaaaaggccatgcctggttctgagagaggaggtgtagtctacagcgatcccaccgtaaatacacctctcatctgatcttgaaagctgagcagggtcgggcctcattagtacttggatgggagagagaggctcagcaagggtagagctagggaggcaggtacagaatttgcaacttcccacaggaaatgtaaagagtttgggtgttattctaagtgtaactgaaatagactgatagattcggagcaggacaatgatatactatatttcatctttctaaaaagatgcacattttttcacctttaatactggggcacttcctacagttgaagtgatttttaaaaagcagtgcaaaataggttaatttgtagagtttttttttttctttcttagtggttcagaaaataattttgttctttttaatgagtggagtcttctatttgatttaattcagtaatttatattttttaagtacagtgtttctgttttccaggttgctttttggcaatggggttagaggagcaggagaaaactcaggatatcttctaggatattgttataatagctcaggccacacatattggtagctcaggctagagcagtggcaacatgatggagagaaatgaatgactccaaaaatgctctggagatagagcctagtgctagattagaacatagagttgaacccgatgtaggacatggaggagaactgttgaagaggggtcataggtcctggctttagcaagttggtatttggtgacactatttgctgacatggtaaaaaaacgaagcaatttttttgtaaagatcaagagtgtgagttggttatattaaattagagttgcctgtgaaatatccatgtgggtgtgtcccatagggaattggatcaagttaattctaatgttcagaagagaagtctagtctggagataaaaactggaagtcatcagatctagaccgcatgtgaagccatcagaatggatgagaccaccaagagagatcatagaatgagaaaaaaagaaggtctaggactaagctctgagaaatgccaacatataggggtcaagtaaaagagaccctgtaggaggagtccagggagtaagaggaaacagaggatatggtactgtagaatccaagggaaaagagttcttcaaggagagagtggtcaaccgcattgaatacaactgagagctctactaagaggacaagaagaatcctttgggttttacaaaatggtgaccttatcaggtgctgtttcagtggaatcttgaattcaggagccactcaagaatgaatgagaactgatggagtaaacacagcatgcgtagataagtcaagaaccttggctgttaaaaaggagtaagaaatatggaatgatccaatagagagggaaagaaggtgatgcaggggcagaggccacatggacaagcgcagacagcacgtggcaaaggcctctatgccattacccatggaagaaaactgaagaggtttaagcagagaactatttgattggactgtttcattaggtaaattattctgtcattgtgggagatgaatttggggtctttaatgagtgtctgaaagcacaaaactcagtttggaagccattgcaggaattcgagtgaaagataatgtgtccttgaataaggctggagaggaaaggagagactggagatacaaccaaaagataaaatcagaagaatgtggtgactggatgtggagcagtaatcaaggatgactcccacatttttgggtaactaggatgatatatgtgatttttaggatggtttccaacaggatatctttaactgtagatggtgaatacctgttgtctacatagtggttgacaaaaatggagcagtgttgttttagtttctctggaatataggattgaggcttgtctgggtaatttttacagaataatttaagtaggctgggcatggtggctcatatctgtaatcccagcactggttggccgaggtgggaggatcacttgagccgaggagtttgagatcagcctgggcaacataatgagacctcatctctactaaaaattaaaaaaaaaaaaaaaaaatgccaggcatggcagcatacacctgtggtcccagctatttgagaggctgaggtaggaggattgcttgagcctaggaagttgaggctgcagtgagctgtggctcactgtgagagccatggcactctctctcacagtgagagcatggcactgctctctagtgtgggcaacagagtgagaccctgtctctaaaataaataagtaagtaagtaaattttttgaaagtagtacatctccatgctggggaaaaaaaaaaaaaaaagatgtctcattggccagccttcttttctagaaggtaattatgggaaagttgaatttcaaataatttgttacctatgtcatttcttattgcttatcttaggctgctagctttcaaaacagacttgtgaccatcaaggtccccgtgtttttttcctgcccttctctgtcaagggatagcatggtagtcagactcggcccagggatgtcgtctgctgtttctggcctattcccatctcctagaacaaagttattttccataacacatatgggctatattccccagccttgtcgatgttgccagacctcagtggaccttttttaaaaggatctttccatatcctattgtattgcctggaccatctcccaatccagtttttaatttcctattggctaaattttattttctttctttaggccttgtgctcatcttccgcttaatgctggcttccctcctgtgctgtgagagagaccttaatcgcttgtgggccagcagccatgccattttaaaattcttttgggcagctattcagctggtttaacatctttcactcccacttgttggctgagatttactctctcctagccggcttccattcctttcagaaaggagtgtgagggctgcatttccattgtaagccccttttctttggatctgttttcctaagattctggcaccaaatacttaaccaatctcagttggttaagaagttctgagctaaaatagtgggccattttcttcttatgaagagttccaggagcaccgatgctagacatggtcctgtctaagtcctgggacctcctgagacttgcaaccatgggtgcctgatgtgctttcttccaagggtctcctacaaaaatatcctcttcatggcccacagtagctctagtgtctagatttcaagtatgatgatatttcttgtattaaaggacagagatgcctaagtcttatttaaggacaagaagacttgataaaactggaagccagtaggtgatgagtcaaagagtaacagatggtgtgttctgacctccatcttcatagtgggcaaactccagtgtgctttttgggctcacagtttggttagttctcttcatcatctaggactaaccttttttaactatcatcatggtgacaggtaagagaatgtgatggctagaaccacagacagattcagaggattcttctgtgaccaggccctgttcctctgccagctctcccgctaactgactatgtaaccttgaggcaagtcacttcccctttctagccctcagttttccggttattaaaatgaagagattgaactggataatcttcaggtttccgttaagtcaaaatggaccatatgattcatctaaaaatgttctaagacaggaagcccgtttcttcacaactctcagtagctttggagattttcctatgaattatccattaccaaaaaatgacacccccattcccactatccacttctctggagcgtcctggcagcagacggaaagctcattagtgagctgcttcccctaatagatgagtacgttttgctcagaataaggaagaaggaagtcaacaaaataagagaaggagatgttaagaaactaagaagaagcactttcctaaaaatgtaaaaccaaaaactgaagaatatatctgaaaaaagagcaccaaatcattttactaatgaaatagacacaaatacccctttctttccaatatacatcattttcagaatatgtacagatacacatagacttttctgcatgtaatacaagacacctaatggaaccattgagatttgttgtgaatttttgtgttgagttcttaaaattaaaacgattttaattttttggttcttaaacaagatttacatgaccccaacctcttttagaaaaccctgccttctttccatacttgttatttatttcatagttcactttacataaatgagaaggtgacacaggtgtctggccttacacctttatttgagaattcgggagtgcatgggttcgagttctactctagtatgtagactccctgaatgcagtcagtaggtttttaaaaacttttggttcattgagaaaatgtcttaagtaaaaagcatctgggcaaggaaaatggatctgccaagtagatcaataaagaccctcaaaagcgtggatctattagtcattgacaacattgctactttttaaatgagccactggtagttcccgtcacccagaactatgttctatttttctttctgacatttatgtaattttttattgggaaattcacatcagggatcgattctccttggtttgcataattctttcttgactttatttccattgaaatatcaatatttatatctgccttcttcagtaaagtgtaaatagcaacacttgcgtgatgaatcagcaacttttataataccacacctgatttttctggattgacaattgacagttgatcactagacaaatcacgcctgtaatcactaacccattggatagtattaccaatgatatcatgcatggcccttacagatcactaagcaaaattgcttggtagttttaacagaatcacccttcattaagtgaaaacatatgatatttggatgattcaaaatatagtttcatcttccaaattcaactttagcaaaaaaggatgactttcacttgttcgtttagtcttgctgggacttctactctaatgtaataaattttcttaacatttagctttatttctctagaattactcgtatttgtagcagttcttttcattgtatgtatatacgggactaacaatggaaaaatatctcagagagctcacatcatcaaagaaaattctaatgaaataatgttttttcttgtagaggtcattaaagtgaaacaaatgtcctcttattaagctattacctcacctcattgttgaaaacatgaaactgctgagaattacattatatcatttttataaaatattagttgctgaagagctagtttccagcaggcattccacgttattttttcctattcattcaaatccaaaatattgctcatctaaactttctcggttaatcactgttacagtaagtctgagactgcaagacgcccagtaattcataaccagcttggggcttgttcaccttcaggtcaattatttggttcctgtgcacagtaacgagaaatcatcatctgctataattgcatagaattaataaaaaggaaagcaaggatgttccttcaggaatctggactgaaaagccaccaggtttctagtacataccttctctttctcctccttagctgtccttccactcattttagtagggaaataagttgctgatgaggttaagttaaaggttcctcaccctgagaaggagccctcgataagcacagcagtggcacaaaatgctctgggactggagaggagaggccctgagatctgcttgtggagtagttaaaggaggtgctgcagaggaggtgtctcttgggctgactcctgaagggccaagaggcatttctaagtaagtccaggggaaaggggtggcatggagattccagagacggaaggagtggcatggagattccagagacggaaggagtatgcaccaagtccatgaaaaattaaagaccgtaggttttcaaagacctctagtatgctaattgagccagagtgcaaattgggaaggaggttgtctggaaactgtggccagacatataggcaggaggcagatgaggaagggtgctccatgccctactaaggagtgtggttaccctttagccaagaggagattctgaacactctgagcaagggaatggtactggtgagtttgcattttgcagagagcacattggcagttttaggtggagaatggatagagggagggaggcaagactggagatgggaagatgacccaccaagagtatgagtatcaggaaagatagtaaagacggcatgacagggaaggacagagaataggagaaagtgaagggtgatattaagatttctggcttgggtgacagattggatttgctgatgaaggaaataggagaaatggagttgagatgaggaggggagtgataataaattcgtttattatgaatatatccaataggtattagataagtggttctaaaggacagaggtaaatttttgagagagactgggaaatcatcagtatgtaaatggtaattgaagtatttccgagtttctttccagcccttaaatcctgtggttcaatgaataacataaataatctctttgatgtacgcccatctcagaaagcctacctttagcagtggcctgtgttaagtgatttggtgacgcgatgcagttcctcctcaagttgtgatcagtaaatagtgatctcagcctcatgctgacattgaaaatcaatcagaacagatttattgagtgtcttttttgtgtttactgttgtaagggagattcattttttagactggaaataatttcattgatttgtcctttttttttttgagacggagtttcgctcttgttgcccagtctggagtgcaatggtgtgatctcggcccactgcaacctctgtctcccaggttcaagcaattctcctgcctcagcctcccaagtaactgggattacagtcatgcaccaccacacccggctaattttgtatttttagtagagacggggtttctccaagttggtcaggctggtcttgaactcccgacctcaggtgatctgcctgtctcggcctcccaaagtgctgggattacaggcatgagccaccgcgccgggcttcattgattttttaattcaagtcaccaaggtcaggaaatggagtttagtaggaagacagtgaatacagttttaggcttgataagtttaagttcatggcagaagatccaatggaaatgattaagaaatgtgcttgcaccccatctctactaaaaatacaaaaaaattagccaggcgtggtggcgagcgcctgtagtcccagctactcaggagactgaggcaggagaatgacgtgaacccaataggtggagtttgcagtgagcagagatcgcgcccctgcactccagcctgggcgacagagcgagactctgtctcaaaaaaaaaaaaaaaaaaaaaaagtgctccgtagaagaatcttggctggagaggaggatgggggatttatcccaaggagcatggtcactgaaactgggagagtgtgggaagggtggaggagaggagtgctgagcacacagcagatttcaggcagggcgggagccttggcagacacccactttcaggctgccaaagggcaaggacaagctcaaggcagaacaagaagaatattccgtcactgaacgtgggaagagagtgttcaaggagtgggcattcagccagactcggaggtcaggggtgactgaccggaagatgatcatgagatttagtgatgagctggtcactggtgctttttctcataggagtctcagtggcataaagagttaggaagtaagattctaggtcattgaggaggaggaggaggaggaagaggaatagtagtaataataataaagttgacatgtactatattggatgtctccctacgatacatgccaggcagtcttcaaagcactttgtacgtgttattttgtttaatgctcacagtaattgtaggaacttaccaatgttattaatattattcatattgatactattatttccatttacagatagactgtaataggaaataaagacaatgagtatagacaatcctttgtgacattttgcagtgatacaaaaagtttaattccccccaaactaaattctgtcaagtgaaattgaacttgtcattttctttagcatttgttgtctgatttcattatttgaacataaaagtacaatcttcacatatatttggatgctgttacattttcttaattgtttctccaaatcttacattttggcgtgactgttaagtccagggcagagagagcagagtaccaggcgtggctggtgtgagatgtggcagtgcccaaggagaagaaaagcacaatgggcgatgatatgatcaggtgaaaactattttcaagcaattttaacatttttgaaggcagtgagggtaggatccaggggaggaataactgaagatgttggagaaggatgagcaggtgggaccttgaggcagagactggtcagggcgggagaaggagccccacccagaaaggagaagggatgtaggttttttgtttgtttgttttgagttgagaaaataagtttaaaagagaaaatgcggccaggtgcggtggctcaagcctgtaatcccagcactttggaaggccgaggcgggcagatcacgaggtcaggagattgagaccatcctggctaacatggtgaaacaccgtctctactaaaaatacaaaaaattagccaggcgtggtggcgagtgcctgtagtcccagctactcaggaggctgaggcaggagaatggcttgaacctgggaggtggagcttgcagtgagccgagattgcgccactgcactccagcctgggcgacagagtgagactccgtctcactcaaaaaaaaaaaaaatatatatatatatatatgtatatttatatataaaaataataaaagagaaaatgctcaattttattaatagtaactctccccaaactaaactctgtcaagtgaacttgaacttgtcattttctttaacagttgttacctgatttcattatttgaacataaaagtgcaatcttcttcacatatatttggatgctgtcattaacattttcttaattgtttctccaaaaacttgcatgtggcatgactgttaaatccaggggcagagagagcagagtaccaggtgatgggtggtatagatgtggcagtgcccaaggagaacgggaaggaaagaacggagaaggaaattagtaaccgtaagaataaagaagaattctatctaaaagtctgttgtaactttgcaattgaggcatcacttttataagaacatttttattaatgagaaaaaaaggcagaagatcactctcatcacgtttatggagaacaaaatgaattggcaagtcagccaatcagctggagcagcctggacggttaggaccttgaatggctgtaaattggtggcatcaaatcttttcttttggcactgggactgactggctaccctgctgacttcatcagactctctcttgacttcctgaggatgttgtgtagtctggatcaaggttatccacaaggttaagtaaactattgctcatttccacctgtaactatcagatgcaaatactattagcatttactgcaactaaaacaagtgacaatattttcacatgttttctctgtaggaatataaggtcccttggaaataaagagtcgagaacgtttaggtaatactgggcgtggcacttgcagccatcatttcagtctaaaaacatttcctaaggaaaagtactaaatgtttttttcatagaacccaacattttggctgttaaaccattttcatcaaaacattttatttatatgtaaaatattttaaaagctgttttctgtgtaaacatgttcatctcatcatcacacactaatcaggatgtgttgagtgcctctgtttatccattaatatctggtgtttgtcagcctgtgtttgttttgtgtctgatgttccatgtcttttttgcagatattgatgaatgtgtaaacaacactgtttgtgacagtcacgggttttgtgacaatacagctggctccttccgctgcctctgttatcagggctttcaagccccacaggatgggcaagggtgtgtgggtgagtttttagattttttcccaacgtgtttcacatgtccctagggaaaagaaatcacagtgaacaacaggagcttttaagcaggtaatttgggtagagctttatcgtaatttgattttgtcatacaatttgaggatgtgcaaaaatatcctatgttggctgggtgcatggctcacggttgtaaccccagcactttgggaggccaaggttggagaattgcttgagaccaggagtttgagaccagcctgggtagcatggtgagatcttttctctatgaataaaaattttaaaaaaaaaattagccaggcttgatggtggatgcctgtagtcccaactacttgggaggccgaggtgggaggatctcatgtgcccaggagtttgaggctgcaataagccgtgatcatgccactgcacggcagcttgggcaacagagaaagaccctgtctcaaaaaaaaaaaaaaaaaatcctatggcttctgaaattgttagggacattaagaaatataaaagtatgactttacatttaaatgaattttaacaagaacatctgtttaaactctaactgagtatgcagaactctagactcccttcagcacaggaaatagagtctggtgtgtggtatagattgtctgtctttgaaatgcatccccttagacagtgcgtttaaggcaaagtattgccaggagcttcagtgtccaggaatgatacctgtaaaaggatgctttgaattgtgcaactgtatttcctcagtctgttccgggattgacagggctggaaggaatcttgaatatcatcatatgtcctggaatatggtccaacaaatgctcacacagaaaataatttgtatttcattgtctgaccaagatgtgatttcttcacgtcaaactcattatgaaacatatttgcaattagagcaattaaatgggaaagagaagaaaggttatcaaattcaagactttatagatagcaagacttttctttttctttattcttagagaaaaatagccatgttcactacatggcaggtggaacttgaggagtctattgcctatttggtttgaaaatttgcaattaagacattagttcatttgccatccatattaaacttggaaaacaagatttttaaggtttaatgataatgtcacttaataactgcttttgtggaattatgaaattcagttaattctcaaccaaaaattatttacaaagcaatggtgtggtttcatgcataagcagtagctagtcaaaaacatagataattattcaagaattattcacaacaagacatagttatttaataatatagctaagactatcctaatcttagttcaaactcctgctttggccacctttccaccaaaatacagttgtttgacgtttggataatattttcaccagttgggtcttgtgatgtggcccctacttttcatcttaactttaccacttccttcttcacctgttgtttccagcaacgtcagactggttgtggttgcccatgtcactgtgcaattatttgactgttgttcactccttctgctgggaatatcctcctgacctctccttccctgagccctggatttttctcactcgttcttgaagactgaggttcagtgtcatcttccagacaccatccctgctccattcctcactctcaagctgagctgtgacctctgcttccagagcaccttcagcaaattctattatagcacttacaacctttgggggaataatttaataatgggtataccacctgcagaccgcttctgcaaggctatgacctctatatgattgaaaactttctcacttctccctgggcagggcacgatgcttggcttattataggtgctcagtaaattttgtttaactaccaactgtttaaatatcagatgttgaaccatacctggaaaccatgtcagctatctggagtccacatagctccagagcccctgcttaatgttcatttctaaccagccagatgagcacaccaaacccatgctgacatttcagcttggcacacaaaacaccacccttagagaaggaatatttgttatcattttggtgaactcaacaaatgccattttatttgtgtttgtatttattatttcaaaaatatttactaagcacctatgatacgcacttcacactgggtgttctgtagagctacagggatgagtgagcacctgccccattatcacctactcatccttcagctatttgctccagtatcatttctctaacccacccccacatttaaggtctgctgttccatgctttcactgagctctgaacttttcactcctcacactcactgaagcatgtacaattattttgttcatttccctaactcgtctgtaagctccatgaaggcaggagttgggactgctggctcatcattgttaccccacatataggccgtacaggcctgccccacagaagtaagctaggaaatatttcttgattgaattattgcagtctgatgggatagagtttattagccatgtcaataatacatgttggaaagtacaaagttccactggacatttacctaaaattgatcaatgtgaactggcaatttcttaagtttttctggtctcaatatgactgtcggttgattaaatatttcaactctgctttatgttatggtatttttcacaagtgaaaccagttcattggatttatatctctttatatataaatgaaatggaaaactgaggtaattatccaaataagtcaagatgtataagctttttgtccaattaactgggtataccaggtgaaaggacgatttttttttttctggaatgatttagataattgctcaaatttttaactttgattaagccatctcaaagtatgctcatgaaagctgatgtttatacacgtttaatgcataagacatgtgagcatttcagactttaagtcaggtgctttactgaattggatacccatgaataaaatattgcaggaggaaagagggtaaaaagcactatgggacaacatcaaacataaaattagcctttctttagggctgtgtacttgcaaaatgttgaataaagtgtacttgtcactgagattccttcactgtattttaattatgtatatttaagtacagaagaaaaacatttagcaaaatagaaattacacagtggaacatcaacagaatttgaaaaggtgtcatgagatcagtgattagttattggaccaatttgtttcacatgaatgattaatgtagcctgatgagtatctataggagtctttccttcatttctcaaaggaatatgtaatctgaattctattgataattatggatgctttggctaccagagaactgtattttcagatatttaagtatattttaaaagtttttaagtgaacttaattctgtggttactgaagtgtcagtgattctaactttgcttgaattaagaactgagagtaggccaggcgtggtggctcacgtctgtaatcccagcactttgggaggccgaggcaggcggatcacttgaggtcaggagttcatgaccatcctggccaacatggtgaaatcctgtctctactaaaaatacaaaaattagccatgcatggtggtacgtgcctataatcccagctactcaggaggctgagtcaggagaatcacttgaacccgggagacagaggttgcgagtgagctgagatcacggcactgcactccagcctgggtgacagaatgagacgccgtctcaaaaaaaaaaaagaactgagagtagagtgttgcgtcatttaagacttcattatgttgaaaagtcaggaatgataaaactagatggtcagtgggcacatactagttttgcagtacaattccagagtatcttttaaaactagattgggaattggctgggcgcagtggctcgcgcctgtaatcccagcacttttggaggccgaggtgggcggatcacgaggtcaggagatcgagaccatcctgcctaacacggtggaaccccgttgctacttaaaatacaaaacaaattagcggggcgtggtggcaggcacctgtggtcccagctattcaggaggctgaggcaggagaatggcgtgaacccgggaggcagagcttgcagtgagccgagatcgcgcctctgcactccagcctgggcgacagagcgagactccgtctcaaaaaaaaaaaaaaaaaaaaaaaacctaaattcggaattgtcttgaattttcatagtcctttcgtacagaccaaatctgacagctctaccttaaagagccccttccctaaaagagcagaaggggtttgactgctctctggggatcgccttcttttcagcaagacactattagccctggcacagctggtaaaatagagagctgtcgtgaatgaggcacacatctcacttggtctgtgctcccttttccagatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacaggtaagtcccagtgacactgtgcaagggaatgacaggctcctctcaaagacctgcacccacacagctttgggataaacgctgggagtgagataagaagcagccagatgtcctgacacagtgctgtctctggaagcttccatgatcttctgtgcctgccttgtcagtggaattaagatgtgggtgatgactctttgggctagatggcctctaatgttctatccaaaccagagatgcctccagtaaggtaaaggatccaaaatgatgaggacatttgctggggattgcttaaaacttagagagctatcagctcaggatttaatatggcaccatctcattaagttgcataatcctccatacgttcttggcccttagagaaatgtgtcttgacacttctctaaattaaaagcaacatataggcctcttaggatctacaaagacttccacttggaattcttaaggtgtttttccagaatttggcctagagagtagctatgtttgcattcgcttaaaatttgatttaggctgtgtcgtcactgtgcaaactgaaatagagagttggactgttttccagataaattaatcaacttcccaatcacccttttaagtttgtgccatgtagctatagcttggttgtattttagggaaagcaaaggcccaaatggtcctttgagagccaagtaaaatgaaacatagaccatttttttttctttctcagtcagttttatccatgcttccataatagctttcactactcctctggaggatacacttgttctgtgtaaaatagctatctttgcaagtaataggaaatgaaatatgaaaatattttcacccacacatatttcctcagttattaaatatagaaaggtgaagggtatagaattaaatgaacaggctataattcaaaaaccttgtgaaagagaagagacaggttattactggtgggaggatttctcttcattcaagtgaccaccacaacaatacatattccataaagaagagacttttcattttaattggatctacaatagcaaaaaacaaaccaaaaaacaaaaaaatctggttggccactaacagaattggttaactaagtgtctttttcttatttttgtttggttccatagggtagcacctcacctatagtgttattttgaatgaattaattcatatatcataatatatagccattaaatggtctgggtgatgcttagatagtcatgataaagataaatgtatgtgatacaatgttaagtgaaaaaatacaggatattccaatgatcacactctgtagaggaagggagagtgagaatacataaaaaggtaattgttggaccgaaccaataactaattgagcttattcatttgtatagctcctggcagcttttccttttatcatgcctcaatttgtatagttgatggtgaactttgattatatggagtcttaagactgtcttatgacagtcttcatttttaaaaaattttctagcagtatcctgagagactgagtttagccataaacttcagcagaagccttctgtctgatttcatcagagtcaataattgatcagttatttgaaaaaggtgattaaaaactagaaatcataaaaaggtaacatcttctaaatttaatttttaactcaaaggatataagtacatttggccaggtgcagtggctcacgcctgtaatcccaacactttgggaggccgaggcaggcagatcactgaggccaggagttctagaccagcctggccaacaaggtgaaaccctgtctctactaaaaatagaaaaattagccgggagtggaggcatatgcttgtaatcagtaaggcagaggcatgggaatcgcttgaacacatgaggcaaggttgcagtgagctaagatcacaccactgcactccagcctgagcaacagagccagattctgtctcaaaagaaaaaaaaaaaaagtacattcatacaccaatctttgaagagaaaggctgtggtctttttttgtgtagaggttcatttgtggagtttgtgtggctatcctgcataaaccccatctgttatgtattacttacactttctttgtagaagggagtgagaatctaaagcctttttcaaaacaaatgaatgtaaaatccctctaaatttttacagtttttctcaattttttacacttgtccacacctaatttgacagcatttcttttactgaatcaactttatctaatctttctaaagctttaacttgccctagaaacagctcttctggttacattcatattgtactggttgatgtaatatttaattaaattatgtaagtacagtaatcaatacactgacacagaatgtttgagtgtatacctaggtgagtcttggtttgtgtactgcacagcctgtaggagcagaagtgtgtggacctctgcaagaatagccgtctggctctgagcattctcccttccatgagcatcagcagtgatattttacagagggcaagaaaacatcagttaacacaagttggttaaatgtaggccagttaagagagtttgtaccctgtccagtaaaagaatctgctattccacagaccaaaacattttaaaccaaatttaaataaaagtttttagactaggattcaaattaatttcattatatgcataatatactgaagctgagagctcatccgtcctgaaaagtacttaggaagggaaagataaatttccagtataggctatcacatttttattcagctataaaactcccccaggacaatctatattccaacaatgagcagtagcatgataatctgatgtggtatcatactgaaggcagaactagggttatggggtaggatattaggaaggcaggtttcaggtcagtatccagaagagctttccagtaactaacaagagctagtcagcaaaaagctgccccagaaaatactggagtgcttcccgcggaggcatccaagaacaggtgggatacccactggcagaagagcacccacttccagcagggtattgccccagatgaacctttaaggtactttggaactctaatgtcctagggtttttatttctaaactttcttgcttcccacatatatattttttaggtctgccttaatgttttttactgcctgggcctttggccactaatttacattgctgtgcattgcctaaaagcatctgaaaaagaagtaactaaaaaatgtccataccaggccactcatcacatttaagaaggtatggatatgaaatatagtctgatgctattatttccttagtgcctgtgataattgctcaataaaaactttatgtctttgggcactctaagggaagcagtaaatatttaatcttggcaactgcagccttcagaccttacccacaaaatgctgttcttttccttgattggtgtacagaggaaattctgtggtaggaactgcatcttattcttaaaacagaaggtataatgaaaagaatacaatgaaaaatatatatatattataatccatacaggtattctccactttaagacaagcaaacaaaatcaggaagtataaagcatataggttggggtggttagttatattataaagtaattcttcactttactcaataatttatcataggatttctttaaatatcagttttcgctaatacagttcgctaatacatcttattcccacatcatgagctatatcctagacttctgcatttagaaaccaccttagtgattttccagctcaacttttttatttataggtaaagacactgaggcccagagaaacatctgaaatgtcattcttaaggttatatagctaatgaatggcagaattggtccaggaacccaactcaggatcttctcacttcaccatttctaattttagggctgaggacaacaagacatcaaattcttctcaaaattggcttttctcattttgtttttcattattaagataatacacattaatcatagaaaattggcaaatacaaaggtaaatttttaaaaagtctcctgcagtatcaccatccaatatctgtcaccatgttgacctctggactctgaaaggacatccatattcccctgtctcaacagaaccgttttccatttgaccttcagtgcactgaaatcaggccctctgacttttcatctaagtgagccgtcagtgagcttctatatggtaaactccttagtctcatcccagagtcgtcttctgaaacatttgacagtggtttttcatcttttcccccgtctttgccctgtgattgatttcatgacattactgttccctgcatcctcctgcatcttggactagtcttttcctgtctcattctcaggttcttcttctcctgtccattccttaaataataacatcccaggcagttacatgcttagctgtcaaattatttatgttattcccctgggatatttcatctgctttggagtcaaccattacttatatgacattgcctgctaagtaaatatcttctgcccccacctctgttgtgagtgtcatgctcctatttccagctgcctattggactttttcttccagggtgtcttgtaagcctctctggctgacagttattcaaacctaaattaatcaccatttcctctccttgtgtctatttatttatttatttatttttatttttgagatggagtcttgctctgtcacccaggctggagtgcagtggcgtgatcttggctcactgcaacctctacctcccgagttcaagtgattctcctgcctcagcctcctgggtagctgggattataggagcataccaccacgcccggctaatttttgtatttttagtagagacgggatttcaccatgttggtcaggctgatctcgaactcctgaccttgtgatccacctgcctcggccttccaaagtgctgcaattacaggcatgagccactgcacccaactctgtctatttattaattgctagacatcgatactagaaattctgaagtcatacttttttttgtctccccattcgtcatccaagcagtccatcataatatcctgccagttctacctccagggtgtccttcaaatctctccctgttgcggatgctacttccctgggtcagtctttcagcatcacttacctggatcattgcagtagcctcctaccttctctcctcgcctctctcatcaattcctgctccacactgctgccagagttaatgttttcaaaacatagatatcggtttaaatcgttcagtctttcaactgcttaccactgctttatagcatgaagtccaaatgcattagcagggcagcaataccctttatcttctgtaatgtaaatggattgtttagctttccgtcctacactcctcatacctacatccaagcccatgccctgctcatggttaccccaaacaattacgctttcccaagatgatgactttgccactactaactctttctgcctactgtgccctcccccttgtaagcccttcttttttttttttttttttttttttttgagacagagtcttgctccattgcgcaggctggagtgcagtggtgtgatcttggctcatcacaacctccaccttctgagttcaagtgattcttgtgcctctgcctccctagtagctaggattacaggcctgtgccaccatgcccacctaatttttgtatttttagtagagacagggttttgccatgttgaccagcctggtcttgaactactgacctcaagtgatctgcctgccttgtccttccaaagttctgggattacaggcgtgagccactgtgcccgtcttcttgttggcctttcctgaaatatctctcaagcctttttaaaagtctgcttgactgtcaccgagttgtcacacattccccaaatccccaagatggaattacaggattctgcctctctgctctcaacacgccttgcttttgtggctaacagtctctgcgtcttattctctctgcatccactgcaaaacagctcactgctgagcacggcgcctgatggatggtagacactcggtaactgttgaataaattgcctctccacattagaagcacatgtccctttcataacccatccctcccattcctagctacttctacagaataaaaataatttttcatttttttaaagatttaataggggcacacttaagtggggaaatgtctattcacacttccgtgtaggaagtgctgcttcagattgcttgagttaaattagaagaggttaaattaaaagaaaaaaagaacatctccccactgtcaaggaacacagaatacaactcatcttggtagttctgacaattgaactcaaatagcatccctgttcccttcctagagaggtacactacaggttttgtgcatgtacgcctttttttttttttttttgagactgagtctctctctgtcacccaggctggagtgcagtggcaccatcttgactcactgcaagctctgcctcccaggttcacaccattctcctgcctcagcctcccgagtagctgggactacaggctcccgccaccatgccctgctaattttgtttttgtatttttagtagagacggggtttcaccatgttagccaggatggtctcgatctcctgacctcgtgatcctcccacctcagcctcccaaagtgctgggattacaggagtgagccaccgcgctcggccgtgcatgtacacattttttaaaggcaggaagccacatgtgacaatcagtcaactgttatatttggcagagtctgttttttaaaatgtgtttagttaacctgttaaataaatttaacattgaaagacttataaaaattatttctgattggaaaaacaaggacttttggtaggaaaaaaatattaaagaaagtaagaccacagtatttataatgcaaatattgtaaaaggccataaacctcctgaggtcgtattgtgtttttgtaatgaatctataccatatatgtaggtaaggctgaggaaaatacgttcatttgtttaaaaaaaaaatatctagtcaagtttcttcccacatccagcgatgcctcatgagaaggtatcatctttttggtatacaagacctactgcttttttaacattatctgcttgctatagatagtacctaaagtcatatctgagtttctgaaaagagatgtcagtgttttaatgaactgacatatcaatcaaagtgacaaactaaaactatacacacacacacacacacacacacacacacacacacacacacaccattgtatcttcatttatttttatttttttgagacaggatctcgctctgttgcccaggctggagtgtagtgtacgatcatggttcactgcagccttgacctgctgggcttaagtgatcctcccacctcagcctcctgagtagctaggattacaggcccacgccaccatgcacagctcgtttttaaaatttttttgtaggacgaggtctcactatgttgccgaggctggtctcgttttatcttcttaatactacaagatatactcacactgttgcattagaaatgcattttggatcctagaacttgctataaactaaacctgacgaggaatggtttgtacatttccttttaaacgtttccatacactttgtgtgtcactttggatgtgctttactcatgcatttatcctcgcaggccctcatgacgcccgagtgtcaggaatgttatgggtttgtgttgtgtgtcatctgcttgttcccccatctccatatgtgcttcctattctgactcatctcagtgtactattctctcgtttttctttctctgcagtacagctatcccttggtatttaagggggcttagttccagggcccccactgataccaaaatccacagatgctcaagtccctgatacaacacggcgtagtatttacatataacgtatgcacatcctcctgtatacattgaatcatctctagatgactcataatacataatactatataaatgacatgtaaattgttacactatactgttgttttatttgtattatttgtttttgtatgttttttattttttcaaatatttttgatctgcaattgattgaattcacagatgtgaatcccatggatacagagggctgggcccactgtactttatttggcttccaggagccccttcattcatccatttctgctcatttttcttccccctgcttttccactctagagtaatatccccgactttttcttctcctcaccctctcactgtcccaggctcattttctccaatctcttgtaatgccttcactagatgtcagctccaccaggcagccttccctgatagccttgtctacccatccctctgcagtgaggcctaggtgtgcgtgtgtgtcctgggagtgaagcctccagttcactccttaagacctctttaagagcaagaactatgtggagagatcctcttttaaagtgtttttatttttgtgcttttttttttctaaacttcactttgactgctttggcatgttttaccatctgaagttatccactttctgttaccgaacaccaggggtttggtctaggttctgcagctcactgcacagaaaaccaatcaccgagaccacaagtatttccaaggaagaaggctttaattgggtgctacagccaaggagatggtagctcagtctcagatccatctccctgatggactaaaactaggggtttatgtaacagggaagaaatgtaacaatgtgtaagaaaacaggagcaagggagggacagggaagcaatcgtgatgaatcaggggtcagcatctggttgtcaggatgtggtgatctggtgagtttcagttctttgatactttctttgagaggcctgaaagtcatttcctgagaaaggaactcagataaaacagatgttaagtttcaagctttaagatcagaaatgtctgccgggcgaggtgactcacgcctgtaatcccagcactttgggaggccgaggtgggtggatcacgaggtcaggagatcaagaccatcctggctaacatggtgaaaccctgtctctactaaaaatacaaaaaattcgccgggcatggtggcaggcgcctgtagtcccagctattcaggaggctgaggcaggagaatggtgtgaacccggatccactgcactccagcctgggcaacagagtgagtctgtctcaaaaaacaaaaaacaaaaaaccacatttctcattttccgagttcttgtgtgagaaaactcgaaacaaggcatatgaatttctaagttttccttgacatctccttgaaatattacagaattctttctcattaaaacattaatgcctgtagcatttttaaaataaaaaaggaaataaagtgtcctgggtaattctgctgaaagtaatttactgaacatcatcacacacacagagttttatccattgatctcttttcaggactataggcagcgtttctttgggggtaactatttactcatgtgtattagcagtgttactcttgggtcattgtaataattctgactgttaggaaaaggtacagagaagattagctcataaaaaccttcagaacacattgtaaatggaaagggagagcccatttaaaaagctcatgtccactttgaccaactacatgttgtagattttctcaccccaacagtaattcctaagattagacatgtatggggaaacactaaagatggaaacggccctacaagcaaatggcccacaccctctttaggctgatgaaccaagagagaaggagctcccagacagggcttggtataggtggtgccttcagctcaaacctactccttcctattcagagccaggggacatgattgcactatttgtggccttgttgctgaacccccagcagcagagattatctgcggccctcttcccatttatctcaaagatgaaaaaacacagagaataaagggcaaagcagaacaaacccatgctatgtgagataagaacctgagctccaaagaagggttttggggaaagtagtagacataggccacttggaaccgacattagttttctcttccgggaagtgaggatgctgtatttaccagcaccttctatctcatatagttaccctctggatcacatgaaaaggcctctgtaaaagttcctacagaaaaaaacatagaaaatgtccaaaaccgaactttcttgttgttaccggccacacctctagaataaaatatgaaaaacttgatctttttatgcaaatgtgaagccagcctcttcatgcaaattgaaaacttaatctgaaaatactgaaggaggagtaatatattttttagaagtctgtggcatgagatatgtagtacagctaatcttactcaaaatatctttaagaaaaagagtattcattttttagtgcttgccactttctatagctattgatttgaccttttaaaattagtttccaatatagaaaccctccacccctggcagcaatgaactaaactcatgtaggagtttctttaagaaattacattatcacatatttactgaccagagttttatcccaatagaaaaatgctctaggaagttaattacttaaagactaggaagatagggaaattgtagcttttcccagaatgacctttgtggactagtttttagaaaataatttgcatttctttccaaacagggtaagtcaagatgagggcttgactaaccctcagtttcagctgtataaacattgaactttcaaatgtcttagaaaataagaccaaaacttataacaaccagtgtaaaaaataattatagttacattattgattatttcccttatgggaaataatctctttctccaaaaaggcaaagattgttttatttcttagtttgtatgatgtgagtgtaacaaacattttagtaaacaaaacaatgtttaccatatatgtatttgtctatatatatgtgtgtgtgtttaaaatgcataaaattatatttaaatatatttcaaattttaaatttatatatatttataattttgacatgctttggactcgagaagcctatagtttctaattacctgtgagtataatcttcattgaggccttattacaaagtattccgttttgtaataaacaccatgacatacttacaactttgtacatgagggaaaaaaatctgaggcttcttttagcacaaaccatagaataaacccgattaccaaaaccctgttgcttttttgatttgtatttctcactattatttattaatagctagctacatttttggaccagctgaataaaataattgagcggaactggtagtagtaacaggctgacaatttattcaccatgttgagggagagattctaaaattttctatagggctcataattgatttaataacaatttaaaatacgtactcttagttttcctaagtaattccatgtctaagagcttggaggcccttctaacgaagatccgttccgttaagagtacgcaaagtgaatttcagtcctctgcacacttgaagcaagctagaccagatgagggaagtggcaggttttacccaatttcacacacaaggaaatgatttaaaaccacttcgtaaactgctgcatagaaatcagcatttgagtttttcctggacgcttgttctaggtttgcatttgtcatcagctattaatgctgacttacagtccaagctgaaatctgtcaaagacaaaataatcagagaattggccagaatcaactggatgagggatctttatattctcactgatgctctgtgttctgagaggagtatatatttcagaggtttgtttgctgctttgcttgcttttaatgccagaagaggaaagagaaagggcagtagcttttcggatagaattttatgagtttatattttagaaacacgtttactatttaatatattaataaaatttccattgtcaactaggccctgcaaaaataaacatataggaagctattgtaaaaataatttatttaatttccttgctaatataattatctactaacttcaaaacaaaggtaagtgtaagtatgtgtggacattaaactcttatcctcatcagtaaatgtcttccttttgaccttagagtttgagtcccaagaatctggaaatagtagagttctagtggcaatatttcattagaattaatctaagtaattattatgacagtagtcagcttcttatttgatgtggcattaaataaaaacagttaatacattcaaactggatcataggcagtaatttgaactccatagtatacaggagagaagggatgtgactactttccaagtctagtcacaaaatagtgatcattttttaaaagcacagacttgttcaaagatttcgtatctgattgaattcaatcaatttcattattatctgaaagtgggtggattttgttcttattgtttgtattctttcatatcgccttgttcgtgttttatcacacagagggttaagctgaatctgttagaatatgttttcctctaggacacagttgagctgggactagaacccagatttgaaattctaccctgaggcttagctggcactcattatgtcattcagtcatatatttgcaacaatttaagtagttagatttttcagtgatgaaaggttatttaataggctgcaggttacgacagtattttcctagttatcttctgtgcagtcttcagaaaagattgggagcatggttgattccaataactacctaagggttaaatattatgtgtgggctcagacccgtggtcaagtatttgggaaaatttttattgatttaagtaggtgttatagctcagtaacaaatggccctatgtttggcaagaaaaggagatatggaaactctactcacagccaaatctgcaagaataaaataattggttcacgtaaaaggaaatggttttgacagatttacactcttggggtatgttagaattccaccaaaactaaggattcaagtgcatttttatctcaaagtggaagaatctgacactgaaagtggaaagcattttctataaagcaaatgctattgacacggtcactctttcccccattgcattctctacttgttgtcttaggtagttctgatgtgtcctattgtcactctactttctctactccatttagatttagatgtagatgtagatcaacccaaagaagaaaagaaagaatgctactataatctcaatgacgccagtctctgtgataatgtgttggcccccaatgtcacgaaacaagaatgctgctgtacatcaggcgcgggatggggagataactgcgaaatcttcccctgcccggtcttgggaactggtaagaatccgcttagtggtagagtcacacttgtgtttggtcacatggtgtccctgggccttgaaatgataacactcattcccacagccaactcaaggcgacttaccttatagtgagtttcattcagggctagagccagcacctgcatcccatcttaatatgaatccttgaacttctcttcatcatcgtgtactttgacagtcaggttctttgtgatattttggcagaaagttaattcagttttattccactttaaaattaaaatcagtctttgttgctgacaatgatacagcattattcgtaactaaagcttgtgtattgaagctatgattttgtgtaattgattcttactaaacctttaagatactatacatcacagtagtggaaaaataatagttataatttcaagtaaagcatgagtaagaaaatattagtgaacttggaggttttttaaattaaaaagtgtaagaaaacctatgaagtcattagatttctttgcacttaatccatcattttttgagattgtactaaatttatttgctggaattgccttaaagttactgagtctgagaaagcaaaactgaatttgaaacatgcattcatggaagatgttgaatctttttttttttttttgtctcttctaaaatcagctgagttcactgaaatgtgtcccaaagggaaaggttttgtgcctgctggagaatcatcttctgaagctggtggtgagaactataaaggtcagaatcaagtggaaacaaattttcagcacattgtgtacatgtcagatattcaagtgaaaacatggcttgggtttcacagaattagagttctttttagtcatgaaaactgattacaaagtccttaattctaccattaaaagaaagtccccatggacttgcagtcagaacacaaactgtatgatgctcggagtttgacattgggaggtgaacttctgagtttctgtctcttcatccctgagataggaataatttctcaaaggttataatgattaagatatatatctgaaagtacttaacaaattctgtacctagtagatacttactaaatattttattctagatgcttaatagaaatcatatcaattatgatcatataaatttgaccactgtttgtctttatggtcatcaacaaagctaaggttcttgtatttttagactttatcctactgttgtggggccttttaccagtgtgcacaagttcataatgagaaatggaagagaagacaaccaaagtagacatgttttatgtatttgatgctacggttatataattctaaaataaatgtgcggccttttaattttggtgaatatccacatgtatgaatatttcctcattaaccactcacttttgacattttcatgatagagatattaccttttatatacaaagtgattttttttcctttatagtttaatactgaggactgctaagtagctgggaaacacactgtaaaatcatttttattgtccatttttggaaaactagtgtttgaataatatggtataattcagtagctggataagaaattccatttgtgttcttttaaatacatctatgatttggtccaattaaataatgagaagatttggtttataatatgtgttgaatggtttccaaattcacaaatatacattactatgtttttgcagggatgtagttaaatctcacttcatattaaggtacagagctttgatttcaccataaattcatcttctcttttatatcaaaataaattccttgtcttcctattttagcagtgctgtaaatggttggaagaagattggattcagatccaaccagccatatgttctaggcttgactttgccattttccatctgtgttaactttaagcaagtcatctatggagtcttcaggttgtaaaatgaggactagatgaccttagctctaaaatgctagaactaatgctaataatagcagtaaaagcaatagataacacttttgagtatctgcttatgccagagca

SEQ ID NO: 14126 - DNA, 18187 bp, Human
agacagagtctccctgtgttgcccaggctcgtctcaagctcctggcctcaagtgatcctcctgcctcagcctcctaaagtgctgggatttaggcatgagctaccttgcctggcctagactctgaacagttttagtgagataccataagtttatccaagtttcttctgtgttgtagcatatattcttttttactgccaaccaatattccccggtaaggatatgctacgtttgtctatccgttcatccagctgatgggcatttgaattgtttccactttttgactattatggattatggtgctgtgaaccttggttacaggttttttgtggatttctgttttcatttctcttttgtatatactgaggagcggaattgctggctcatatagtctgtgtttagcactttgaggaatgtacacgtcttcacatagatgtatgttttttgtctagaccataccctttttgtacaggttgaacatccgtaatccaaaagccaaaatgctccaaaatctaaactttttgagtgccagcatgatgccacaagtggaaaattctacacgtaaccccatatgacaggttataagcaaaattcaatcactttatttcatgcacaaaattattttaaaatgtcatgaaattaccttcaggccatgtatataatgtacacatgaaaaataaatgtttagacttgggtcccatccctgagatatctgattatgtatatgcaaatattccaaaatccaaaacaatttaaaatctgccacgtttctggtcctaagcattttggataaaggatattcaacccgtattatgtttatatgcctcttcagtgctggtagttgtagcttctgcttcctcatcccctcatttgagccgggtggcagagcagggcagactgctgccttgctcagacctaatcgttcagttctttcattgtacaagtattcattgagcagcaaacataagccagtctctctaagtgctgggatgtatcagtgaataaagaatatatgcctgctttcatgtgcttccatttttactgggggagatggcaaataaatgtaaagtgataaataacaaaggttcagtggggcattcgtagttcagcggcagaaatttcgtctcctacgcgggagactcgggttcgacttcggccatgcagtccttccatgcaggaagggctactacgtttctacccaacaaagttattatggctggacgcagtggctcacgcctgtaattccagcactttgggaggccaaggcgggcggatcacctgagatcaggagtttgagaccagcctgaccaacatggagaaaccctatctctattgaaaatacaaaattagccaggcgtggtggcgcatgactgtaatcccagctactcgggaggctgaggtgggagaattgcttgaacccgggaggtggaggttgcggtgagctgagatcgcaccattgcactccagcctgggcaacaagagtaaagctctgtctcaaaaaaataaataaataaaaaataaaggttcatgtaagttttgggtggcgatgagggcgttgaagcagttatgaccatgtagctaccatgactttgagatgcagtcttctcgcagtgtgcacaggcagcatggagggaggcagggtaccggctctccctcctgaaccagacgagctgttgtgttgccaatggaggttcagggagccagtgatgggacagctctgctcctgagctttgccacccacaggacctgggcactggaccttatgatgtgcttctctggagtgaagactggctgtcacctcagccccctctcctttcttctgctgccatatcattcttcacatgcctaccagccccctggaatctgcccctgcaccctcatcccttatatattttgcagagagcgtttagaggactggaagtgtggcatgtaatggtatctctgtttccaccccgcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtgagcactgggactggggacatggcagcacctcccagccctgttgacactccagcaggtggtgatgggactactactgcagccaacctcttgtttatccggcagaaatgagatctgagatataggggtgcaaaaagctgtgggatgaaaaggagtaagaaatataaaggaggaagtagattggaatcctgggtttcgctggtcagagaagtgatttggggcctttttgtctcatcctcaggtagctgtgaagatcattgacaagactcaactgaactcctccagcctccagaaagtaagcacatggcacctcctgtccctttttttttttttttttttttttttttgagtcagagcctcactcttgtcgcccaggctggagtgcaatggtgtgatctcggctcactgcaacctccgccttttggtttcaagcgattctcccgcctcagcctcccgagtagctgggattataggcacccgccaccacacctggctaagttttgtatttttagtagagatggggtttcaccatggtagccaggctggtctcgaactcctgacctcaagtgatccgctcgcctcggcctcccaaagtgctaggattataggcgtgaaccactgcccccagcccacctgtccctttctaaatctctcttctggggtcaatgatctactgaccccatttagaccttctcttgaattcctagtttaaattttctggccatttcgctcaccgtcccccaaccattccctcccatggctctgctaccttcggggctttggttggatcatctgtggtgactcctcctgagtgggcttcctggccataggcactggctcttgtgaagtctttctgttcattcccagccacttggcctacctgtctgacctacttcctgcatcttgttatcttctggcttgtggccagccctatgcaaaaacacatgtttgtagccactactagaaacacgtgcagctacttcaagatctggaatgatacaggggagtggctttagaaatacaagaataagaggaagcagggaacctgccggtgggttctgtgccagctaccttttagagaatgagctccagctcaaattttctgaacaaaacctagttctgttcatcttgtggcaaatcagatattttctccataagcatattgtggcagttgagttaggagaaggcatgattcgtgctaacagagtcagatagtgatactgggaaccttaggagtaagggctgaggattgttgttgagggcgatgctcatggaattagagtggatgagttgttctccggacatgcaaatagccagaaccaaggtgtttcctatttattgttacccctgggatcccttcaagggttcttcagttcagtagaaacattgttgtcatcatcagggtgtctctgcttgaagctttccaggaggaagggaaaaagggctgcttatgacatcctggctccagccccacagaagaagtcagcgtggggtaggccatttggccttgggagcagtctagcctgccatcgtaataatcgccagtccaccaagccatcttattcctgaccttgtttttctccctaattcttcttggttttctccctaattcttcctgactctctggaaggcaccaacaccagacaaatagagccattttcaaaaccttttgagactctttgttactaaagccagtctgattctggccaaaaatgtgatctcagcaatgatccctgaaaaatgaacattgaagaagctagccccctcaggggtctagacaagcccagaaaaccccaagttctcccagaagaatgtcacttccatgccaggtgagcagcctcaggggaagaagccctggcagctgcctctggccctatttcagagctgctccccattactgccccagagggtggtatccaggctttttgcctctccatccaaaatatctgttggaccagggaaaaaagtaagaaaaacctaggccctaataaagggtaaggtcagcattgggttcctgaggattggaaagcctttttcttcttttcctttctagcttaggaaagctctggggcatcattaaaggggaaacaaatgtattcactttattccataaaccatatcttgaattagggcttcccctacccccaacaaaaacaacaacaaaaactagttctgttctttgtgcaagtgatgaggcctgaaattacaaaaagccccacctccagttctctggcccccgcagaggggaaggagttcatttctgtcatctttctttatggaaatacatggtttggagcccctggttttgtttcacaaagagagcgtgagtgtgtggaggtggatttgattaaaattggcatcagctatatataggagtggcttcttctgtcaccaccctagaggcccaggaaggaaaggcctatcccctagaacagagccctctgactactgtaaatcagaaaatgatggggtccccctctggtgctctaccacccctttacacagaccaagctggggtgtgtactgtcactgaaccaaggcagcagctcggattctgaatattcacgcacacgggctcacactccctccagtagaggcacccagccaaaacctgcctgctgttttggggctggatttggtagacgcagcagagggcatggctggctcatcctgatgccatcccgggtagcacgtccccacagccagccctcctccagcttccccaacttcccagccacagggaaggccgtgcatgagctagacaaccaccctattttcttttccctgcccggttttggttttttgggaaaaacaaatcctggcagggactgtttggagagacctgatgggagcaagttgggcaggcatgacccctggtattttatcttccagctattccgcgaagtaagaataatgaaggttttgaatcatcccaacataggtgagcacaagttgttatttctttcttcttccccaacagcaaggcactgctttccagcatgtcatcttctccccgaggtgcactgccttctggagtctgcagtcttcaaggatacccctggggaagctcagctcaaaatccatctccccttctggcacactgggctgtctttagcagtttggctggcatgagaggaacttgttcttgggagtgggggatcatgaaaggaggggagactttcgttcctaggatgctcctggacatgttggagagcagtatgtggcccctgttgcttcttgacttaaggcttggccttttctcttgtagttaaattatttgaagtgattgagactgagaaaacgctctaccttgtcatggagtacgctagtggcggtaggtgtggaactgcctcttcctgttgtgcccccacttcttccacctccagccagctctgactgagatccctgcctggtctcttacaggagaggtatttgattacctagtggctcatggcaggatgaaagaaaaagaggctcgagccaaattccgccaggtaggtgtgactccctccataggagctaggcctgacctctgcttttggggtttgacatgtaaggataagctgcctgtctgtaagtggcccttggagggtactttgggctctgcttatccgtgtggcaggttagcactaagtcacagggtcactgctctgtcagcccctgtggcccaccctcaggcacccctgggttaacccttcttccttcctttcagatagtgtctgctgtgcagtactgtcaccagaagtttattgtccatagagacttaaaggtaaggcatgcacttctccttgtgcctttgagtgggagccaggttgttgcctcttggttctccatgataaaaccatcaataaccatcaggccctgagtgttccaggaaactccagcctttctttttttctttctttctttctttttttttttttgagatgaccagaaagcccctagggctgcctctgatagaggccttgtggctggacctcgggttccattctagcccttgagcaggggccctctgccatttcacctcttggcacatcaccttttagtgctgccaagcaaggcaggcacactccaggctttctcagtctttcaggcaacctggtagctgacccagggaagagtgctgaaagttccacagctgtatcccagctgctttgcaggcaggcacacacataccatctccatcaccaagatactcaagtttgaggacacctgtgggtctcttggctgctgagtcctcacagacatgatttgattaacctgggcctgatgctgaagctttgcacagctcacagggtctctgggccttcagatcccatctctcccatggctgcccacgtgaggagtggcctgcattgccttcctcctgcccagcctattcacgctgattgaagccctgccctgaaattggtggagaaagttctgagactgaagatgactttccgtttgttctcccattcccctcagctccttcctgcccagggccttagtctggtccacttggttccctgatgttttccatcttacctcccaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggtggagtgaagtgcaagctttttattgcttctcatttcctctcggcctctggtcttagccctgacctcctgcctttgccacctgtctacatttgtcccaagccaaagcttcagagaagggcttgctgaggtagcagcagtcaaaggccttctgcacctgggaatgaataacctcagttcctttctcgaaagatgggataaactgtgtgtgtgttcatcccccaaggcactccggattgcaggcctcggactggtcaagttagagggtacgagggtatttgacttcacttgcctctctggtgaggtgtcttgtccccaggctgtctgccttcttccatatttcatttatgtctgctttgccaggcttaagctctcaggatcttggatattaggtttcttcctttggccttggggtgatttcaattttctaaccctggatcctcctgcaggagctgcgggaacgggtactgaggggaaaataccgtattccattctacatgtccacggactgtgaaaacctgcttaagaaatttctcattcttaatcccagcaagagaggcactttagaggtgagcagtggagcccaactggcggaagggcctggggtccccacagaaactttccagctgagtttcttccccctgcccttttccttctctgtgctccccagcaaatcatgaaagatcgatggatgaatgtgggtcacgaagatgatgaactaaagccttacgtggagccactccctgactacaaggacccccggcggacaggtgaggctgtgccgggctgtgaggttaagcttgcctaggagttgaggccagtcttaactgtatgtccccctgtgcagagctgatggtgtccatgggttatacacgggaagagatccaggactcgctggtgggccagagatacaacgaggtgatggccacctatctgctcctgggctacaagagctccgaggtgtgtgctccccgctccattctctgacctggccagcctcactgtctgtagcacctatgcttctaacacctgttgagggcagaagctcatctctgagtaggtgtgctctctgctcaccaattttaagcctcagctttggtgtctaaggtcctctggcccattcactgatctccatgagtgaattaatagaaagctggtagggtcggtgtgggactgggtcagagtttcaatacgggtgagttgatctaggttagtctgcattgattagatgtgtctaggtcatcggctagcactactacattgatctagatatctttgtgtctctttttgtatctggaagtgtacatttctgggtgtgtgtgtgtgtctctgtgtgtgtctgatcggaagtttgagtctgttgcttttttttttttttttttttttttttgagacggaatttcgctcttgttgcccaggctggagtgcaatggcaggatcttggctcactgcaacctccgcctcccgggttcaagcgattctcctgcctcagcctcccaagtagctgggattacaggcatgtgccaccatacccggctattgagtctgttgcttctgtctagtgctttatgtttgggtgtgtgtatctgtgtgtgtgtgtgtgtgtgtgtgtgtgtgtatgtgtccgtcttcccgtctgtggatctggagactttgtgattgttcttctgcccatttgggttttgttcatcatctgagtatccccacatgaactcccagcctccctgccctgctctccctctggtggtgggatccttaagaggcacctggtgacacttggtataggcccatattgctctgtgttgaggggagtggacttgagtctggacatgtgttcttgcggatgtttgtgtctctgggtgtgtgggcttatgtattcctttctgagactgtgtttgtcagtgtctgtgtcagagcatgtgtgtctccagggtctcctccaggggggatgtattggtcttacaagtggatgtccggtatgatcctggggtgtttgagtgttgggagagggcggtatgtgtaaatgtgtccatccatagggatctccacatgacttctgccctcccttgaagctgttttctgtttctttcagctggaaggcgacaccatcaccctgaaaccccggccttcagctgatctgaccaatagcagcgccccatccccatcccacaaggtacagcgcagcgtgtcggccaatcccaagcagcggcgcttcagcgaccagggtaaatgcttttgggagttgtaggtggggactcacccctctccagagaggttacaggttctgtggggacttgggtaacacaactaagtttcagtcctggttcagccacttattagtagtgtggctatgggcaagccacttcccttccctcgcctctgtggaatgggggcttgctgggttgttggccagccctgtaggaaatgagcatgcgtggggctggcactcagtggaccccttggccttacccattcccatcctccctctggcccagcagctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacggtgagccgcaccccccgctctctccttccttcctgcggtggggcctgccctctccaggcagctcttctcttaattcagactctgttccctttggctactacttctgcttatagcaggaagcctcgctcccagcagtaaatgcagaatcctttccttaacctaccactgtctgcttcaggtggaagggacaggaagcctgttccatgaacctggggggagaacctggctgtagaccactttggctttctgatagaacgcttgccctttattccccacagaacagcgtcctctccaccagcacaaatcgaagcaggaattccccacttttggagcgggccagcctcggccaggcctccatccagaatggcaaagacaggtgagagacccgggccctgcctgcctcactccctaggagccatgtctcacagggtgatgtctgtcagcagcaccgtctcctgtccctgccagcgcattgctccctgctccctggagttccatcctggctgtgtccagtccagctttcccctcccctattccacgccattgcctcctccccatcttcctctgactgctacttgcagtttgccaagtgtggggctgaccgtggccatctcagctacatgctcgcttcttgaccacggccagggcatggcagctgccctcctctagacatgagcagctaaggccttgtgttgggggtcccagctcagggcagaaccaagagatgcccaccttgaggggtgtacacatagagggcgactccagccatccccatgagaccagagctccccagccttcaccggccgcatttcttggtgttgcattcctggctctatctcttctgagtttatgaaagtttcccctcagcaacaccccactctttctgtagaagaaactctcctgttcttaaaattcttaggaggccagtgcagcctggaggcagcggccccttgtctgctctccttcatttctgattcctcttcccaggcactgacccacctcgctgcttcccgacctcactcacctccacttctcagccccgcattcctcagttctgacttgcatcccgctgctgcccaggcctgacttctaccctgccagagctccccagctctggcccttcccctgcccttgcttcctaatccaggcctcccgccctcactcacccctaacacgggcctctccgctgcttttgtttcctagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccaggcaagtgtgctggggcagctggtgcacctgctgccctcagcccaccctacccccttgccccaacaatttcttcttcccacttgggggtcctgctgtgttcttgtcatcttagccacaagaaatgggtctgtcccctgcggccaggaagtggagggaacaaaaaagagcattaatgcccctcttttccagttctccctctcagaacaggtatgcaggaagctgtcctaaggctccaaagggaaacctttttgttctgaaccttccagggtttccttagggaccccggggatagtcggcatcacagggactcaatcctcaagggttggtccccattgccgccttgagggtccagtctgcccggctcccagggagcccgctgtctccagcctaaaccacactccacacaggggtccttccttgcctccctccctcccttcccaaaccatctccttccacttccacgagacttccttctcaccactgtcctcagtagtcacacccttccttctgtgtcctcgtgatggctgcctctgccctagcatccccctccctgtccccaccacagggtgtccaggtgcccagtgatggctgtcctgtaccctaattcgtccccctcaaccccacttctcttcccacagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggtaagcaaggagctttgggtggcagagaggctcaggccaggccttcctgctttactcggggtgggttgggggttgggggttggggtttgggacactctgtaccggtattgggtcctggggttagaagaggcttcaggaagcacaagaaattaggtctttgtcaacaccttatgtgcccaggcccacccctcttaggcctctccccaactcctcacaggcacccctcattctctggccccaagcagatggccgatgccgcctcctctctaggagagtgtgaactcagatgctaaaataaaagcccccccttctctcctgggttcccatggaaacttatatttggtgacgcagctgcaaagtcatgaggcatgagccaggctggggccagcaaggaaaattttgtcctggtctcttgcccctttgactgcctctcccactagttggttctgtttctggctgcaggcgcagccatgcccttctgcccgggggttttagggtgaaacctataaatgaaatcactggcgagggcctacagtggcctcttccctaacctaactccgatgtgccaaaggtttcctgtgttggacccagggtggggatctcttcacggggtttctcacacctgagcccccagccaccacagaggtgcagcttgaagtgcatccagccaactggctggcctcctgggatgctccgcatccccatcctgccattcctctccctgccttggagtagcagctcaggaagcagcaggggctttgagagaacaggctcgcctgcccttcctctacgtttcactccactctgctggaggagccaaagccactgccccatccgagccccagaatgcaagtgtgaggcctgcagagagtgtgggcaggtctgaaagcctgggactctagtctcgctgagcggctcttccgaaaatgggatgacccttgaacctgtaaagccacctcccccacctgcttatccacataccgtcttgttggttttttttttatttctttttttattttgtcttttttttgtttgtttttttagaaatctgtctttcaggtttgccagaaggtaggcgttgagcccgctgtgtgtgtgtgtgtgtgtgtgtgtgtctgtgtcctgtgtcctgcctccatcactaactccccttttctggctcttactctcctccatctgcttaaccaagtctgtgtggccctcctctctctgccatcttaaagggatgaagactgcctctgattgggcatcagcacaaggcctgccctccgtgcccccagtacaaacaggcagggctaagaggccacattggcccactcagggcaaatggctttaaaaatgagggccttccttgggcccacagttaacgcctgtcctcaagtaaggggagactgtctcagggaagcctccctttaagattgtctcctctcacccaccccaccccacccccactccctctcaccccaggttttggtcacaagtgttgggatcctttcctgccctttcccttgtcatgtgcatgcgctatgaggaagctccagggttacaagtgcatctgggatggtatcttgtttgttgtctcctgggtttcctgaacttcagagctatgtgacctcttccccgtggcctatgggatcgcaggactttggagacactacggggaccctggggccccaaggtttcagtctggctcccccagaccttaggagcttttgtctcacaaatggagcacagcaccccctcctggcagctcctgcagaactagccccacccacccgcacccctgccccagcacccctgccaccagcagcatctggataaatcaagcctcttctcctctaggctgttttctccagatatggcctgtctcttccaaagtgcggggagctgggacattctagggcaacggccattctaccccaagccgtagcaaaacaacaggagatctctgcacccttactcaggggtctcccttcacagtccccttcctggctctttcacccctggccttatgctcatcctctctgcaggcctcggggaccaaataccaagctgaagaccaagggccaggttaagagtgcttgttccccaaggctgtctgctcaggccctgcattgggactgggatgcctggcaggcacattggtgccacagctgatggaggaacgtccagacagggtcttcaggctttccctatcccctcctcctcccacccagctgttgactgcatgactggctgctgcctcaaggggccccagcagggggctgccccacagggggtctggagagagcagggagggtgccttcctcgcacagccgggctccctgctcgcagtgcgcttgtgtgcacccctgtgttggttgtgtcttcctgtttatttctatgtgctgctgctcttcctccttcctctcacatccttcctcctctgcaatccccagtttcctagctccagacacccatcttccagccaggagctggagaagccgctcagcggggccagacctcttccccacccacccaaccaaggtgtctgccctgccctgccccaccccaccctcatcctccctgcgtatgagcagatggcctggcaggccagcaggtaggggagttgggaaaggtcggaggaggccgccttttccactcagcagcaggaagccatccccaggtgcctaccatgcagacccaggccttggcactttgagtctcctgacaggcccttgcgtagccacggcccctcctcctacagagattcaaagcattgcagcccctttcctccaaaaggactgcagtcctgagaccctagcgtgtggctccaaaaacgcactcacacctgcaacccccagaacagcgcgtgagccctggctgtgggggagcagcctcgtgccgggccgtgtgctcagtgtgctcagtgaagtgcgtgcacagccactccccctcctcccccagagcagaggctccttctccccggcacagatctgggaatgtggggagggacaagccccatgtgctgggctccctgctggaaaggaatggttgagccgccagtgtgaggtgctgcagagccctgttggcttgccaggtgatgggcagagggccctgggcttgggtcctgcccacccactggtggcacctccccagacccactctcatctgggtctgtggcggcggaaggagcgagagatcccagcactaaactctccctcgctctgttttttgaggaacctgaatgaacctgaaagcaaagaccgagtggagacgctcaggtgagagggctggagccagcactggccctgcccgggccaccgggcttgccacagcctcctgctcctctcttccttctgccacttggctcttcctcccgtggttctgccctgtccctaccctctggggcctccctttcctcagagagtttccccttcccaaacccaattgcaggagttacgggcccttctcctcaggtctggtatattctggaagtcggagttctgggtcgggtggttggggctacagattcctacccctggactatcccacctccctgtgctcggaggctgctttctggagagagagtctgtgctcgtgctgttgagggcactggtgtcttccctgaccccaccccgcctaccccaaggctggcttctcctccccttcgctgtcctgagagatgggggttggaggactgccaccctccgcccccgcaggccaggggccacgcctggctgctcctgctccctcccgctctcctctctgggctcaggggctgtctgccagggtggctctcctggggtggggtgcctcagcccccccgtgacgcccgcctctgccctctccacagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgagctgcctcctcctgtctcttctcccagccaggcagggacccagtctcctgtgggcaagatgtggcctagcccacctgccttgcaggagagacttgattcctgtctggggccagtgctgggtgggcccagctccccacttacccacagggcacagacaggaagcaaagcccagggcccttgcaccaaaagggaaagaaaactcagtaagcttagattttattttttttaatttttaaaaaatgttgaaaaataaatccatgtctgcataagttcccaacccccatttctccaagtttctggaaggtgggcttggtgggcaccctcagctccttagcatttcccagctggcccctgaagacagagc

SEQ ID NO: 14127 - DNA, 18187 bp, Human; identical to SEQ ID NO: 14126

SEQ ID NO: 14128 - DNA, 40379 bp, Human
ttgtctcaaaaaaaaaaaaaaaaaaaaaaaaaaaaaaggcgcttgaacattaatttactaagcaggccatttttacttcctgcagaaagggtacactcgccagcagttttgccatgggagtataccaaacaaaggagacagggtcatttataacctgactcgtccaccccactgcttgtgtctagtttccattggctggaacggtgcctcacgttctgtatttgtcccgattggctagcaacttagaagtttttaaaagaggcaaaggtagaggagaacaaaggaaggaggaagtaacttgtggaatggtgacaaaggttgaaacaccttcaaataaggaagaggaacaggctatgacctaatgctttcttggaccactataagcatgccagggcaaatatttaggctaaattgtgagagctaagaacatgaagtacattgatttctttatcatagctagcagatatttaagaatgttagcacaggtctttgaataaagtttgcttctaagagaagttactatttattcctaattaaatggggaggaaagtctttgaagaggaacctctactttactttttataccgtcatggctggaaactaagtttttaagatttttctggggttcccttggccgaggtggggagtgggagggctgtccagtggtagggacttaggatttttagtttacagtagtaggggaaacactctgtaatctaatacataagtaaatgatgtattagaatatggtaaatataggcaagtagacccccactgggattagcagtggtggaaatgtgagagagggcaaacaggtgggtctagatgaggtgtgagcagactcgaggggcacaggagttagtcaagccagtatctgggggatagtgcaggaatagtgaacagctagacaaaaagtcctagggccagagaaagcaaaagcataagagatggaggccagagaggtaatctgggtggaaggctgcagcctctcaggatccctataggtgctttggcttttgttggagagacactgaacagctttgggcagtgaacgtacctgacaggtttcctgtttgtttttgagatgaagtctcgctcttgtcccccaggctggagtgcaatagcgcgatctcagctcactgcaacctctgcctcctgtgttcaagcgattctcctgcctcagcctcccaggtagctgggattataggcgcctgccaccatgcctggctaatttttgtatttttagtagagacgcagtttcagcatgttggccaggctggtcttgaactccagacctcaggtgatccgcccgccttggcctcccaaagtgctgggattacaggcgtgagccaccgcgctcggctagacctgacaggttttaaaaggattactggttgctgtgttaaaacagactgcaggatggcttaggtagccagtaggtttttttttttttttggagacgtagtcttgctctgttggcctggctggagtgcagcggtgtcatcttggctcactgcaaactccgcttcccgggttcaagtgattctcctgcctcagcctccggagtagttgggactacaggcgcccaccaccacactcggcttttttgtatttttagtagagacgggtttcaccatgttggccaggatggtctcgatctcttgacctcgtgatccacccgccttggcctcccaaagtgttgcgattacaggcgtgagccaccacgcctggacgggtagccagtagtttctagggctggagagatctaggatgagagaagtttccacattcctgttacaggctctctaaggcttcagctcctttttctaggactaagctggatctcaagtaaacactagagagggggcagctgaagctccaggagtgtgtggggctccctggggctggatggcggtggcgggcaggcgagctgggctgtgctcgggtgtgttacagtaaagacgcccagcttggcgctggcccggccttttcacggttttaggctctacagagagcggctgcagagctcacccggctggcaggagccaccgaggccggacacgtgggcgacttattgaccaagtggggaggaagcagccccgcactgctctcccgactgcggaccaccgttgggctcctgcgcatcctaagccccaccgcctcacctccagtccccacagcgttcgcgctcccagccggggtaagcggaagaaaacaaaggcccggctccatcagggcaccaatcccgctcgtcggcctctttctcggcctccaatgagcttctagggtgttatcacgccagtctccttccgcgactgattggccggggtcttcctagtgtgagcggccctggccaatcagcgcccgtcagcccaccccacgaggccgcagctagccccgctggcggccgaggccggttgaagtgggcggagcggcgggcggggcgtcgccgtactaggcctgccccctgtccggccagcccctcgaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggtgggccgagcctccctgcttgcccggggcggggaaggagctcgctgggccggcctcagggcctgagcggccgggcccggatctggggcaaggggcgcggcgagcagggccgacgcctgggtgttcccgtccccctttcctcgagccttccccctgtagggcccgggtggacgcggccgtcctggctgacctgtccctgcccccgcaagccgccctgggcatgagcgacttttgcgtggttcccggtggttgcgctccccgtttcgtcccctccgtgagcatcggcgcttaccggtattttaacccgagggttacacatctgaggcaatgtgggtgggttacgcgggagaggacgagtgagttttttggtaagcggaatgaactatgcagataacatcacatgaaggccgtttctggaatgaagtctgactcctccagtttcaccacctcttccggagctctccccgccttgctgccttccatcgcttcatcctcggtgcttcctgagttttaaaatcgcctatctacgcttccaagttccaatgagttatctaacgtctatggattagctaggtggttggtggaaggtcagaacttggttttacttagatttttatctgcctcatgcctgtactatttgtttaatgaatgcataggaggtgtttttattccaacaagaaaattattcgtacgcgattattgaatgaatagacaaattcagccaagttcttctggtctggaccagcctggctgatttctgtaacttttttgggccaacaggacagtagcaaatgtgactcaggccgaggcttgataggtgcctgaacatcggagtctttctttcagtgtccatgtgcttcagtaaacacactagaaaataaatttctggtttttgtccccagtagactacaccctcatttggtgttatttttcacgtgctatctttaatacaggtacatccttcagtctatttgtagaacattcagttttcttcatcttttctttgccggtgctacattatttgaattattttgctacagaataacttctattatttgatatggcagatgtcactttttatatttagatatagcattcatttatttaacaaatatttgacgaccagttgtatatcagatagtgttctaggtgctggaggtacaacagtgaacaagctaggtgaagaccttgattttataaaacttactttttagtggaagagagacaatttaaaaaagcgaatgtacagtttttcacgtggagaaaagcactgcagaggaagatactagcagggcaagggatctgagtgcagtcagacctcatttgggtccagacttcattcctctatgtctctttcctttctacagaaagactgttagagaaaatggtagcattggtttcctgttgggagggaaagtgggtggtcatggtaagtgggtagagaaagacttcacagtatactgtttttgtacattttgagtttttttaaaagcgagacttgagctattctagctctgataatatggtgcagtatttgttatgttagttgtagtctttctgggcagtttttacatccccatgagccgttaaaaaaatacctgaacctttaattaggggaaataaattggaaaaatacatttcccttcacttaacattatcttagtttctctttttttttttttttttttttgagatggagtcttgctctgttacccaggctggagtgcagtggtggcgggacctcagctagatgcagcctccgcctcctgggttcaagcaattctcctgcctcagcctgctgagtagctgggattacaggcacctgccactacgcccggctgattttttggtatttttagtagagacggggtttcaccatgttggtgaggctggttttgaactcttgacctcaagtgatctgctcgccttggtctcccaaagtgctaggattacaggcgtgagccactgcacccggcctttttttttttttttttgaggggggggtctcactccatcgtccaggctagaatgctgtggcctgaacatgactcactccagttttgacttccttggctgaagccatcctcccacctcggcttcctgatcccgagtagctgggactccaggcacgtgtcaccaatgcatggctaatttttaaatttttttgtagacacaatgtctcgctgcattgcccaggctggtcttgaactcctgagctcaagcgattttcccacctcagccttcaaagtgctgggattacaggtgtgagccactgcacccaaccagtttctctctgcaaactagggaaaaaatttacgcttagcagatattgagggctgattatttctatcacagaagcatttggctatagaatttcagggtttagtaaacttgatttacactgaatttttaggtgcatatcagtaaatctacgggcatatgccgcctgcaagttgtgtggcatcacccaaaagccgagagtaatggaaagagcaggctgttagtaatcaggcagatctggctcctgtccaatctaaatcctgttatttagactaatatcttaagtctgttattaagtccgatttctgacgctattaagttaggtgaacaaccttggtaacttaacctctgaaccacagttacttcatctgtaaaatagggatgtatgtatggtaacgattttttaaccacaacttcccaactctaagatggtctgaaaagaattttttgagtgtttggctcagaatcacttggcagcaaaacctgacttgaagttgaggcttcattcatcccacttagtatattcaaatgttttgctaaagaaataattatgaggtgctacttcacactgactagggttgtatatgcattttattgcctattttctaaaacactaaaaatgctaaattctgccccaggtcttgccacagatgtttcagtggactatgggcctgtgagaccttaaagggttgattgagtaaggatcacaggtgatgtccgcattgtgcttggcatggagttaagtgcttgataaatggtggttatcaatctgattatgtaaatttatgtaaattcagttctcaagtttgtggtttttttcccctcctggagaaatctattctattttaaagtgaggaaggctccgtggagggctggtagctggtagctgttcacttgtggaactttcagcctgaggctggagccccttcctgggagtctggtcttgtcgtcttcctgaccacccccacacccttcctctaaattccctccatccctgtttttctcccgcttgcgagcttttgggagtgtgctgaatctcagactgcaatagataaacccaagagggacaggcaccagtagcctgagcttgctttctcccctggctcatgggaatcaagcagtagaaatttttagtgagtgttgttttccatagtatgcttactagttgtgtcttcctgttttgttcttggtgatttgaagaaacctgtttacaaggtaagggactgaaacaaataggtgacaggaaaaagagcagcaggggtacgagctggaggagtaagtggcttggcttgctctctttcagaatggagggctgtatggaaaggaggggtagtgttcttgaagagtgttggggtttaaatctagggggaccgtgtcttggcattgattgaaactcctggcttaacatcaccccgaaactgttagttggactgaacatgacatttggcagtgcagttaaaaacacttcctgctgtagcctggtaatggtcaggctatgtgaagagctgctctggagctcagtccagagcgggtattctgtttctttcactctgaaatcctgcctctcgatattttgagaaggaaggagttggtgaattgttttaaaatcctcgatgaatgtcttcatttattcatgacaccacttctgaatatatttatgtgccagacgctgaagtttactaatattatggtgcccagtaaatacttgtttttactaatattttttatggcaataaaatgactttttcaggattatgtgatttaaaagattgacccttttggcaaaatacgtattcatgataggaaatatatacaacatagttcacttaaacctcccaccagagcccagggttcactgttaccattctgaagtgactggaatttcctagaagtggatatgccatatttttttaaccactcctattggatatttgttttttatttttttgagatggggtcccactctgcagtgtacaatatcatagttcactgtaacgtgtatctcctgggctcaagcgatcctcccacctcagcctcctgagtagctagtcttcagtagctagactataggtgggcgccaccacagctggctttttaaaaaattttttatgaacacgaggtctcactatgttgcccaggctgccctcaaattcctgggctcaagtgattctcccaccttggccttccgaagtgcagggattataggcgtgcgccactgcacccggccctgttggataaatgattccagtctctcccaaaaagaactgttgtaagactgtggggtgaggggagggaagggacaaataggaacccgccgtattttccactccctgtgggcctaaaactgctctaaaaaatagtccatgaaaaaatacatagtacaaacagcaactctttctgatatgcttgcatttaaaatcaggctttttctcccttttggaaaaacacagtccttgtttgctttagggaagagtaaaggtcagtgcgctgcattgcattaatttcgaagggaaagatgagaagacatcttgaaaggaatggctggctttctagagaatagtagaggcttaataggtgtcatagaaaaaccagggttggacagtggtagtaaaacggcaaaacagattttattcagaaaaactactgcagtaagaggagagagacctcggtacagaactgctccactgcgaatacaaagaaaagtaggaattgatggcgggggagccggatgtcagtggatggaaaattattacgaggaaacacaggggtgtgcattcttgctgaaggcaggccagagttatcagacatcacctgagggatggagggggatgtggaacctaatcggctgtctagggtgatcagatactgaagttgggggattctggtcaaatcaatttagcaggattcttggtaaaactgggcgatgcaaagacagatgcgttgagtacaaagtccaggccttattgggaagaggatttcagcggagcccgagtagagtttggtctagggagactctgtcactgggaggacgagcgagccgctcggaagtgcgctgggttctcttagcggccagtgggttctggtgagaagggcaacagcgggaggaggcgccggtgcggagcgggaggccgggggcggggctgcggggctgcggggcgggcccgttgtgggtcggcccagcgcgtattcgagtagagggcgagcccgtcccgcctctcgtcgggcgcttcccagatctgcttgagtctatggaggaaaaactccgcggggtccgcgattcccatggccgcagccgcctgcggcaccaaggccatggccctcttcaagcgcaccttggtgctgagtcccgccgcggcgcccaggggcccgggcgcaggcaccgccccgcggggctgctgcttgcctcctgccgcctggccctgcaaggactggcctcggggagagggcggcaggctgtggagccgcctgccccagtcccactcccactcccactcccactcccactcctgctcctcgacgtctcccaccgccgtgtgtgttgtctgcccgcaggactcgctcagcagcagcctgaaaacttgctacaagtatctcaatcagaccagtcgcagtttcgcagctgttatccaggcgctggatggggaaatgcggtgagtgatggaggcagcgcctctggcttggaggaaagcttgtccgggacttttgagtgtgttggaagctaccttttgatatagcgctcagcgttgcagcctcgttgctgtggcttatccagaacatagcccggccctacgtgtttactttagaaagcccttccaggctctttgccatctagtagagtccctgcgggcccagcctttcagagaagaggggggagggggtgatgtttattaactttttttagtcttggcagctgaacctgcctgtgagcaggtcgtgtatttctcggcttcccttatccaactttgcatttctatttctagcatattgggttgattcttttgaagctgcctctgtgcacattacacccatgaacttagaccagttgcctttatgtatgatcgtatttatactgagaagttactgtgttttttgactttcttttctatttgctacatattagttcggtctaaacgtttggtcttctggtctccatagttctacattggttaaatgcaactcacttctgggagtagtggtgacattcaactagtaggctttttaataaactacagaagttcattactctcatgtaaggaaggaaaactaatgtaactttcgttaagtatgaaaagcgttggatatccttatagttctttagagttaagggtgagatgggtttagaaagtggccaggcacaagttattttaaaataaaaaatctttggctgtttgttccaatatattaatagttttcccttttttacagcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacggtgagtggggttacgcatcttgtctacggactgttgtgttcataattgctaacgtggttgtccggtagcctccatacatgtggagaaaggttaaataagcattctgagggcagcataatgtgagggttaaaaactccggtagccaagactctgaagccaggctgcctgggttggaatctcaaatctcccacttactaaactgttggttacttacaaagactctctgtgcctcagtttcttcatctgtaaaataggggtaataataacacctacctcatggtattctgaggattcaaagaattaacgtaggtaatgctcttagaatgttagctactgctgttattatcagtattggaagtccagtgtttcttcctgtgggaagacgcagtcaaattttagtgttgtgaaagattctcaggctagctcacaaaagcctgccgactgtatgatgcagcctacctgtaacactgctggcctcttgactacccggagcctggtagcatgggactgctgctcacgatgggcagcagcctggcatgggggcggtgtctgttggcagctagggcgagcctctgccacttcacctgtgatcctgggcaagttccttatctgctttgtgtctccgtctcctcgtttgtaaagttagagctgagaggattaatttcgcacatataaagtacttagtgcctggtacagggtaagtattctgtaagtattagctatttggtctattttgttggagtaaagtgggttatagttaaaatcctaagatttttaaagtccctcaagttcatgtggacatctgcctaggtcctactatcctagaattcgcatgtcttatcacacaaataactgattcttccatatcttataaataaaggtttgatttagcaaagtcacatgttgtgtaatagctcgaagaagccctttttgtccacagttgccagagcttttggagaacagtccttatgttattgaaacaaacctaatctgtagctgagttgggagggagctaagtggacagagagtcctccacccaaacaaaagaatctttgattcttgggcataatgggagcaatatttaaaaaaaaaaaaaaaaaaaaaaaaaggaatgtttggggaagactcttgcggtgcaaaggctgtttcagattgctgagatcagaccttaagtaccaaagcccaaatatagtacaacataatacaaatgagaagaaaatagctgaagaataattcgagtttatacagtacaattcaagagaagaaagaaaatttatgacgactagctgggtgagaattagaactgtaaccctgggaaggtcctggtgatttgactctcacaggacacctgatgaccagaggatgggtttcctttgatgggaaatctgtggcgattcattgatgggcctctgaattctgctgaagcagaggaagtagtaataccccatttataatggaagtgcattctcacttaaaaacaactaatattattctagctggacctagcctctagaaacagccaaattacatttgacttgagtggattcataataattaaaaaatttctggggcatgggataaatgtgttaggtattgctaagtcaaggcagccctatcccctcagcagaagtgagggaatatgaaagtgtgtgaatgctaacataattttggggaatatcgccgtcagatttccagatgatattccaacatgtttgtgaaacttcagtgtcttcctgtgttcatacagtgttccagtggaaaaataatgcttagttctggaaggtttcagatgtgaacactgaactcatcgttttcttttttgggtagtagagttagagattccatcctcttgaaagcacagttgccccgggaagagtaaaagggagcagaaggcgtaagccaggcacggctgttttcactgttgttcaccttttgtatccttacgaatatgaagatgtactaagttgtgtgttttgcgtgcatatataattttaagctacttgagttgtaggtccctccagtctgtgattcagtttgagatgggactgtatgggaattaacagtgccttgtcttcttaagcagtgatttgtgtatgtgctgatatagctcagtatgtctttgaaaccagttgtctggggctaggcctgcaatcagcttttggctaagaggtcccaggatggaacaagtagtgtgaaagaggactgataccttggcctcacacacagtactgctcttagactggggcaagtgaaactcctcacttcagagtgccccattctaggccccctcactcccaaaggggtgagggatcactggggccatgggaatgtgcttgttcagctctcgtgggctctccttctgtaccacgttctggacatctggagttccttgccccaaatccctgagcccacgtctgcgtccgcacagtctatttcctaaggtcagtccatctcctccaggtgggaacgtgccaccattgactgtgcccttgggcctgagtgatggccaagggctgtgttggggagtgttgtggatggatcctggcaccgagggctgggatatcctctcaaatgaatgtgaggtgcctcccagtgctggagagagcgggattcaggaagcagtggaagggaagagcctgggatatggggatcagctgtctgtgccctgctgcattctggaataaaactctgagggactaagaattctaaattcaaacctgaatcaaccaggttgttacaaagataagtttgtcagtgcaggaggatacaatatattttacttaagttactagctcgattgatcatttttaaatttttagctacatatagtatgtgggcctccatttgtcctcttatcccaggccttgcagaatttaggaataagcctcaatacagtgttctaacccagtgacttccgcctcgatgtacagtagattgaacctgatcctttatactttagtgatcattagttgataccagttcaagtcaggctttctagaaatctcattgtatgttaggggttcgattagagtacagtcatgcatcacttaatgaatggccacaggatacattctgagaaacgcattgatagatgatttcatcattctgtgaacatcatagagtgtacttacacataccaagatggcatagctactacagacgtaggctctgtggtacaggccattgctccaaggctgcacatctctacaggatggtactgtactgaatactgtaggcaattggagcacagtggtaagtatttgtgtatttaaacatagaaaaggtatagtaaaaacagggtgttacagtcttaagggcccaccattgtatttccagtctccgttgactgaaacatcattatacagtacatgagcacgtatctttctcacctggtactagtggaaagctagaaggcttagaagtctacctgtaaacatagcttaagtaataatacagccttatttttaaatgataatagcaataatagtgttcacttattgagcattttactatgagttacttactaaatatatttcatcgttaatttactctttgtgttatttgatctataacatcgtttaacagggaaattacctagtacataatgtactgttatctacattttatctagatgaggaaactgaggcacagagaaattaagtactttgcctaggattacccgtgaagttaagtgacagaatcaatgaatctggaaggtctggcttcagatctcttgtgctgagtcactcgcatactttactacctctaaggtttctaatcagaggaatttgtatctgtattccctgctactcttaccctctatgtgggatttggcctttctccattatccctgtgaactcgctctgggaccttccttcttgtacttggaaccatcagaaagtgatctgagaacatagaaatctactgtgttgtgaaacagaattacctggaagcggaaaaagccctcctggctcaattcacatgtcacggcttatggtcgtatccggggaacatatgaaactgggcactgagtgcggagtcaggaaagccctgtccatcctctgggtttctggggaaaacgtggaccccttcattgtcactttctcctgtatatttttgtttttacttttagaactgtacaattacgtaataaataataaaaagtcgttggaaggataggtgaagttcagaagtgaaagtgttttggaggagtctaagctccttcccaccctcattgacctttcctctctaataaatagaactggtctaaccaaggatctgtggaatgagcagagtccaacggagattcagggattctaataacctcttgtagaatcactggtttgtttcagccacaagaaggaattaccttttgacattggcttgaacagctgttgtgcaaagaaaaactttttggaaagttctggaagtaccagattgattttataggtttttttttttttttttggagggacatgggggtattgacagttgatgttaatcagaaatcctaaattatgtgtattcctggtatgttgcaatcagccggccacctggttttcctctgggctcttaattttaggtgtattccgaggaagtttttctaacttttctgtaaacacagaccaggtatattgcatactttcaatgtttaaccaaatctcttcactgtttgcagtattatctgtaggctctcatgttttaagacttcccatggtgtttttgtattgtattttgctaacctataaacaattctttgaacttaaaacaagatatttgggcagtaacaataaattttaaaaacatcaattcaacttttttacattagggcttggactatggaaaaagtattgggcagcatgcctcatactgagttgtttaatgaatttaaaagtatagccttaatagtgagagaaactctatagcttcataatataaattgggtaactaatgagataaaatggttggcagatctgctcactagaatctaagctcttcaagggtctgagtttttttttttctttttcttttattatactttaagttctagggtacatgtgcacaacgtgcaggtttgttacataggtatacatgtgccatgttggtttgctacacccatcaactcgtcatttacattaggtatttctcgtaatgctatccctcccttggccccccaccccacaacaggccccggtatgtgatgttcccctccttgtgtccatgtgttctcattgttcaactcccacttaggagtgagaacatgtagtgtttggttttctgtcgttgtgatactttgctcagaatgatgatttccagcttcatccatgtccctgcaaaggacatgaactcatcctttttttatggctgtgtagtattccatggtgtatatgtgccacattttctttattcagtctattattgatggacatttgggttggttccaggtctttgctattgtgaatagtgccacagtaaacatacatgtgcttgtgtcttcatagttggacgagttataatcctttgggtatatgcccagtaatgggattgctgggtcaaatggtatttctagttctagatccttggggaatcaccatactgtcttccacaatggttgaactaatttacactcccaccaacagtgtaaatttagtcctgtttctccacatcctctccagcatctgttgtttcctgactttttaaatgatcgccattgtaactggcttgagatggtatctcattgtggttttgatttgcatttctctgatgaccagtggtgatgagcatttcttcatatgtctgttggctgcataaatgtcttcctttgagaagtgtctgttcatatcctttgcccacttattgatggggttgttgattttcttgtaaattttttttaagttctttgtagattctggatactaccctttgttggatggataaattacaaaaattttctcctattctgtaggttgccttttactctgatgatagtttcttttgctgtgcagaagctctttagttgaattagatcccatttgtctagtttggcttttgttgccattgcttttggtgttttagtcatgaagtctttgcccatgcctatgtcctgaatggtattgactgcattttcttctagggtttttacggttttaggccttatatttaagccttcagtccatcttgagttaatttttgtataagatgtaaggaagggatccagtttcagctttctacatatggcaagccaggtttcccagcagcatttattaaatagggaatcctttctccattgcttgtttttgtcaggtttgtcaaagatcagatggctgtagatgtgtagtgttatttctgaggcctctgttccgttccattggtgtacatatctgttttggtaccagtaccatgctgttttggttactgtagccttgtagtatagtttgaagtcaggtagcgtgatgcctccagctttgttcttttggcttaggattgtcttggctatgcaggctcttttttgcttccatgtgaaatttaaagtagttttttccaattctgtgaagaaagtcattggtagcttgatggggatagcattgaatctgtaaattaccttgggcagtatagccattttcaccatactgattcttcctatccatgagcatggaatgttcttccatttgtttatggcctcttttatttcattgagcagtggtttgtagttctctttgaagaggtccttcatatcccttgtaagttggattcctaggtgttgtattctctttgtagctattgtgaatgggagttcactcatgatttggctccttgtttgtctgttattggtgtataggaatgcttgagattttttgcacattgattttgtatcctgagactttgctgaagttgcttatcagcttaaggagatttagggctgagacgatggggttttctaaatatacaatcatgtcatttgcaaacaggcaattttacttcctcttttcctaattgaataccctttatttctttctcttgcctgattatcctggccagaactaccaatactgtgttgaataggagtggtgagaggacggcatccttgtcttgtgcaggttttcaaagggaatgcttccagtttttgcccattcagtatgatattggctttgggtttgtcataaatagctccttattattttgagatgcgttccatcaatatctagtttactgagagtttttagcatgaaagactgttgaattttgtcaaaggcctttcgtgcatctattgagataatcatgtggtttttgtcataggttctgtttatgtgatggatgatgtttattgatttgtgtatgttgaacagccttgcatcccagggatgaagccgacttgatcgtggtggataagctttttgatgtgctgctggattcaatttgccattattttatagaggattttcgcatcaacgttcatcagggatattggcctaaaattctctttttttattgtttgtctgccaggctttggtatcaggatgatgctggcctcataaaatgagttagggaggattccctctttttctattggaatagtttcagaaggaatggtaccagctcctctttgtacctctggtagaattcggctgtgaatctgtctgttcctggactttctttggttggtaggctattaattattgcctcaatttcagagcctgctattggtcatttcagaggttcaacttcttcctggtttagtcttgggagagtgtatgtgtcgaggaatgtatccatttcttctggattttctagcttatttgcatagaggtgttgatagtattctccagtggtagtttgtatttctgtgggattggtggtgatatcccctttatcattttttattacgtctttttgattcttctgtcttttcttcttgctagcggtctatcaattttgttgatcttttcaaaaaaccagctcctggattcattaattttttttttttgaagggttttttgtgtgtctgtctctttcagttctgctctgatcttagttatttcttgccttttactagcttttcaatttgtttgctcttgcttttctagttcttttaattgtgatgttaaggtgttgtttttagatctttcctgctttctcttgtgagcatttagtgctataaatttccctctacactctgctttaaatgtgtcccagagattctggtatgttgtgtctttgttctcattggtttcaaagaacatctttatttctgctttcatttcgttatgtacccagtagtcattcaggagcaggttgttcagtttccatgtagatgtgtggttttgagtgagtttattaatcctgagttctaatttgatttcactgtggtctgagagaaagtttgttgtaatttctgttcttttacatttgctgagcagtgtttttcttccaattctgtggtcaattttagaataagtgcgatgtggtgctgagaagaatgtatattctgttgatttggggtggagagttctgtagatgtctgttaggtctgcttggtccagagctgagttcaagtcctggatatccttgttaaccttttgtcttgttgatctatctaatattgacagtgggatgttagactcgcacacaataataatgagagactttaagtctttttctaggtctctaaggacttgctttatgaatctgggtgctcctgtattgggtacatatatgtttaagatagttagctcttcttgttgaattgatccctttaccattatgtagtggccttctttgtctcttttgatcttagttggtttaaagtctgttttattagagactaggattgcattccctgcttttttttttcgcttggtagatcttcctccagctgtttattttgagcctatgtgcatctctgcacgtgagacgggtctcctgaatacagcacagtgacgggccttgactgtttatccaatttgccagtctgcgtcttttaactggggcatttagcccacttatatttaaggttaatattgttatgtttgaatttgatctgtcattatgatgtttgctggttattttgcccattaattgatgcagtttcttcctagcctcgatggtctttacaatttggcatgtttttgcagtggctggtaccagttgttcctttccatttttactgcttccttcaggagctcttttagggcaggcctggtggtgacaaaatctctgagcatttgcttgtctgtaaaggattttatttctccttcacttgtgaaacttagtttggctggttatgagattctgggttgaaaattctttaagaatgctgaatattggcccccactctcttctggcttgtagggtttctgctgagagatctgctgttagtctgatgggcttccctttgtgggtaacccgacctttctctctggcagcccttaacattttttccttcatttcaacgttggtgaatctgacaattacgtatcttgggattgcgcttctcgaggaatatctttgtggtgttctctgtatttcctgaatttgaatgttgacctgccttgctaggttggggaagttctcctggataatatactgaagagtgttttgtaacttggttccattctgtctatcactttcaggtacaacaatcatagcattggtcttttcacatagtcgcatatttattgaagcctttgttcatttcttttcattcttttttctctaatcttgtcttcttgctttatttcattaatttgatcttcgatcactgatatcctttcttctgcttgatcgaatcggctattgaagcttgtttatgctttgtgaaattcttgtactttggttttcagctccatcaggtcatttaagctcttctctacactggttattctagttagccatttgtccaaccttttctcaaggttttaagtttccttgcgatgggtcagaacgtgctgctttagcttggagaagtttgttattaccaaccttctgaagcctacttctgtcaactcgttaaactcattgtccatccagttttgttcctttgctggtgaggagttacgttcctttggaggagaagaggcgttctgtttttggaattttcagcctttctgctgtggtttctccccatctttgtggttttatctacctttggtctttgattttggtgacgtacagatgggttttggtgtgggtgtcctttttgttgatattgatcctattcctttgtttgttagttttccttctaacagaggcccgtcagctgcaggtctgttggagttgctggaggtccactctagaccctgtttacctgggtatcaccagtggaggctgcagaacagcaaatatcgcggcctgatccttcctctggaagcttcgtccaagaaggacacccacctatatgaggtgtctgtcggcccctactgggaggtgtctcctcccagtcaggctacatggggctcagggacccacttgaggaggcagtctgtccgttactggagttcaaatgccgagctgggagaaccactgctctcttcagagctgtcaggcagggatgtttaaatctgcagaagccgtctgctgccttttgtttagatatgccctgcccccagagatgcaatctagagaggcagtaggccttgctgagctgcggtgggctccacccagttcaagcttccttgctgctttgtttacactgtgagcatagaagtgcgtactgaagcctcagcaatggcggggaggcgcttcccctcaccaagctccagcatcccagcttgatctcagactgcttggctagcagcaagcaaggttccatgggcatgggaccccccgagccaggcactggaggcaatcacctgctctgccagttgcgaagactgggaaaagcacagtatttgggcagagtatactgttcctccaggtacagtcactcacgcctttccttggctaggaaagggaaatcccctgaccccttgcacttcctggatgaggtgacgtcctgccctgctttggctcaccctccatgggctgcacccactgtccaaccagtgccagtgagatgaaccaggtacctcagttggaaatgcagaaatcacccatcttctgcatcgatcttgctgggagctgtagaccagagctgttcctactgggacatcttggaagcaactctgggtctgagtttctgtttgttgccctgatgtatatccccagtgcctagaatgatacttgttacataggaagtgcttgatccatgtttgcacaaatgaatctttctcataatgaggtttctctaaacaagctgttctcccaaaaacttaaacccagctttatgttgaagcatctcattatacattggaaagatgaaatgtgtagtgagactttgaatcttcttttgaatctagaaacattagcatttttagaccattctattttaatatttatgaaatttatgaaataataagaaacatgaggccgggctcagtggcttatgcctgtaatcccagcagtttgggaggccagggctagtggatcatgaggtcaggaatttgagaccagcttggccaacatggtgaaaccccacttctactaaaaatataaaaattagctgggcgtggtggtgcatgcctgtaatgccagctcctggagaggctgaggcaggagaatcatttgaacctgggaggcggagtttgcagtgagctgagatcgtgccattgcactccagcctgggcaacattgcgagactccatctcaaaaacaaaaacaaaaacaaaaaaaatgtgtgacctaaattaggcttatagatgaaccattgcagtcatgattaattccgccattgtttgccttgtgatctttggtgccatgtctgtacatatttcatgatttctgtgtttttacggtttccatttcagatctcccttgagtttagaaatctggctgagaaataccaaacagtgattgccgacatttgccggagaatgggcattgggatggcagagtttttggataagcatgtgacctctgaacaggagtgggacaaggttagtctcataaaacagtgtctgtgtgtgatgtattagacagagctggcagtcctcatagtgaagctcagaacaagaaaagttgtccagtattttcagcccctctggttttacaattcatctgtttaggttgaatgtctcatcataaacagtttattccagagttaattccaaaccagcagctatgtaggatatcagccaggctaggagtagggtactggagagaagtgcttatctagacaaagggatgtaattgaccatgaagattaaaactacacatcaaaacataaggtagggttaggagtcttgcctatttttcataggaatggtgtttgtgagacttactcatcacttctgtggaagtaaagacattttatttatttattttaaagccagtcagatttagcaggcagagacatttcagacatctaaagtgttgatgtatttcatacctttaactgtgcttaaattaggatctccgaaaagatgctgctacatggtcactacgttagtgtaggtccaaggtcttgggcctcttaatttttcaaacctcaaaacttgacagcagttatctttggaactgctgatttgtgcttcctaagttaacagcatacaatgactgctagaaatcaatttctgcatttaaggtgaagttagccgggtactatggtttacctgtaatctcagcactttgggaggctgaggtgggaggatcatttgagcccaggagttagacacaagcctaagcaacatagcgagaccccgtctttcaaaaaattaaaaaatgagcagggaattggtggcatgtgcctgtggtcccagctactctggaggctgaggtgtgggaggattgcttgagcccaagagttgaaggttgcagtgagccatgattgtgccactgcactccaacgtgggtgacagagcaagacaccatctgaaagaaaataaagttgaagttaaaacttctggccaagaaccagcactggttatgatagtaactcattttctgttgtgcagatttattcaggaaacttaattttaggttgttgaatagaagttttgatcagataaaattgaattaaaaaaaattttttttgagacagggtcttgctgttatccaggctggtgtgtagtggtgtgatcacggctccccgcagcctcaacctcctgggctcaggtgatcctcccacctcagcctaccgagtagctgtaactacagtgcatgacaccataccaggctcatttttgtacattttttgtagagagagggttttgccatgttgcccaggctagtctcaaactcctggcatcaaacagtcctcccactctggcctctcaaatgttgggattacaggcatgaccagccaattatttcaaggagttattttttttcttctactttgggggaagatgaattatataagtctccattttaggagtatttctaccaaaagaactattatcttcaaatatatttttggatagtactatagatatactaatttttttttaaatttctagtaattcttttgaagattttgtatagctgtccaaagccaatttctgtctacctaatttcagcaagatttcactcttttcatgttacttttgtcccagaacaaatttcaagtgctttctcttcacctgtgcattcttccccctgattagtctctggctttgtattactttcagtcagagacgactttttttttttgagacagggtctcactctgtcacccagactggaatgcagtggcacagacaaggcagccttgaccttctgggctcaagcaatcttccttgccctcagcctcctgagtaactgggaccacaggcacgttgccaccatgcctggctaatttattttaatttttattatttttgagacagggtattgctctgtcacccaggctggagtgtagtggcatgatcaaggctcactgcagccttcacctcctgtgctcaagcagtcctctcacctcagcctccccattagctgggactataggtccacaccactacaccaggctaatttttgtaattttttggtagagacagggtttcatcgtgttgcctaggctggtcttgagctcctgggctcaagcgattcacctgccttagcctcccaggtgtgagccactacactcagccttttaaaattttttacagagatgaggtcttgctttgttggccaggctggtctaaaactcttgggctcaagcagtcccctctccacagcctcccaaaattccgggattacaggcgtgaacttcggtcatttcctaacttttacccttcctaatgacactccagagcttaccttctttacttttgcttcttaagttaactaatagacaattattgtatgtggatattgcattaagttgtcttaggatacccttttcagaggaggacagcttttgacaaattgctgtcgcggaaaaaaaaagtatttggcaattaagagttgcatttactgaaatctctgttgagagaggggaagttacgttgtctctaaaagaaaaactaaaaagaaaaggggaagttttagcaaagttgttaaagcctgacacttaagtcatactacctagttttgaactcttagcccctgccacagacacggcagccccttgaaccttcctgggttcaagcgagcctcctacttcagccccctgagtaactgggaccactggcctgtgtcactgtgcctggctaattttttttttttcctcacatgggcaatgttgggcaagttaaatcgacttctttgtgcctcagtttcctcatctgaaatggagatcatactgctatgtacctgatacaatgtttgtgaggattgaatgtgcagagttctttttttctgttgttgttgttttgagacggagtctcactctgtcgcccaggctggagtgcagtggcgcgatctcggctccctgcaagctccacctcctgggttcacgccattctcctgccttagccttctgagtagctgggactacaggcacccgccaccaggccagctaatttttttgtatttttagtagagacggggtttcaccgtgttagccaggatggtcttgatctcctgacctcgtgatccgcccgtctcagcttcccaaagtgctgggattacaggcatgagccatcgtgcccggctgaatgtgcagagttcttaaaacagtgtcaagaacataaaatagttatttgttctttcatataatgatgattttgagggcctgcggatcttgacatgttatcagattggtcaaaaaaagattaaaccatagttggtattgtcctagttcctgttaccagaatattccatctttcatcgttgccttctctcatagttttatgtatcaaaaagtttattgtaaagctaggccgggcacggtgtcttgggctggtaatcccagcactttgggaggccaaggctggcagatcagttgaggtcaggagttcgagaccagcgtggccaacatggtgaaaccccgtctctactaaaaataaaaaattagctggatgtggtggtgggtgctttaattccagctactcaggaagctgaggcaggagaatcacttgaacccaagaggcagaggttgcagtgagttgagattgtgccactgcactccagcccaggggacaaagtgagacttgatctcaaaaaaaaaaaaaaaaaaaagttattgtaaagctagacacggtggtatttgcctacaatcccagctgttcgggaagctgaggcagaaagattgcttgggtccagtagtttgagtctaacgtgggcaaatatatgagactccatctcaaaaaaaaaaataaaaaataaaaataaaaaaatgtttactagtttttttcagtagccttttattatagtagcagtacatgtgtattgtagaaatttggaaaatacaagtgaaaaataaaaacatcaaattcccgtcagccagagactgctgtgaaatgttttgagcacatccttcttgaatgttttttaaatcctggtatgtatatttgtattttaaaatcaaaatgcattcttacccattctcttttgaacctgcttttttgtagctaatgatctctagtgtgtccatttcagtaaaaattccattattaaagtgctttaaaaatcgtctcttacagtactgccactatgttgctgggctggtcggaattggcctttcccgtcttttctcagcctcagagtttgaagaccccttagttggtgaagatacagaacgtgccaactctatgggcctgtttctgcagaaaacaaacatcatccgtgactatctggaagaccagcaaggaggaagagagttctggcctcaagaggtaacagattcagggtattttgggggaaaataactttagacattctctgaaaaatcctttaactcttgtggttgcgggtgacagaaaaacaagtcaggcctcccccaggcagcataaggggatgtggaaaataggatagattgacatgagtttgcttcaggtagactggctgactcccaggattcacaccacgtaatcagtatattcaagccttgctgtccttgatttctttcagacggtctttctccaagtggtggatatggtaacaacccatgtgcactagcttaacaaaaagttcttaggaatggctttgttcggcctggcgcagtggctcatgcctgtaatcccaacagtttgagaggccaaggtgggcggatcacctgaggccaggagttcgagaccagcctggccaacatagtgaaaccccgtgtttactaaaaaatacaaaaattagccgggcgtggtggcaagggcttgtaatcccagctacctgggaggctgaggcaggagaatcgcttgaacccaggaagcagagattgcggtgagctcagattgtgccactgcactccagcctgggcgacagagtgagactccctctcaaaagaagaggaagggcttggttcttctgctcagccctgaatcagttactgttgctacacagctgagttctctggcctcacctggattacgtctacacagtacacacagaatggatttcccccaaagaaagaattctgcggcaggaaggggaaagggatggcaggtagacaaaaactccaggtgtctgtaataagggacagggtcgatctttaattaaaacatggacagggaacagaaagcttttgatactgattttgttcagaaggaaagtagaaaattttatgactgttccctgaatttattccagcatttaccttttgctttccataaaagtgtttcctgcagccaagtactttaaagttttaaaaagacgggtgaggctaagtgtggtgtctcatacttataatcccagtgctgaggccaggagttcaagaccagcctgagcaacacagcaagataccatctctataaaaaattgttagaaaatgattctgctgaaagagcaaaaataaaaattaaagaaagtagaaaaaataaaactaaatttaaaagattaactgggcatgttggcatgcacctgtattcctaggtattcgggaggctaaggcacaaggatcccttgagcgcaggagctcaaggttggattgagttgtaatcacaccactgcactccagcctcggtggcagaatgaaactgtctcaagaaaaaaaaaaagtgacagagggaaacaatatttgcaattcatagagcagatacagggttcatattcctaatattaaaaaaaacttctaaaagttaagaaaaaggccaactgccccacagaaaaatgggcaaggagataagaacaagattgttcacaggaagagacacacagatgattattaaaaatctgaaaagatgctgagtcttactcctaagaaaaattcacatttaaactactctgggggctgggcaaggtggctcacgcctgtaatctcaacactgggagaccaaggcaggaagatcactgaagccagggtatcgagaccagcctggacaacgtagtgagaccttatctcttaaaacaaaacaaaacaaaacaaaacaaaaaaaacagtaaaaattggccgggcacagtgactcctgcctataatcccagcactttgggaagcccaggtgagtggatcacttgaggtcaggtgtttgagaacagcctggccaacatggcaaaactccgtctctactaaaattacaaaaattagccaagtgtggtggcatacgctggtagggccagctacttgggaggctgatgtgagactccatttaaaaaaaaaaaatcaaaaattagctgggtatagtggcacacccctatagttctcgctccttgggaggttgaggcaggaggattgcctgagcccaggagttcaaggctgcagtgaaccatgatcacaccactgcattctagcagcctgggagacagagcaaaacccttgtctcaaaacaaacaaacaacaacaaaaaaacaaaaaacacttccctcagctcagacatggccttttaagtttcctaggtgactcgtgtgcagccagggttgagaaaccactcttgtcttacccctcttttgcagacacagggctcagagaagggaaggggattgtctggggatgtatagtgaggcagtggctgccttggaagtggagtctcagtctcccggctcctaggccagcccctgaccactgttccattgtctcccagacagaacatcagccacgggcatgtgatgcatgagcgtgagccacaccatcttgcacacacaggagcagagccctgctcttctcattcacttactttatctgtaaaatagcatcatttctaccacacggtggtggtgtgaataaaatgagatgaacttctagcatagagtgcttagtaaaggttctggacatttcgtagtagttgaatcatgccaaatgtggtcctaggtgattggcttcttttgctagcatgttttcagggctcctccatgctggggcattgcatcactgctttattcctttttatcgcctagtattattccactgtgtggatagaccacatttatccattcatcagttggaggatatttgggttcttcccattttttttggctatggtgaatagtactgtgtacatttgcatataaggttttgtgtagatgtgtgttttcctttttcttgggtctatgctgagaagtggaattgctggttcatacagcagctcgaaccttgtgaggagctgccagacgcttttccaaggtcgctccaccattttacattcccgtcagcagtgtgagagtcccagtttcaccagcacttgttgttatctctttttaactgtatgtatatatacttaacattttatttataataaatgtacataatagagaatttgccattttaactatttttaagtctattattcagtggcattaagtacattaatgatgttatataaccatcaacactatgtttccagaactttcgctagcttcagagaatcctctaaataatatcattaaaaatcatcaagccgaatcccactgttagaattaaaggttttatttcactttcaagttatcaggatccagggaggtgtaatacacttagaggatagactcagctcatttcccagctatgcctttcagcagcattcttaccagagtaggaatataatgttagtcattatttagaggcctggccatcttgagaaggtttactgtttagtctgcagtacaattataactgtttttgtatattgggttatttttttcagaagtaggccagtagctctaacaggagcctctttagcctgaattcgtccaagtagtgcagtgttgcactagttgtccctcgggacatgctccccaatacgtaactcacttccaggttgcaactggacacttactggtagtcagaaatagctattgcatggagcttaaaatgaacttgatcttcgtgaaagatgagtctgcagctaagagactttactgtatatcatagtgtttttttttgttttgttttgtttttgtttttgtgacggagtctcactctttcacccaggctggagtgcaatggcgagatcttgactcactgcaacctccgccccctaggttcaagcaattcttctgtctcaccctcctgagtagctgggattacaggcgcctgccaccgtacccggctagtttttgtatttttagtagacacagggtttcaccaccttggccaggctggtcttgaactcctgacctcgtgatccaccctcctcggcctcccaaagtgctgggattacaggcgtgagccacggcgcccagcctgtatcatagttcttatgcacaaagaccctttaatattgtttgtaaattctcccctatgcacacgctgacctgttccttaatcttcttatctgtctaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtagggaacggggctcctctgggtggatacggggctaaagggagtggggtaggagtaagggtggattttgctgtgctatattcaaggatatgattccttaaaaagacgatgactccagtttattacgctgggagtttcatagcacccgcctttgcttccagccaccaaactcagctcagccttgaggttaagcctgctccttttcagaaccttctttctggatttactattttctacagctatcctaaactagttaggttcttttcctcacagttaagtcaaggtctttggcttagatttatggggagtgctgggtaaaacctgggtgaagctgttatcattaaaaagtcttcattaagcacctaattactgctgtccttttcctagacccggcataaaaagaacctggtccggtagacctagcctctcagtatgctaggaacttacactttttagttgcctttaccaagtattgcagatactactgcaaataagtgaagaaagtaacagcatttaactgatttgggaacttggtttgatcttgttctaatgacccacttcgaatggtggttgaaagtaaaatctgtatcgccgtcttatgtttccatttacctagaaatactttacctttgagcacaggaaattaatccccttctggttgttctccccctggcattggttttaaatatataatgattatgtttgttgtaggaaaaatagaaaaacaactacaatagaaaattcttcccatatattattttgaaatacatatttccgatccgataatccattgctctagcatggaaaatgttggatttacttgtgtttgctttttccaaataaaatggaacttttgtggctacattatagaattgttttagactgcttaattctgtgtgttgttgagaaagggaggagtggggaaggtaaaaatcttgacatactttcttcgtgggtattttttcttgagcgattccatcttagttgattagcagttagcaattgcccattcaacagaaggttttcttacctttttgtgataatgatagctaacgacatcatttcttcttttttccctctcttcttgttgtctctaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagaggtgggtttttatttaactacttggataatttgtagctacttttatgatttagtaatgtcactgtttaaccaggtttggatattagatgatcctaacaattcactatcctgtggcctaaagagacaggaattgatatcctttataaggaaaaaagtctattcacaggagccgagcagattgctcactgctgtgtagtaccctggtgagaggagataaatggagcaaggctgtaggttggagcccctcagtagaatcatagattttgagctgcaagatgatgcaggaggccaaccaagcttcttgttgctggtgaggaatgtgaggttgaagcttgtctgtgctgatgcagtgcgtgattgagtggatctctggctcccgtccatgtgtcctgacacccagtctggtactttcattatgccacaggcctcaattgaaaaatcacagtagggaatttaggccaaggaaagccatcaagttgcaattatttcctaaattttctttggaaaatttcatttcaaataccaaaaccatcctataaaaagaaaacttaccttcttaggtcaaatctctaatatttgactaggttcaaaaagtttatttctggccaggcacagtagcttactcctgaaatcccagcactttgggagaccaaggtgggaggatcacttgaggccaggaattcaagaccagcccgggcgacatagcaagaccccatttctacaaaaaatttaaaaattgtcatggtggtgcacgcctgtggtcccagctactcaggaggctgaggcaggtggatcacatgagcctgagaggtcgaggctacagtaagctgtgtgatttcatcattgcactctagcctgggtgatagagtgagactttgtctcaaaaaaaaaaaaaaaaaaaaaaaaagtcttagagaccagaagtctctgtaatctctaataatctctaggccctagagcagtggtttgtaaatggaggtgatttgctcccctccccccagaggacattggacaatgtctggagacatttttgattgtcctaaccggcaggaatcgggtgctactggcatctggtgagtagaggcccaggatgatgctgtgatcctcaggtgtgatcctgttgagaatgaaacactgtagactttatgaaaacatacaagaccctcatcatttttcctttgcctgagctccctccccagaggttacctctgttcatggttttgtgcatccgtctagtccccctattacgcgtttacaggaatatggtttgcaacagtgttttcatctaaatagaattatacaaaatagcgatttctgatttctcttgcatattgcacattcttcttatacttcctccctacctttatctgacacagaaatgctgtatgtccagaacttctatcagaggcacctatggaagtctaagggaagaccacatcgcttttaaaaaccctaaaattttgtagtcactagatgaaaatattcagccagtgacccaaaaaattgctaccaatgagactctccattttgccatgtagccagaacttactttgatctatgtgcctggggtagtgaccaagtaggtgggtaggagtaatctcagggaaacttgaggccccagcctcatggctagggtcataatttgaacccaggtctgtctgacatcagaatccatgatgttaaccccaattctaaggggttcaactaccctttctaaatggaatcctgctatattaagcactatttattcattttatataaactagaaacattttatgtagtaagtagttgagagtgttttggttttgcagtttgatcactagttttagaaaccagtttttaaacactttgtggccaattccattactatattaaaattcagatttatttggtttttccttaactattgggattaaatcctggttgtaattcatagtttgagggcgagggtgggcagtctacagttggctgagccctgtttttgtgaataaatgttatcagaacacagccacacccatttgcttctatgtcttctgtggctgcttttgcaatgtgacggccgagttgaggagctgcaacaggcgatgacttgtaaagctgaaaatattttttggcccttgaataagaggttggctgacttctgacttagggcatcagttgttctgttatcccagtaaaactcaaggcattaggggagaaatgttaatattaatacttaagttgatttgatttagggaaatctttgaagatttctaagtcttaagcagtagaacctgttaatggttttagtttcagcagtaaggacattttacaagtaaagttttaaatgaaaacattttgtatgaagccacaagtcgtctggcctcttgctggtgtccagatattaacactgatcctatttctccttgctgaccaagtctgtcctttgtagtaagaaaggaagaaacgttgactctgtccgatctctggacttagtgttgtagcgagcatgcacctggaagggacttgccagaggacctcctcatgcttctccagtgcttagtgggggcttggagtgcagccccaggtcttcacgagcagttggccacactgcagggccctcaccccactctggagcagcctctgcttcaaaccagcctggatgcttgtcagctggggagaagatcaacctgctattttgggatagaaataaatgctcagccaaacggccagaaacccccattcccctctctgccaaagtgaattccttggcagggagaagcttgttcgtgtctctgcacacttcctgtgccctcctgtggttaagtcagagaatcatccggctctttgagccccaggtgcctagctgctcaaggatggtccccagccagcagctgccaggaatcacctgggagcccattaagacatccagcccccacccaaacctatcgaatcagaatctgcctttttttcccaaatgatgtttttgctttaatggaagtttagatgttcatagacaagagttttaaatgatgatcaagctgattccatattcgcagttgtaagtagaactgctgagacgtggaagtaccacatggactcacagaggagctgctgtatgtagcacagcattgcacaagagcttatttcagtctagtaaacatttataggagcctgtgtcatttaatcatcaagcctcgcactgtggctcacacctgtaatcccaaaactttgggaggctgaggcaggcagatcacttgaggtaaggagttcgagaccagcctggccaatatggcaaaaccctgtctctactaaaaatacaacatttagccaggtgtggtggtgcacacttgtcatcccagctattccggagcctgagacatgagcatcgcttgaactcgggaggtggaggttgtagtgagctgagatggcaccactgcactccagcctgggcaacagggtgaaggccctttctcaaacccctcaagtatttggcttcaactttatgccgggcatgtagatgaaaagtcggctatgacctgtccttgacaagcagatgtaactccttgattgaggctagtaggtttttaagacctgaataattgagtttgcagaaacctactgtgtgccttcaggtaaatggagagtggggtttggtctagcaacgaagcatctagaaggtccctttggccttaccggctctgttttaggtaagtccacgtctgagtaccagtgactgcagctcttccagttgtgctgtcatgcttatatgttagaaatgatcatcaaaggactcaaaagttttgccactaattgtattaccggggactgtcacaaccaagatttctcttaatttattcaccttacttatctcctggaagggcatattgaagtgctcttggagttctctaaaagggtttttgttggttgtgtatattcacttgggtgccagcgattgattccaaataagtaaatcttttttcccaaaaggatgtaagatggcttatggttataagtacaacaggctaacaaagtacaagtagatgagaaagtaaaatgaagaaataaagtcataggagccacagaattaacccaggaatgaataagtgtgtagtttggtgctgatgttatcatcctttatttgtacattgcttgtacagttgctctgagaaggtaagtcttaaattttcaaaagtgaaatgtcaccgagcatggtggctgatgcctctaatctcagcactttgggaggctgaggcaggcggatcacttgaggtcaggagttcgaaaccagcctgacttatgtgatgaaaccctgtctctactaaaaaaaaaaaaaaaaaaaaaaaaaaaaaatcaaaagttagttgggcatggtggcaggtgcctgtaatcccagctacttgggaggctgaggcaggagaatcgcatgaacctgggaagtggaggctgcagtgagccaagattgcaccactgcactctagcctgggtgacagagcgagacaccatcttaaaaaaaaaaaaaaatctacaatataccaaaaccattacttacctgagaaactattctcagggtcattgtagtgaatgcctattttatggcttttgatggcatcagggcactcaggtcatttacaagagtagtgtgtgagaccctgtgtgtcactgccactcatcttggccttcggccactgctgtagcaaccagtttccaagtagggctggaccttgccttctgctccagagacctctcgcttcctgcccttgggcttctgacgagctgcaggaactgcctggcacgtgggtccccacaacccagaggaggtgagggccacctctctgctcctcagggccacctttcataaggctccttgaaggtccctcaagatcaagccaactcaacacatccttgataggccttcctgccttctgtttcacttctccactcgtttccaaataaatggctgcatgcaagcttttgcctcaggttctgcttttaggaggaaggctaagacaagcagtaaagcaacatgggcaggcagaaggatgacttctaatagaattatctcatcactatatattttactttatggatgcttgtattgaaaagtcttggctgggtggagtggctcacgcctgtaatcccagccctttgggaggccgaggtgggtggatcacttgaggtctggagtttgagaccagcctgaccaacactggtaaaaccttgtctctattaaaaatgcaaaaattagccagggatgcacgcttgctgtgtgccagcacagggctaggctggagataaaaaggtgagtaagtaggtgcggtgtagtcagggtgaaaactacagatggtccatttccacgtaagtggaaaggtaaaggtatgtacaatagggtggctcctggctgaacctggagctgcagacaggttttctagaaggcataatcctgaagttgagacttgggggcctaggtaggagccagttgaagggacgtgggaggcgcattccagagagaaggagtggtatgagactggaacagaggtgtgcagcagcatcgcatgggcgaaacaacagtagacagttgttcttttgtttttgtttgttttttgagacagggtcttgttctgtcatccaggctggagtgcagtggcatgatctcggatcactgcaacctccacctcccaggctcaagtgatcttcccaccccagtccccaagtagctgggggaccacaggtgcatgccacgatgcccggctaatttttgtacattttgtagaaacagggttttactgtgttgtccaggctggtcttaaacgcctgagcttaagcagtctacgtgcctcagcctcctgaagtgctgggattccaaacatgagccactgtgcctggcccggcaactgttactagactgtagagagggaggtgggcaagggctggtgacactagacaggtgcagtaggtctggaccatgggtggccttgcgctacacattacagagctcaggctttttttctccaggtgagagggctggtgccactgaggcatcaagcagaggtttgagatctccttggtgacagtgtagagcagacaggtagatttgggaatttaagcttagactcacgttggagactgagatagctcatctgagaggcactcagggcctaatctcaggcagtaattttagggatgtaggggaagagatggattctgcacatacttgggaggcttgtggaggagtggggagggaggcacagggaggactccagggtggttcatacggctccctgcttctgttcctgtccccctttgtcaagctgtggtctgtactgcgtgttccatcttgtttctaagctgcttttgcccagtctttccagcatttccctttcgtcatgttagtctgtgcctgtctacgtgaactatggtgacgtttattgggcctggcactgtgaggtgctggggatgtgaagatcattgtggctcagccgctgctctcgagggcctctgggtgcagtatgcacacctgtgcctcctgtttgctcaggaagacaggctttgagatgagctggggctgacatccccaccttatcattgggatggctttgggtaagttatgttcatgttctctgagcctccctttcctcattggtaaaatgggtataaaatacctgccagtggagggttgttgtaagtagccatggaaaatgtaaagcacatagcacttatcattttttcctgtgtctttaacagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtcaagtacagttcgcttgaaagcctgcctgactgtggaaaagatggagctcaagaatggagttgatggcccagcgtggtggctcatgcctgtaatcccagcactttgggaggctgaggcggtcggatcacgacattaggggatcgagaccatcctggctaacacggtgaaaccccgtctctactaaaaaaaaaaaaaattagccaggcgtggtggcgggtgcctgtagttccagctactcgggaggctgaggcaggagaatggcttaaacccgggaggcggagcttgcagtgagctcagatcgcgccactgcactccagtctgggcaacagagcgagactccatctcaaaaaaaggaaaaaattgtaaaaaaaaaaaaaaaaaaatttcccccagcagtttttgttttctaaagttatcagtttatatattcaggtcttaagaaaggcaaaagctgtcttcaggtgattggcttgggggcagaacagtacttctgctcggggtttcaccttcctctctactccagtgcagcagagcttgtgatgtgctctcactgaggtgctcagtgcagcaaggaggcctgtggaccctcgagttgagaattggtgtactagggcattcggtactttctagaagccattaatgctacaggtactcataaagtctactcttctgcagcccatcgtggatggtggcttaatcattgaatttgagttgtttcgagctgcaacgttggatttgcattgttgtaagcacactttcttgctgtgaccactgacaccaaaattagtttgggcccagggagacttcagttaattggttcatttgaggcttagccctggactcatttgtcaccagccaagataacttgccacatggaatacagccagaccaggggtccccgacccccaggcctaggaccggcactaaaccttctgttacgtggcctgttaggaaccgggcatcacagcaggaggtgagcggcgggtgagtgaacattatcacgtgagctccactcggcgttagattctcataggtgcgattgcgcgtgtgagggatctgggttgcatgctccttgtgagaatctagtccctgatgatctgaggtggcagtttcatcccaaaaccattttcctccctctgtccttgggaaaattgtctttatgaaaccggtccctggtgccaaaaagcttggggaccactgagctagactcgacagtattttccaaggaattaaagcctcaaaacttggtttgagatttcagggtaggttgttaaaaatctgtgtgttgaaatctaagatttaattctgccaaagttcacgttaagacagaacaacctgctggaaagagatttg

SEQ ID NO: 14129 - DNA, 46720 bp, Human
aatcatttgaaccctggaggcggaggttgtggtgagcggagatggcagccattgcactccagcctgggcaacaagagggaaactccatttcaaaaaaaaaggaggggggaaggggggttgagtccactctccccagctcacgccagatctcatttcagtggtcactattaaaaaaaattagatatttactttattatagatacttcctatgatgatctgtgaggacatgcattttcttatcctgtaataccatttgtaacaatagcaaaaccagatcattactggtctggaaagactgtcaatgtatcagcaaataaatcttaattaactctgatgatctacttaactcataactctaaaagcactaaaagaccactgtatgaaaaggtgactcaaggcaactgcaaacaaagtgatccccaaaatactaaaagcacaatctcaagtaaagtggcaatagctgggaaactcttttccaaacacaactgtcagaaatggaaaaatgtcctcctgagtaaagttttcggcagaaaacttcaggcagaggcataacactggtatgcaaaaacaataaccagacttcacttcaagaagtgagcgaagaatgtgagtgatcataaatcagaacttccgtcaagcttgcacgagtggagttgtaagtaacagcagaaactttgaagtaccagaagataccatcattcaaaaacgaacacactttgactagcccaccttggacacggagaatctcgctgatcactacaaactacaagataatcatttaactttgagacctcagtgagagagggtatcagcttttcctactccttgcacgctccgctgtacggaagatgccgagggaacgcatgccgtgtctcagtcccggcatagtcaaccacgctgggcaaaagacggggccagagggtgcagacgaatatcggtaactcgaaccaggctgggagttaagctagaagaaactggggaaggaggcaaaacagaagcaggaaaagagcagtggggagcggcgggcgcaccagagactggcgagaaggggaaaagtcccccagacgcacaaaaatgtctagaaggggttcttctacttcgatctgagtttcccaggagctcagccttggctgtcccgctccccacccaaccccacatgattcctcctcttggatgggacgcttaggtgaagcgagggggagcttcgcaggtggctcccggcaaactgagaagggtctcccagagctgccaagaggaaagaactgcgaacagtcgctcccccggtacgtgagagaggagtgaccagaggcaaaggtgaggcgagcaggttctcccttacctgccgcaggagcttccaccgggcggctcccaggggcgccgagactacgggcccccgagtggtgcagccaactgccggactcccgcccgctgctcgcgcggtctcgccggtcccagcgtccgcgactcgcgactccatctcactggagccttccacacccggaggtgccaccgccgcagctcgtcccctgccaggacctgccaacttcttccctgtcaggacctgtgacgcccggcaccctccctccaccggaccaggcatgcgcgctctccccgaattccgcatttccggtactcgcatctccttggcaaccagggccgagctgtcacgccattgcaccatttttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcgtatgtatggggggtgtgctggtctctttccttctcccctttctccccccgcccagccacccacccctcagtccccaggtcctcgctttttgactaatgtcccggcactgcgtgcgtgtcacctggtccctctccctgttgcattcagatcgcctcatccctggggtggagagttgcacggggtaaacgaataggttctcctgagaacacccatttatctaccccacccccatcctagccttgcatactgtcttcttggggatgaaagatggatggataaaggctgtgggaacgtggtgatgtaggacctttgcaggtccttgttattcgggtcttttttcccctttttttactagtgtcggctagtaaactagtgttgctcccctacccccaatcgcccattattttgctgcgacatggaaagggattaaggggggcgggggcgtcgtagcgcatctgatctatggtaaatttgacgcagcattctacctttgataccagggggcattttgtggaagacttccataatgacattcagcggtgtgcaacatacctagattattcctgtcgtaaataatagcaactgccatttattgagtggtcactatgtgccaggcactgtatggtcttaatgttaagctgtctcattttgtctttacaacaacaaccctagaaggtaaatggtgtcatttcatttttgcagatgaagaaactgaggcccggagacacagttaagtgtaggagctaagacctcaacccaggtctctctgactcttaactacttattagcaatcaaggttaataaaagctacctcctgacaaaccagagatggccttacattttatttgtgcatcttgcaggggttttttgttgtttttaattaaagcgctaaatacctttttaacattaaaaatccgaagttgagtatgtccagtatttggaaccgaaccaaattggattttttgctatacagcttactgtacaagtgacctggaacagttgcttagaacctcccacagccacagtttggcaacctgtaaaatgtgcatggtaatatctactttattaagtccatataaaatttaaattagacaaacaagataaaagcacctggcagttagttaacactcaacaataattaatcttccctcccccacctttattaaataattaggcttttccagtttatcttccacatatataccaaagatacgttcataattatgtaagaccaaagggctttttaccttttacagccctgagttcctgagataccccattaagtctgtgtacttatttgcaaatttatattttgtttcttgttttgttttttgttttagtttaacccctatgtgtgccagagtcagtgctgcatagtttgagcctgataggattaactttacaaatgagacatttaagtcacatctgccaagaattatgatttgaatgaaactttaacttacacaggtttttagatttagttagcctaagttatcagctgtctgaagttattcataacctaagtggggcatggccctgaaaaggagggatgagaactgctgatcttagttactctgagaacccactactctgtaatcatacctataaaatcattcgtgtgctggcagccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggtatggactgtttaagttaacctatttgtaggtcattaagattaattttaatttaaaaataaagaatgggtagaatatcagagctactaattttctcagtaattctaacttgatttttctaattttcaagtctcaattgtctctagtcaaaagtaagtataaaagagtatatacatcgaggcaggcagatcacctgaggtcaggagttcgagaccagcctggccaacatggtaaaaccctgtctctactaaaaatacaaaagttagctaggcgtcatggcacccacctgtaatcccagctacttgggaggctgaggcagagaatctcttgaacccaggaggcagaggttgcggtgagctgagatcgcaccacagcactccagcctgggtgacagggagactctgtctgaaaaaaaaaaaaaaaaaaaagtgtatacatatatttatagggctctaatgtaatatataaaaatgtaggtttataaaaaatgattcacctcaggacttccttagtatgcctgccagtgcatttcaaagtataattcggccttctaaatttcctagaacactaaattatagctcttaataaaatctaatgatacgctaattgttttatgaatcacaaatcagtaaacttcagtaaaggccatgaattgtattttatttctctgtaaaaaaatgaaaaataatcttgcgtttttgaccacttgagtcattcaggaagacactgtcagagtattgtacttctgccagaccccaagctgtgggcgtgaactcaaccttaaggacctgattgcccttatatagagagtaaccacataaccacttttgcctggcacagctccagcctacacctgttgtccctgtgtaattattaatagtgtcccctttcctctcaaaagtgtcctggttagaatggtaaattatatggtcatcctacagtaagtaggattaaatgatctatttgtgctgctgctgctttgacatccctctcctaccttttacttcttatgttccttaggttccttaatgatatttgggggtggtattcttgcaatagtttcacaaatttatgattttaatattttttttattttaatttctggttttgtcgcatactgatttttcttttagtctgttttggcttcctcctttcttcgggtaaaatatatgtataacaaagttttccacttgatccattttaaagtatgcaattcagtggctttcaaagttcatctgtgttgtatgcatgtatcataacttcatttctttttatagttgaataatattcctttgtatgtataaaccacattttgtttatccattcctgtaattgatggacacttgggcagattcttctcattttagaaactatcttttcaatctaatttttctcagtttttctagtttttgttcaatttttgccgctatcttagctgatacctatttaggtgttgtgtgtgtctcttttgcttttaacattttatatgttagccccctagtcttcctagacttttactgtttatgttttagtctttgaaattcttttcctttttgtagtgtcttgccttagtttagtactttctttactcatttagaaattctttataacttctttttatttcatttttgtgttttttgtacatctttcctacttcagaaagataaaatttttaatttcacctattgaactaaattttggacctttaggttattttattttgcattgtgtttagaacattttgtcatgtcgtactttgtcttaacacttagtttataaatagtagacaggaattaccatcagagtaacagctgtgatattagctcacattctaaacagaaggttgactatttcttccctccatttgttcctgaagcaacttttccgttctcttttatagattcccactacctggaaactttaacctgactcaataactccaagtattaatagttcatttagtaattcctttacctgataaagtaatcctgctgtcacatgtcatgtatcaaccattccctctatgagaaatgatgtaatgtaaaagccatggtctttatcactgagacctggggaagctttataaagatgccccggcagctgtgaaaacacctgtagagaagaatgcacatttccttctttcagcaagcatccactgatttccaactctgtccacttttatagggtgtaataaagtagaaaaagtagttactgcttttaggtaaattaaaatgtctgcttaaagagctattacctatataagttaactaaggaacagaaaagtagcatgtgtagtgggaatgttagaaggcaaaagatccagccacgattggtgtgactgaactaatcaggactcctaattttcctgactgaaaaaaatagggagttctgatcaggcatactggctcacgccagtaatcccagaacattgggaggccaaggcgagcagattgtccgagctcaggaattcgagaccagccttggcaacatggcaaaaccccaactctaccaaaaagactaaaaattagctgggtatggtggcgcacgcctgtaatcccagctgcttggaaggctgatgtgggatgattgattcagcctgggaggtcgaggctgcagtgaggttgaggcacagtgagatcttcagcctgggtgacagaaggataccctgtctcaaaaaaaaaaaaatagggagtttcaacttgtcattctgtagaaagtcttagaggtgctaaaatttcatgattctatacctcttgttaccttagcaacaaattactgcctaaaagtttggggactcttcagtatcaacttctgcagtctaactgtatatcagaaatcctggagagctttttagaaatgcggattcctggatctcaccccacatctgcgtaatgaaaatctctatggttgaggcctacacatctgttgtttgtttgtttgtttgtttgtttgagacggagtcttgctttgttgcccaggccggagtgcaatggcatgatcttggctcactgcaacctccacctcccagattcaggcaattctcctgcctcagctgccaagtagctgggattacaggcgtccaccaccatgcccagctaaatttttttgtattttttagtagagacagggtttcaccacgttggtcaggctggtctcgaactcctgacttcaggtgatccacctgcctcggcctcccaaagtgctgggattacaggagtgagccaccatgcccggccccagatctgttttttgaagttcacatcaggtaattctggaactcacaacttgactgacagtggacctgaatttagaaattggaaatgtttgatgatcaagtgttgccgatctaaaccttattgaattcattcagttctgcagttcttattggcaagtacctctgctttccattttacattagccagatggcaagatgaacttactctattatacttacaagccagccagtgatattcaaagactagcatccatccatccagatatcacatttctttatcttccacatcatcctgctctgctctgcctaaaaaataattcccaaaatctttaatagtgataatttgaacaagatacaaaatgaaattgtataattaaagagagaagactaaatcctttggttaaacatgtcatttgcctatttctacaatacaggttagcagctcctgcaatagtctcatattcatatgtgtgtgtgtgtgtatatatatatatatatatatatatataatatgtagttttgtatatcttgcaaaaagtttgagctacatccttttaagcaatagaatgttattgaaaaatgtaggcgcaatcagatttgcattttagaagaatcactctgacagaatagagaataaattggaagtaggaagccttgtcagtaactcagatgagtgaagatgagagtctttacagggtgattgcttttttttgagacagtgtctcactctgtcacccagtctgtagtgcagtggcacagtctctgctcactgcaacctccacctcccaggctcaagtgattctcgtgccttagcctcctgagtaactggaattacaggcatgtgccaccacacccagctaatttttttatattttaagtagagacagggtttcgccatgttggctaggctggtctggaagcccagcctcaagcaatccacctgccttgccctctcaaagtgctgggattacaggcatgagccaccgcagctggccctgattacattttatttgagacatcttaatggaagactagagagcttgagtgataattcctcatctctttggattctaaaatccaaaagcctgttagaaaacaaatgattttttttaactgattggagggtattgagaatgggcaaaacctgacctaaactgacacaaagctattatgatctttatcccaattagtagatgtttagctctaaaatgttactgcatttgattagagtgttgttcccctgtaaactgagataaggtacccagttaacattccaaaatctcaaaattctaaaacgtacctggtttatctttatgtttcagatggacttatttcacagtcatgtatgtaatcttactgatattcagatcttaagggtgaagaaggccgggcgtggcgcctcacgcctataatcctagcactttgggaggctgaggcgggtggattgcctgaggtcagaagttcaagaccagcctgaccaacatggcagaaccccattgctactgaaaatccaaaaattttagccgggcctggtggcgcatgcctgtaatcccagctactcgggacgctgaggaaggagaatcacttgaacccgggaggtggagattgcagtgatctgagatcgtgccactgcactccagcctggtgtgatgggagcgaggctccatctcaaaaaaaaaaaagagaggaggaaaggataaatataactcactagtaaagtggagatttcagtagcagttggatatatgagtctggaatttggggagagttgttacatgtagatagtagttgaagccataggagtcaaatcactatatttacctctctgctattactacatcattttaaacttttcctgtctccccattatattgggaggtccttaaagacaagaattttataatacacatcttgccagcacatagcataacgactgccacattgtagataagcaacgtgtttatagaatgaattaatagttaaattaatgcattttttcttttcatataaccataaattttattgctagaaaacataccccagaaatcatcccatctgagctctttctttaggtctttgatactttttttgttgttgttgttgttgagagagggcctcactctgttgctcaggctggagtgcagaggcacaaacatggcttactgcagcctcaacctcctgggctcgtgctgtcttcctgccttaccttgcaagtagctgggcccacaactatgcccagctaattttttgattttttgtgtgtgtggagacagggtctcactttgttgtgcgggcttgtctcaaactcctaagctcaagtaatcctcctgcctcagcctcccagagtgctggcattacatgtgtgacccaccatgcccagccctatgacccattttgagttcattttgtttatagtgcaagggattggggtacaactttattattttgcttgtggatatccattgtctgagcaacatttgttgaaaagagtgttctttttccattgaattgtcttggtgtcctttctgaaaatcaactgaccataaattcaatggtttattcttgactctcactttcatctcatttttgtatatgtctgtcgttatgccagtactacacatttaattactatagctttgtaataagttttatttatttatttatttattttttgagatggagtctcgctctgtcgcccaggttggagtgcagtggtgccatctcagctcactgcaacctctgcctcccagattcaaacaattctcctgccaaggccccccgagtagctgggattacaggtgcctgccaccatgcccagctaattttttttttatttttagtagagacagggtttcaccatgttggccaggctggtctcaaactcctgacctcagggtgatctgcccaacttggcctcccaaagtgctgggattacaggcatgagccactgcgcctggcctgtaataagtcttaaaatcaggaagcgtgtgtattctttctaaacaaatgaagaaactaaagccacagagcctaaagttaagtaagaaaactagtagagtcagaagtagacctaagttagcctcattcacagtacctttcttttttaatatcttgtagtacaggtagaccatccctaatacaaaatctgaaatgctccaaaatccaaaacttttttaaatagagacagagtcttgctatgttgcccaggctggtctgaagctcttgggctcaagcaatcctcctgtctcagcttcccaaagtgctgggattacaggcatgagctgccactcatggccagtgagcatcttttcttacacttattgatcctatagtttttcttcttgaatgcctattcttgtcttttgaccttcttttaattgtctgtccttttcttactgattcataagatttctttacgtgtcctttgtcttttatatgtgctgtagatatcttctccatatttgttctattattatttttttcactttgtgatatcttttgttaaatatgtttttttcattttatgttttatgctgtctgaattttattcaactcagcaaatatttgttgaacacctgctatgcaccattctaggcactggagatataacactgaacaaaataaacaaaaatccctgcctttgtgaagcttaccatcctacttgagaaaggaaaagagaaagaataaagaattacatgaacaaggctaggtgcaatgggtcatgcctgtaatatactttgggaggctgaggtgggctcattgcttgagcccagaagttcaagaacagcctgggcaacatggcaaaaccctgtctctacaaacaatgcaaaaattagctgggcatggtggcgcctgtagtctcagctacttgagagctgagatcaaggatcaattgcttgagcccaggaggcagaggttgcaatgagccgagatcatgccactgcactccagctgaggtggacacaagcaagtcctcatctctcaaaaaaataaaaagaattacatgaatgaaatacaaagtgggtcaaaagcgatagttatggcgaagaagaaaagaaaaaaaagacggggaagatgtgaataggcagtgtggggatagggaggggtgttattttagtaaaatggttaggaaaggcctaacttagaagatgacatttgagcaatagctttaaggaggtatttgggcatagggcccaagttctaagaaactgatatgggagcaagcttgatatgttcaagaaacatcaagtatggattaactggaataagtgggcttggcgtgtagcagtagattaggtcagcaatgtaatgggacaagattctttaggactttgtagaccattgtaagaatttttgcttttcctcttgagcaagatgggaaaccactggagggttttgagtggagtaacataatctgacttcagactcacacaagctcctttgttgaaaatagaccaggaggcaagcgcagaagcagagaaagcttttgggcttttgcagtaatccaagggagaaatgatgatgatactagccaagtagtccagtccaagtgtgagaagtggtcagattctaaatatatgttgaaagtagaattgagaggatttagcagaccagttgtttgtggcaagagaaaaagacaaatccaactgtaatgtttttaagcctgagtagctgggaggacagatttgtcatttatgtaaattggaaagattgcctggagaacagggttttgtttttttttttttaatagggcgagggatatatggggagatttaaagttcagattcggacattttttggcatattagacatctaagtaaaaatgttgggtagtcagttggatatacaagttcatcttggtcaggattgttcaggctacagctgtaaatttgggagtccttagcatataaatggtatttaaggtcatgactggatgagatcaccaagggaattagtgcagactgcaaagaagagaagtacttagtgcaggaattgagctctgccagtgttaaaaagccagggagatgccaggcccagtggctcacgcctgtaatcccagcacttcgggaggctgaggcgggtggttcacctgaggtcaggagtttcagaccagcctagccaatatggtgaaaccccatctctactaaaaatacaaaaaaaaaaaaaaaaattagccagcgtggtgagcaagtgcctgtaatcccagctactcaggaggcggaggcaggagaatcgcttgaacccaggaggcagaggttgcagggagccgaaatcccatctcaaacaaaaaaaaagccagggagttgagaaggaactagctaaagatactgagaaggaagggccagtgaagtaagaggaaaacaaggagaatgaggtgtcctggaagccaagtaaagaaaagtgtttttaggaggaggaagtgatcaattgtatcatgatcctgacaggtcaagtaatatgaatactgaacattaacttttgcactttgcaatgtggtagccattgagtgaccttgacaggagcagtcagtggcataagaagagcaaaagtctgggctctagagaaggggtaaggagaagaattggaggcagaagatgaaaggaacaagtttccttcatttaacagttgcttttaaaaaataaaatgagttaacagcaaatacaattagttgttttacatgaacattattaaaattttggaaatctcattggtgtttcatggttgctaaataccatgtatatgctaatatgaattaatttcaggtattttgattacagatttagtatatttctgtgtaagataactgacagaaactattaaggaagttcctctctattcctaatttaaggttttatcatttttttaaagtgtgattattttttattttttccctgcatttatcaaaaatggctctaagatttatctcctttatttgtgttagattacattgatagatttttttctgatgttggaccatcctttcattcttaggaaaaaatccttcttggtcacattaagtttaattggtattactattactgttcttattttgtgctttttaaaattaaaaatttgattttatcaagttttattttagaataagattgatttttttaattgtctcatatcatcattgtctaattttgatgtcaaggttatattagcctaataaaatgagtagttttacctcttttactatttttttaaatagttgacgtatgaaaagattagctgtttcttgaagatccaagaaagctacatttgaaagcatctgggcttggtgtttctttcaagaaggggacatttagttagcaatttaatttctttaagagttagtgacttatatagcttttctatttcttgggtcaattttggtaatttttcttcctggaaaattacccatttcatttattttcaaatagattcacataaagcttattgtaatttttaaaaatctctgttgtatctgtaattatgcctttttctctcctcgtattcttttttcttgacctcgtgatccacccgccttggcctcccgaagtgccgagattacaggcgtgagccaccgcgcccggcctcgtattcttttttctatcagttttgtgatgtttgttttttaataggtttctaaaagaaccaacttttaatttgattctctttagtttctttgttatcaatttaatttcaaaaattaattttcttacctttcttctacttccttaagacttactctttttctgttttcctaaattgaaatgcttcatattgcattctgtttttcaattgctgtggatttatgttttttcaatgtattatttattatttattattctttttgaggctccagttgtccaaaatgtggcctgtagaaaccccttcagttgacacttgtattcttttgacatgtctccattaaactttgagcacttccttattttctggcataagatttcccaaacctaccatgtattttctccctgctctagccttagaattagccatttactaatggctaattagtcttgactgaagggctgtccggtgtctttctacttcaccattttttctatctttagagttcagcatctttgccatgataaagttaacacatatcattctccttctattttataacagctttcattgttaaaatgatttagtggtgggtcacttggggagtgggaaggagtgcttctttttaccactaatggagtgatactgtaccagtaaccttctcaaaatctgaaggtaaagccatccttacctcagctccattgggtagtatatgcctttgaaacaactggactaagatacctggctaaaatggatggctttagctgtgtacgctaatgatattgctagctgaaattgaaatgaaagcttaaaacactgagcaggtatccctgggacgcaacaaaaaccaaaagtaacctggagtacttaatgaatattatataaaacctcagtttccatgggagtaattcctttagaagagttacttagaaagctgttgagttctgcttgaatttcgttaagggagtcaaaaatcctattgctttcagagttattttggttcagataagctcagtttatttggatatatgacagaaaaaatgttaatcaggaaggaatgtaaagttaagaagatgagttttggagcccgctctgttgcttttggctctgtgttggctatgactctcagtaagaatgagtatttaaaagtgacagaacccagctccatgacctagaatgtgctagaagctacagggtagtagagagataatcctgactctacttcaaaagttttaatggaaattacagaacagacaatcctgaatctagaaatgcaaaggcagctcctattgctattttacagtttcagaatagatttttagtcatcttctgacttatgatggtgatatgaggggattattgatacagatatcatgtctcaccactttaaagatcaactgtagattttgtagaaatgctttaaaaatgaatgaaaaataaatatataagcctccagtatttgatcttcaaataattactcaaaaaattaactgtatggaatgaggaggcacacacctatctatagtcccatctacttgggaggctgaggcaggaagattgcttgagcccaggagtttgagtccagcctgggcaacatagtgagaccctgtctcttaaaaaaaattcagaaaattatatgatagtaagtagaggctaaatgattgagactatcataacaaccattattgctaattttaatctaattcaaataataatgtgtcccaaaaaaatctaaaaggaaaacctttgtgaaaatgattattttccatttaatttgttttggtgatttttccgttatattcttgtgtttaattttagattgtaaactctttgtaatataaactgtatttatagcttacattctctacaatgttggtaaagtatcatggacatattttatgcaataaatactttccagctgttggcgatccttaccaaagacttaagtcccccctctggtacaaatcactgtacaattgtcatctttggcagagagctgaagtaaaatatcttggccagaatccttttgcttaaacaaggcaaaccactggagtgttgaattattaaacagtttttaaatttgataacaggttttgctttatccaaattgtaatgatttatatgatattaatttgcttaccagaactcaaataaagctgtcagcttattagtcactcttgataagacacagtgaatgcttatttagctttcatctatatctccactcatgttcattattttctattatttttcctggttcttcctttcataaagtgaacatgttatttttcctcaaagaaactgaaaaagaagctctgtttcattaggcattaattcccttttttttgttgttgttgagacagggtctcactctgcatgctggagtgcaatggcatgatcatgcttcactgcagcctcaacctcctgggctcaggtgatccctcccacctcagcttcccaagtagctgggactacaggtgtgtgccaccacacctggctaaatttttttgtatttttttatagagacggggtctcgctatgttgcccaggctggtcttgagctcctgggctcaagtgatccattctccttggcctcccaaaatgctggggttacaggcatgagccactgcgcctcgccagtttactttttgatgtgataaacagttctgttttggggcttagttattcccacaagaaaagaaaattatatcccttggttctcagacccatttaaatttaaaaaatttaaaaagtaaaaaattatagttaatgaagtagggaaatatttcttatcactctggctgtgaataaaataatagtgaacatttattagtagtgataatgtcttccacttctttgatatttcccttcttttaggaagtacttcagtacttcctaaacgcgaaagatttttttctctacctgattttcctattaaatatgtaaaagttcatggaattttattttctccttaattgtgtataaattttccccatagtatttctgaacattcttctgagcttcttagtattcctgcttcttaaggacttattcatctaaaataatagtataaccatcaaatgtctatcttactttgtttactttttttaacgaaaaagatcattttattgatgagcctaggaaagaacatttacaatctgtgaaatacctactatttaatcttatttcttttttgtacaacgttaagtctacggtatagacctacttatctttaaaaagcaaaagttttttttccctagtttgaaatattttgatcataacaaaactttttccaggatcttcagcctgttaaacaagaaaacgaaaaaccccttccagaaaacatggatgcatttgaaaaagtgagaacaaaattagaaacacagccacaagaagaatatgaaatcatcaatgtggaagtaagatatctcatgtctttaaaaaaaaatttttgatattaccaatcaagatgcaaatgagatacttggtgatttagagacatagtccacatcaagattatactgcttttggcctttaaaatatgctgaaaaacttaaaaagcaaagatttcagagattgtgatcacagaatgtgatcctttacatcttttaataaatgtaaagatcgaaagtaagatgaattttcaactgtaatatattaattctggtttttgcaaacaatcagttccgatttaaaaaaaaaaaatttcaagagacagggtctcactgtgttgccctggctgatcttgaactcctgggctcaagcaaccctcccacctcagcctcccaaagtgctgagattataggtgtgagccaccatgcccagcactgatttaaaaattttttaatcattctaaggagaagttcaaatgaaagtagttcatactttgttattatttgaaaattacttgattgttttgtctaaattttttaataaaaggaattcactttaagtagtataataccatgaaagccaagtatctgtttaaccattttatggttatcacagtcataaatagtcagtcgaaatgaattgagggctgtgcgtgcagtggctcacgcctgtaatcccagcactttgggaggtcaaggtgggcagatcacctgaggtcaagagttcaagaccagcctagccaacatggtgaaaccccatctctactaaaaatacaaaaattaggcatggtggcaggcgcctgtagtcccagccactcaggaggccgaggcaggagaatcacttgaactcaggatgcagaggttgccctgagccaagattgcaccactgcactccagcctgggtgacagagcaagactctgtctcaaaaaaaaaagaaaaaatgaattgaatttttcaataagattggaaaattgaaccgcaataggtgaaaatcacatacatagtagagtggaaatagtaggttaagaataaggatctccagattcaaattacgccaccaactaacagataataaacgtaagccactgaaatcatatcaaccaatcaattacatttaatatgtaggcattagacaagaacactatttatatttgggtaatattaattctctcaatttcaaattgtatttgtcaccctacagcaggtgaaatagtttgtgttaagtcaagactgtgtatagttgttggtgacagcatattttaaaggaaagagtctcagaaagttatagactgggttttcaggctagtctgagccacagtttcctcatctgcatcattttggattgtcttaaagatgccacttgatttctgttaattgactcccactgtacaggtatcagatgtttctaaaatgtagcagaagtggtttgtacagttgtgagaactgacagattttgttataccttttctttattgcctcttgtatttatgtattaaaaacccctctagtggttatgaacatacgaaaaccatatcttatcaactacattgtaaaaatggtcaattttatatttcatatgtgttcattcatatacttcaacaggtctgttttttataagagtcttcatttcatcttcatcttgaatagtcagactatgaaaaggttaattaaattattattaagtaaactgcatgtttcttttgtcaggttaaacatggtggttttgtttattaccaagaaggttgttgcttggttcgttccaaagatgaagaaggtacaccacaatttttctttttacgtgctctaattttcagatttcatattttttataggaaatttattaatttctcaaagatagagaaaagatttttttaaagattatttctgaatttttttttaatgactagtttttaatatctgggtttgtgtaagatatagttagactcagaagctttggcagggagaatggagacggcatccagcattttttgagcatctgctgtgtcttgggtactatgctaggcacttggcatatattgttgattgtcatttatattcacttactttctaggttctgtatggtctgtaaatactaaactagactataacaatatcaaataatgtctcataggttgatgcacagaatagtattgaatagtataaggtaatattaaataacttattgtcagttgatgtgcaagttaagctgccatcattgttgaaagaagctaggatatggcctcttacagaatgggaattctaatttaaaacattaaaatacagttttaattttttaaagtacatcctttgaagttatcactttcgtatttttctttatacagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttggtaagccaccaaccaaaatagtcctctgtgttgaaaggcaacggtaacacttttgaaacatttttttgtcgcatgtgagggagggagaaggtgaatgcctgattcatgtatccctatggactatacatcttcctatgtacctcttattcaggagaccttcccttatttaattatatatctagatgggtaattttaaaatactcatgtttttaaaagtgttataattagagtccatgtcatacaatatgttttgatttatcagaattatttgccaaattattatctagaataaatttttacacgtaagttgcatcttaatattttattcaactttaagcttgaatgtatttttttaatttcatgttatcttatagagctgttacagcataaagtcactaccaaagaacttggtatgtgttgaactaacctgtttatcaatggaagctgtgacatttttagtaatagaactaactttaaatttatcattgagtggtacatatgttacattttgtcctcccttttcattttcagccatcattttctccattgtttaactaaatgttgttgcagtgaattgaaattataccctaactattgaattctaagacatatattttgtacattttataacctttaaaatcatggtgcatattatacaatgatgacttacaatcactgtcagccaggtggcagtcatggtgtaattgtgtgcaaacttctgttgacagcttctggtgggatcaagaatcagcattaaattgtgtttggtagttggagatatcctgtggcttgaaagcagacagagaaggtttacacatgagagaaagatgcaatattccttcagacttacagtttcaagttgtagattgagacggaattcacctcctaaaagcaaatgtgactttaccaatgtctttcctaaatattgagcatttagctcttatttagaaacctgagtaccctgagactgataactacttgaaaccttggaatggtgtagtagtggtttattctcaggaaagctctctggcttatatacagcacagattagatacagtcaaatatttagatttccagggataaacttgcacatgttctcactggcattcaaaattagaatgtgctgtgcttttttttttttttttaatggagtgtaggtgattatgtataattatctcattttctttcagaatgggtaaaggacgaggaagatgaagatgttttattctacaccttccagaggaaccttcgctgtcatgacgtatatcgagccacttttggtgataacaaacgtaatgaacgcttttacacagaaaaagacccaaggtactagaataatataattaaatctttctctccagaaccttcctccagttatttaaagtactgactttggttgacttaaaatgtttattttggttggaaccaggaataataaggctaaaacgatcattcttttattagttgtttgtattcaaaattggagtctggtaatattcaaaatcagagtaaatacagatatatcactaatattttattaaaaactgaaattgtttttgtgaattacaacatagttcattcatgtaaattcataaagatgacctagaactgctagattgtgaacagactgagtctgtttcacctttgcatcttaattgataagcagggtgccaggtttgtatagtgctatttagtcagtatctattgcttaaataaatggtatatacttagataggtatctctctttcaaactaaaaccccttgttcctgatgattgttgagtaccttttaaccattaaattcttagtaatatatagaagaatttaaagtatgtgttgctactaaattataaattaaaactaactcaaaaatgtattattgtgctaggtgaaaaaattaaatatatgctatggtttcaattgggtatcaaggaaaaaagatgcatttttaaaagattgaaaggaaatacacccaaagtactaacaatggttttttttttacttttctttttttctttttgtaataagcattattatttttataatacattttaaatttaaaaataattgtcgatagaaataattggaaaaaaagattaatgtctagttctttatatttcgtatattctcttagacacattttaccctagagccacttgtgttctcacttcctgtaaccacatatctaacaactatttggtcaagtagtttatttttaatttgtcatcaccaaactaagcaaacaaaaatatataaaaacagcgaagaaagtgttgaaaataaagagcaaagtagggtaggggacttgccctacaattatatattaaagcatataaagcaataacagtaaaaataatacaaattgatagacaaataatagagcttagaataactctaaaacatagatcctagtctatgtgaaaatttatatgataaaaggcatcacaaactaatgaaaaatgaatcggtgttattttataatgcaatgggaaatactatttgggaaaaaataattttcatcattgtatatgtcagcatacattcctaagagatttaaagaacccattgagaaaaataattttttaataagatgaaaatataagctttttagtcagcttggttggaatatttttgaaacataaaatcaatataagaaattacaaagggtagtagcagtctcgattacgtaaaatattaaactcaagtcaaaaaccacaaaaactattgtaaatagttaaaatctaggtaacaaaatggaggaaagtgttttcaacaaaaagacaagttaatgttcttaattttttttttttttttttgaaacagagtctcactctgtcacccagactggagtgcagtggcgcaatctcagctcactgcaacctctgcgtcccaggttcaagtgattcttctacctcagcctcccaagtagctgggattacaggcacctgccaccatgcctggctaatttttgtattttttgtggagacggggtttcaccatgttggccagggtggtcttgaactcctgatctcaggtgatctgccagctttggcctcccagagtgctgggattacagttgtgagccactgtgcccagccaatattcttaatttttaaagagctatttacatactaataatttaagctacattcaaagtttaaaatagacacacatttcacaaaagaaataacgattgacaaataaacatggtaatgtgatccaatacagaagaaattttaccaaactataagcagttgttatttgggggcattgggattctttacgtttttcagtagtttcagtataaattacttttataataaggaaaaatataaatataacatttaaagccactcattatgttagtatagtgcttctaggatattatttgattatattcatcaagtcataaaaatacacttattaaattagtatttccatttctaaaaatttgtcttgggaaaataattgtgaagatcatggaaggggaaaatatcttcatgaatatgtttcttgttatattgtttattataatgaaacattaaaatctaaatttttaagaattatgatatattaggtagccattaaacctgttataatattaggtagcctttaaaaataataatcacaaagactttcaactcatgtagggagaaaattgatatatgaagtaagaaatacagaatcaaaaattgtatctataattacatctatttaaagacacacatgaaatataaatataacttagaaggaaaaatttaaaaagtaaaatagctatgttaatgttttaaatgtgttacgttagtaagattgtgaggggttttcttcctattctattttgttgtaaaaactgggagaaaggaaaaaaaaatccaaaatgcatgcagagaaagaagaaaataaaaataactccgtgtcccttttattccctatttgtgtctcctatagaaagtttatttcctcttctcagcaaaaagctatgttatctactcatgtgattgagaaatgacgtttgtagtttaccttgaaatgcatccaaataaagatggattaataggtgcatagatatgtaataaagtaaatgtagcaaaatgttagcaatgatggaatcaagatggttttttcaacttttctgtatttttgaaaaacatttatgataaaatgttagaagtaaattattttgaatgccctttaggagaaaatgagaaaaataatagctaattgttaaagttacaagtgatattcactaaggaattattttaatttcctatctgcattataaatcaacatgtatactgaccacctctgagatactgtccttaacaaggtagcatgcatctgaaataaactgtgatctcatgtctctctctctctctctagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaaggtaatcctggatgctcgttgttcctatttgggctgttaagaagtgtcacacttcgatcaacaacatttcttgctccaagagctcattgttttataaattgatgccaccttcctatgtataaccaatcccatttcttttcccttagagctaatgcctctacatattttaattgtgcctaaaaagttagtaaataaaacatattctgtcctgagtttatgttaacaaaatcaaacttagtagcttaaaagagcaaacttataaactcgtgattttatgagttggcaatttggattgatctcagctaggcagttcttctgctgatatcagctaagctcactgatgtatctgtagtcagctagctgtcagtgccctcactcaaatgtccagtggttggctaagcactggatatactgtctcaccacccagcaggctagtcaggactcattcatatggttgatggtcacactttatccctgatgcagcgttagttccttcagctcttcataaaacagtgaggactagtatggtctagttctcagtgattgcatctctggatgctgcagccttcgtgttttcttacctatatgtcttctaactttgttccacgtagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaaggtatgtttaattttcagaagttaatactgttaatcaaaatatttatgcagtttagcttaacagaacatcacattttgaatagtggcagcagtgttctttttcttgaaaggaatgtaacttaaatggaatttagcaaagtcactcttgggtttaggagggttatcttagaattacttagaggatcttgctttttatgcagttttacttaagatagtgtcttatggcatggacttcacaagtagagttgagtgctaatatttctctttctgtatatctctctacctcacatatctctgcaacttgagatatagtaaaaactcaggccaaagttggtagctagtgcctaaacactgactgctgttcccccatcccacatccccaacagggacagtagtggtatccactgtgtttttagccactacatgcttttgtctgcatcatcttctgtctgccagttttcttatccgcaggggatgcagggaacaaactttggtttctttcagtgtaggagtagcagtggtctccacagcagcacagaagggtaatagtggcaagactgcttggcaagctgactagttgatactgcttgtggctaccaggaaagataacctgccttcacaagtgaacttcctaaaattggtgaatgacaaccttattgcctagttttaaagcagcattaacatgtgagttgaggtagtaggcactgaagggaagaggatggcttccattttgtttgatatgaaaagagttactgagccagttgatgagcaaacagcatagaccatttatacctccctaactccaatattcttaaaactcctgtaaaaatgcaatttcagtcaattcagtggctttttattgaactttcatgtgcacaatactgtatcgggcattatagaatcgaaagctgttaaagcagaatatcctagccttaaggaagatatagttaatcacaagattaaactagtacacaaaggttaagtgtatcatggatttgaataagtagtatcaaaaacataaaatgtgctgtggggctcaaactagagaagaaggcccaggaaagcttttggtaaagttggttgaatgtgaaataaaccagagaagagagataggattttgacaggtggagaggggatggtattccaagatgagaaagccatcaaatgaagctgtatgctctgacattcagaaaatgttcaggaaactgttaattattctgttttattaaagcgctatacatttctgggggatgaagtcatgatttgactttttgtgagtgtcaatatgaggaatttattaattatgaaaggtaacatttgaagtttttgagcaggggaatggtttgaggagtggcagccatattaggatacactaaaccaaaaagaagtaaggggcaggaagctagttttgagattgttttattggtataaataagaaataacaagggcctgaaataactgaaatctccagctactccctaaaatcaaaagatcaaatgtaatgtccagtctcttagaacactatgtaagtgtcctaaaaccaaaatggtgactgacttggagggatgtccttattgtcttcatctgctggagtgcaaagtatttcttttcacttgctaattttaaaaattttaatattattattttagatagcatttctttttttttaacttttactttcaggggtacatgtgcaggttggtttaatagataaattgtctgccacaggggtttgatatacgtattattttgtcacccaggtaataagtatagtacccaataggtagtttttcaatcctcaccctccttcaaccctcaggtaggccccagtgtctgttattctcttccttgtgtccatgtggacacaatgtttagctcccacttataagtgagaacatggggtgtttgattttctgttcctctgttggcttgcttaggataatggcctccagcttcatccatgttgctgcaaagaacattatctcttttttatggctgtgtagtattctatggtatatatgtaccacattttctgtatccagtctatcattgatggacatttaggttgattccatgtctttgctattgtgatgaacataatgtgtgcatgtgtctttatggtagagcgatttgtattcctttggttatatatccaataatgggattgctgagtcaaatagtagttctgttttacattctttgagaaattcccaaactgctttccacagtggctgaacttacatttccactagcagtgtataagctttcccttttttctacagcctcaccagcatctgttatattttgactttttaactacagtcattctaactgatgtgagatggtatctcgttgtggtttagatttgcattcctctaatggttagtgatgttgagcatttttttcatatgcttgttggctgcatgtatgtcttcttttaaaaatatctgttcatgtcctttgcccacttttttatggtgttggggtttttttctgtttttgtttgttttgcttgttaatataagttccttataaattctggatactagatctttgtcagatgcatagtttgtaaatattttctcccattctgtaggttgtctatttactctgttgatagtttattttgctgtgcaggaactctttagtttccagttgctgatttttgtttttgttgcaattgcttttggcatctttgtcataaaatctttgcctttctgtagaattatatttcctaggttttcttcaagggtttttatagtcttaggttttacatttaagtctttaattcatcttgagttgatttgtatatatggtgtaaggaaggggtccagttttcaatcttctgcctatggctaaccatttacatgttaactggtgccaaatttagacatcttcagttgggaaactggtggagcatctattattatttcagtctgtatgaataagaatgggagagaatatgtaatttctagcaatgcacttgttagaacaaaattctatgtcaggaaagttagaaatgtcatgtggagtttactctgctatatgatttgacttctaagtaaatatgaccttttatattttttgtaagtattcttattttaaagatatgccccagtttccatggttttaaattccactggaacaaacattatgtctttaatttattctgtatcttctatctcttcattttctgacccttcccaaatgatagtacctattacgacttttataatgttctagtcatcatcaagtggaattaaatacttcttgatctttctggttagtacctggtatataataaagagaattttatagatcagaccctttttatgagcctgaataatattaattaatatacatagacagtgccatccatacacgaaagacaaaatctttaaccatagcgtgagtgcattataaaatatttctttatgcagtatctctgcctggtgggcacttgattaaaagatctttttaaattcaatctcagcctgtaatcccagcactttgggagaccaaggcaggcggatcacctgaggtcaggagttcaagaccaccctggccaacatggcaaaaccctgtctctactaaaaatacaaaaaatataaaatacaaagaatactaaaaatacaaaaactagccaggcgtggtggcaggtgcctatagtccgagctattctggaggctgaggcaggagagtcacttgaagccgagagctggaggctgcagtgagccgagatcacgccactgcattccagcctgggtgcaagagcaagactccgtctctaaataaataaataaattctatcttagcaacagaaatgtaaaacccttcacatatttgcctcgtatccttggtcaccatgccatcagtattttctggaagtatttttttttgtcacaaaaagaagttatgatatttaatttaggccagttgggacgttttttgctgtatgctaacatcagttttatttagaggaggagtctgcatattcaggccaattttctttcggcatgtatgtcttattcttttgatgaaataactatagtttgctggtagagtgctaaaactgaacctgtttctctcaggtatctaaggaatgtctccctatctcctggcctacttactctctggtgctgtccattaatatacacagatacactgcaggcttatctgaataggaaatgtggcttaagatatccttgagttagttaatacttatatctgcattagctggatgaacttctaaaagtccatagccttgaaacagtttttattatgattaaaacattaatgttggtcccattagttttagaaaaacaccaaaaatactttttgatttattggaaccacttggtctaaagctaagacagcttactgcgtgggtcacatagagactgtcctgaagtctcatcaaagggcagaaaaacttgagcttccatgggctaaggaaccttgtaccctcgctctgaggcctggttatgaggtttgtagcagtgcttcctttttttcccctctcaagtctcagtttgcttgcttataactatgctaccagatttctcaatttttgtttacattttactctccagttatggcttaaatttaaatagacaagttatcctttaaaacaaccctcaatgtgagaagcatacattaggagcttttagagattgcagatgtgtgtccttactagtgtttcatgaaaatagatttttttttttttattaataagagatttgctcagagaacgtaaactctggctgtagttgctgcaggtggaatggtatcccctttacgcacaaatccccggctgccctttttcaatagtgcccaccagtgatgtttctgtgcctctgattttctaaggaatttgctctttctacaattactcaggaaaagaaaggcaattttcttttaatgttctgcctctcggtaccatttctaacgctctgtcaacctgcttaccagagttctttaaaaggtgtaagagggatgttagtgcaaggcttgaagctggaccctgctgctctgagagaataaattttgattcctttccttttttcttaaagttaagaaccttgagtataatagctgtgagtctctcagagtagatgtgccagaagaggttttgttctgcacaatggttagcctaggagctaaaagttagaaacaaattgcaaatgccttaatgctgctgagcccgtttatagccctgaaataataactgtcatcactgtggctgtccaggcagcagggtaaggactagtgggtaaattatgaaaaacacacgcatgtgaggaatttcacgttctttgagaacagagatcttggcagtgtcggtgggttctggaattactatttgatttgctcttattcttccattttactattttattatccaagattataccccaaaataaacttttatgttaaaggcaatttcatgtaaagctagaatcatgataaatcattttcctatagtttgtcttattttattggtcattaatgtacagttttgttttttatttgaaatatatgttgttgtgataaagtaatccttgaatgaggcatgacgtggtaacaaaaagtaaacgagatatccacatcatcttgtttggagaagacttagaaatttaattaatgatacttggtggcctaaataaagaataaaaatagctgttgtatttctttagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggtaggtcttataatcttcactttcagctcccatttactgaaagcataccgtttgccagatgccatgcagttgttggagttacattagcacggtttcctaatgtagatttcttagaccacagtaatacccaagtgactttagggataggtgaattttttttaaccttaatattcatgtttgttttaacatggattagaaaatttatagcatgtcggccgggcacggtggctcacgcctgtaatcccagcactttgggaggccgaggcgggtggatcacgaggtcaggagatcgagaccatcctggctaacacggtgaaaccccatctctactaaaaatacacaaaattagctgggcatggtggcgggcgcctgtagtcccagctacttgggaggctgaggcaggagaatggcgtgaacccaggaggcggagcatgcagtgagcctagatcgtgccactgcactccagcctgggctacagagcaagactccgtctcaaaaaaaaaaaaaaaaaagaaaatttatagcatgtcaaactttttattttacatgttgtttatgtctgattttttaaagttgattttaagaaaaaattaatagagttggtatgtagttatggcaaaaatagtgaaggtggtagttgactagagtaaactagactgatacagtccctgccctcatggagcatacatctagcaggaaagatgacatgtttaaaaagtcattaataatgtactgactgctgcaaaggaggacatactgagtacagtgggagcatagagcaaagggattttacctagtctagagagatcagggaagttttctccaaggaagttatgtctcaggtaagaccactaggatgattaagagtaaactagaaaggagataggggattccattttgtatagaggccctgaatttggggagaaattatacaattcaagaagtgtagggctggccgggcacagtggctcacacctataatcccagcactttgggaggctgaggcgggcagatcacgaggtcgagaccagcctggccaatatggtgaaaccccatctctactaaaaatacaaaaaattagccgggtgtggtggcaggtgcctgtaatgtcagctactcaggaggctgaggcaggagaatcctttgaacccaggaggcagaggttgcagtgagccaagacctcaccactgctctccagcctacagaagaagtgtagggctaggcacagtggctcaaacttgtaatcccaacactttgggaggccaagctgggaggatcacttgagcccagaagttagaaaccaacctgggcaatatagtgagacctcatctctacaaaaaccaaaaatattagccaggcatggtggcatatgcttgtagtccctgcttcttgggaacctgatgtgggaggattgcttgagcccaggaggttgaggctgcagtgagttgtgattgcgccattgcattccagcctgtgtgacagagtaagatcctgtctcagaaaaagaacaaatataaaggaggccattatggccaaaatcaagtaaaagagggaagattggcagggtgaggagtagagagagatgagacacagaaaaggaaataacaaatatccatattccaggtatactcaatatacagaatatacaaatttatgcaagtagggaacaaattaatatgtaaactatagccttgaatttaaggaaacctcagactttagcatatcatatatcagataatttcacatgtgctgacacaatgaattacaacacaagccttttattcttaggaatttttttctttaattcatttatttttctctgacaatctttaagtaaatattaatatttttatattacaaaagcaatacatgcttgttgaacagatgcaaaaatacagaacaaatcttaaatgactacttctcagtaccatttgcttgctgcacctcttagaaataatcattgttacccacttagtgtattatcttttagataggttttatttggttttacaaacatggaattagactagtctatcaaaatgttgcaattattggacccgagatggaaagaacagttaagcaccatgttcttggagagccaagaggggagaagggaagcagctgctgaatggaagcgctatacctttccacaggcattttagtactgctggcaaacccagatccagcccatcacaggagtagctactgttttacctcttcctttcaaaacttttcaacaagcaactttttctgattgtataattgaagttggggaagagttgggaagtgaaaagaccaagagtgttttatagaaattaatctacatcaagttttataaaagtgaatcttactaaaagtgaaagttaacaatgtcataacaacttgggtattttaaagaagaatgagaggagaatttcctccttatttgattacattttgctgtctccagttattgccccaaagtgaagttttcaaaatgagaatgaaaatatgaagagtgacttggatgtattatttattttctttatgtaaacggtgctatttcattagtttaagcagggtgaaaaccaatttctttatcttttttgtgtgaaaggtagatcagaattagttcttttgtctgttcagagactgcctagtttcaatcaactggaactgatgagtttgagctacattgggggatggttacataacctacaagtaacttagtaaccttacaaataatttaacttactttaaccctacaaagaattttaccgaaaaattttaagaccactttaaattttttttaataaagttaaatgggcctttgaagaggattgtggtagttatcagtaacatcagtaagatttcaggtcttaatggttgagaattccgactacagaggatatagaaaattgagctggtaagactttagtcagcatatttgtagatactcaaaagtgaaaaatgccaatatctagctcttaggcataggaagagtgctatactaggacttctaaccttggtaagtattttggtttcatctgaaaatttaaaattatagtaggtagtgaagaactctttaaaattacattattgtcatgaaaagctgcatttaataaaatgttttcaggccagtcttgctgctcttttctggttaatactgtaggacagcaaggtagctgaaaccaaaagccatgatttatttttagagaccataattctttttcttaaacaaatttgtgctcaacatcagtaggtagcacacaagtggggacagtgcacctcaatgtattttaaattgggataaaacagttattataaaagactcttctttacatacatagtaattcttcatttctaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcggtgagtcagtatattttacctggcatgtaagtgctagaccattgtgagagatgtcaagaataacaatatatatcagggaacaaaagcttatttttttcattcttattattcaatttttgtattcctaaaccagcactggtgaaacttgattctttaacagattagttgatccaaaaagcaaaaggataggtttttaggatttttgcatagaggtaccagactctgtacttatttagtaatattattatttcctttcagttctcctgaattcaggtttaagtagcctctgaatctgaactgttttccatttaacttccattttatttcagctgttttcaagacacaaatattattttgtatttctgcttaaaattcttctccacctccccatctctagaacacagtccagattccccagtataatactcctaatggtctgatggatctctgtagcggcatttagcatcagaccctttttttttttttttttttttttttgtttgagacagttttgctttgtcgcccaggctggagtgcagtggcacaatctcggctcactgcaacctctgcctcccaggttcaagtgattctcatgcttcaggctcctgagtagctgggactacaggcgcacaccaccacactgtctgaatttttttttttttttttttgagatagaatcttgctctgtcgcccaggctggagtgtgcagtggcatgatcttggccagggttcaagcgattctcctgcctcagcctcctgagtagctgggattacaggtgcctgccataactcctgactaatttttgaaatttttgtagcgatggggtttcaccatgttggccaggctggtctcgaactcctgacctcaagtgatccgcccgcctcagcctcccaaagtgctgggattacaggcatgagccaccgtaccagcccgatttttttgtattttagtagagacagggttttccaatgttgcccaggctggtctcgaactcctgagctcaagcagtccgcccgcctcagccttccaaaatcatgtccttttattttttttattttgttttgtatttttttgagatggagtctcactctgtctcccaggctagagtgcagtggcgcaatctccgctcactgcaacctccgcctcccaggttcaagtaattctcttgcctcagcctcccgagtagttgggcttataggcacgcaccaccacacctggctaattttttctatttttaggagagacgggggtttcaccatgttggccagtctggtctcaaactcctgacctcaagtgacctgctcacctcagcctaccaaaatgctgagatgacaggcttgaggcactgtgtccagcccccaaagtcatgtcttttaaatgacatgctctgtcacctccttgcccttatacatgctgtgtcgtatctgtgtcttaatgccttttctttgccctctggaaactcaaatttttccttcacaactcagtttaggcatcatctccttaaaagcatttgtgttcctgactcgtgtatatacccctcacctggcagatggatgttctttcctctgctcctgtaataccttaaatacacttgtattgtagcaatgacaccacattgctgggtaagtcgttgttttcttaccccacaaaattactgtcttctccacggtaggggattttcgtttgtttctacttttaaggtctgtacttaatccctgataaatgggcaggcactcaaaatatattcgttgaatcaattctggattgtctatatcaggagttggcaaacctttttctctaaagagctacatagtcacattttaagctttgcaggccgcgtacagtttctgttgcacattccttgttttcactcaacctttaaaaagcaaaaaccagtcttagctccagggccacacaaaaaacaggcctccaggtgtagttcgctgaccccagcctacagtattaactttttttttccactaaaacttttttgcccttcaatttcagaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggtgagtacgctctgtctctactgtttatagaatgggggaggtgtgaagccataggctactctaagaaaaatgtttttgggctggcacagcggctcatgcctgtaatcccagcactttgggaaactgaggtgggcagattgcttaccaggagctcgagaccagcctgggcaacatggcgagaccctgtctctgcaagaaattaaaaaaaaaaaaaaacctacccaggcttgttggtaagaggatctcttaagaggttgaggctgcagtggaccactgtgctccagcctgggcaacagagtgagacattgtcaaaaaaaaaaaaaaaaaaggaaagaaaaacatttctgttacagttttaccatagcataggagtataacaaagcttttaagttttaaactcagaattatagcttgaggagaacttctaaagttattttaatccaactattaaccgttattcttctctgatacagtgttctttattatctttaaggctttccactgaaagatattaatggctatttccattgctcatttgtatttgtaaggacatttagaattggtgaaaaagcactgaagcatatatgagtcccagttgagaaagccaggcaaagcacgctgtgactctggaatgcactgagtcctttggctcctggtcaccttgacaggctactgcccatcaacatttcagtcctagatttataggctctttatttttagatagtccattcttaatggtcgtttgggcatagtttttccgtattttaattgaaatatcttaccctgttctgaaaatgattatcttttcccagtgtcagaaattacgaagttacattgtagcagttggtttcactgctatcattctcctacttctaggttactctgaaaaataatgactgagatgggagagagtaaattattttcaggattttttattttgaggttggggagtttatactgtgggcttgtaaataagtgttaaatagtagtcacctgtaagtctattttttaaaaacagaaaaatgtggagaatagcctatgcacaaagataatggcagaattatttacagtttaaagaaaaagcaactagattttgacttttagaaatttaaaaggaaatgatgagaaggatatttatgctaggttgcttattatagtgaagactaggagacaaccttttatacatgtataagtcaaattcttcttataagcaccaaaaatcaaccctaatttaagcagaaaagggattaaagggcattaggaaaatgtaggtgtcttcagaccagtgttagaggcttcagagccaaaggcatagaattggcccaatgaaactattactgccgccactgccaagcacaaatcacctcacactgccagtgcaacttctagagctggatatagctgtggcacttttgccagaataaattatctgtgatcactgcttctttgaatcactaactttccatgcagagtgtaaagcacatgtgtctggttgatagacccaagtcacacatgggtcacacagctactcccaagctgcagggaaaaatgggaaagagaagtctagcacttagtatctccacagtgagaggcaggctctagctgataaggttggaggtttttcaaatgcaaaaaagttcatatggtaggcagccaaaaagaattacagatgactcactatacttggttaatgttaatatgagggaaagctaaaaagtatgttaacagaagaaaataaagctaagtgaaaaatacagccttcatttttgttttgttgtttttgtggggtttttgtttttttgttttgttttgttttgttttttgagtcagagttttgctctttcacccaggctggaatgcaatggcacacgaacacagctcactacagcctcgacctctggggctcaggtgatcctcccacctcagcctcctgagtatctgggactacaggcatgtgccaccatgccctgctaatttttgtggtttgttgttgttttgtagagatgtggttttaccatgctacccaggctagtttcaaactcctgggctcaagtgatttgcccacctcagcctcccaatgtgctgggattacaggcatgagccaccatgtgcgacccagccttcgttttattaaattttgtaacactaattataagccaatgggttgttttctcttctttcaccttgggtattttgcagagtttctttacttagcgttttttgcttttaatataaaatgtccaactggtcaaaaagactttattccttgtgtatttttttcatttaaaaatttttaattatggtaaaataccataaaatttaccatctcaaccatttttaagtgaatagttcagtagtggtaagtgcactcataggcttatgcagtcaatctccagaactcgtttttcatcttaacaaaactgaaaccctgtaccgattaaacagctctccatttgcttcttcccacagcctctgtctctgtgaatttgactactcaaacacctcacataggtggagtcatacaaaattttttgtgactggcttatttcacttagattatatccttgaggttcatccatattgtagcgtggatcagaattttattcatttttaaggctgaataatattccatgtaatattgcatgtgtataccacattttgcttattcgttctttggttaatggacacttgagttgcttccaccttttggctgttgtgaatatgctgctgtgaacataggtatgcagatctctttaagaccctgctttcagttttggggattatatgccaggagtggaattgctggatcatatggtaatcttaagcttaactctttgatgaaccaccatactgttttccaaagcagctcccccattttacattccaaccaccagtgtatcaggattccggtttctccacattactgccaatacttgttgttgttgttgttgttttaatataataactaactgtcctaattggtatgagacagtagcatttattgcttttatataagaaaaaatataaatgaataaaaggtactaagctaaaaataaatattgtgaaattagaagataaaccatttcttgttatatgtcatttaaggaatctgaagactttaaaagtaggttataaattacaggccctggttaaggactgagtattctagctcctaggaatctacatggcttgagttattttctctcatattagtatgtatattcataaaatagaatgtttttctgaaactcacttaccaacctcttacttgaagtataagtttctttgccttttttttaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcaggtagtgaaagacaattgtgttagattatcctgaatttacacagaagataataaaaaaaaaacttatccaagctgaagcaaaaataggagctttagagatgtttctacttatgatgcccaaatatcttcagcaccatctctgctcatgctccatgtttaatacctcaggggaatagacttatcatgccttaattactaaattagctaaggtcctttagtcaagaaaaggctattccagataacaagtagtctactactgtaatactgaggcgctctcaagatagcaagtgagaaaaagcatagagcacttacagggaaaaattggaggtaattatttttcatagtctctatagtggcaagggaccataagaaataatgtaaactcttcgtgcatgtattttctttcagcattatccttcaattcacataacggcatatgaaaacgatgaacgggtacctctgaaaggaattgtaagttatactgagaaactcaaggaagccatcgcggagcatgctaaggacacaggtgaaggtaggagaccccctagaagcagggaacatggccaaacagactactacccacagcacactgctcagaggaatatatttcaggctgtagccaaatcatctgcccaggatttagggcaaacaattattttgctatgttgactccccagttaaagtgtacgtaactacatgtctatacatacactgcctcacctctttttcaaaggacagtattaaaatagataggcaggacacaaaggaaacaggaaatttaagaatcagatataacttggagatgcactgccatacaattattaattcatttaacaatatttattgagccgttattcttgggaatctctaaaagacagattctgagatttttgttttgggccatcagtgcccaaactgtttagctgcatgaatttcctctagctagctgtttcagctttatgagataagaatccctcccttttgccttgaaactacatgccatatcagtctccctgtattcatctccatttgtcacccccatccattgctgtagttggtgtttccagggcataagactctcagattccacagggcaggttgatgatctcctgggtttcaaccttgtccgtgtggcaccatatagtcttttccatacggcctcttcctgctttcgctgtgtcagaagtttgtcttctgttgcttgtcccctcccatctttttgttgatgatggtggtttttgctttttattcctttactattatttgaactgagtactcaaagaagaggggaggaatgggtctcgatcttccaaagaagatcccatacaatcttctaattgttctacatgttaactcttccaggctatcagacccctaatattattctagatattcagcctggaggcaatcatgtaattgaggattctcacaaaaaggtatgttatcaaggccctctcagtggacagattcccgaactagatacatgttgttttcacattttcagtggttgcagcaggtttatgacaaagccacttcacaaatgtcctatctatgggtgagacccaggaggggagggagggacactgtgtcaatcaagagaaatgtctctctcttgtacttgatacgtgagctctgttaaagaaaataatttaatcttaattgttggaagccttctgcctctctctcgaatgaaagtattcttgccataaattgctgacttcacggttaggtaaagatggatagataaagagaagcttaaacagtggcattttactacaaaggccttctatttaatttttttaatgtgtttcttttagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattctctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcagttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattctcattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattgaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcatagtcatgatttttggtggaatgttttatcaatttttgaaaattgcctttgtctcatataatgcttttcatattgaactatattttgtctgctattaaatacttccaagcctgatttttgtaattttattttttattcaattacaagaatacatactataaaaaggttttcttcaacacctttccatagcttcacagttcccctcagagacaggcactatatgttcttttgtttttaatgtatcatatgtttgcataggcacagaatgtatgcaaacatatgtttatatatttttctttacacagttggtgatatgttaccattctatactttattgaatacctgtttgaaatggtctcatatcaatgtatatagaactgtcatttttaaaagctgcatactgggcccatagttgatagaactggttttctgttgataagatatttaaatcatttcttgtgtcttctattaaaaacaaattttgcaggccaggcaaggtggctcaggcccgtaatcctagcactttgggaggcaaggcagacagatcaccagaggtcaggagttcaagaccagcctggccaacatggtgaaacaccatctctactaaaaaatacagaaattacccgggcataatgacgtgcacctgtaatcccagctacttgggaggctgcagcaggagaatcacttgaacccaggaagcagaggctgcagtgtgccgagatcacgccactgcactcgagcatgggtgacggagcaagactgtctcaaaaaaaaaaaaaaacagtgttgagatcctttaagtattattgtgcacatgtgcaaatatttctaagtattaggaatggaattattaggtcaaaagataacttcattttttgtgtttatagctatagctgggttgcaagctttctattatttgcttgctatatcttcattttaattctttgtgttttatgttagtgtttcttatgtctgtttttgttatctgagtggttttatcttttaataggctaatttaacccattcatatttgtaattattgtattatttagacataatttggaagccctattttatttgtagttatactattgtttagggtttttttctattaagctttttgttggattgactgtataatttttttcttctagtattctttgaaaatttgaaaattgttatattttatgtctagtgttctttgaaaataattctttgaaaattatttttatgtcctaattttaccattaaaattatgaccacttgaaaataatgtttctcaatgtctagaacaatgctggccaatagaactttctgtaatgctggaaatgttctatatcagagccatccaatatggcagctaatgagcacttgaagtgttgctatgacatgggaactgaattttttttttttttttttgacacaatctccctctgttgcccaagctggagtgcagtggcatgatcatggctcactgcagcctcaacatcctgggctcaagtgatcctcccacctcagcctcctgagtagttgggactacaggtgtgtgccactatgcccagctaatttttttcttaagagatagatagggtcttactatgttgcctaggctggtctcaaactcctaggatcaagtgatcctccagtcttggcctcccaaagtgctgggattataggcgtgagccaccatacccagcaggaactaaatgtttaattctatttaatgtaatagtcacagtggttaatggctactgaacagctcaaatctagagttactctttttcctgtgcaaaacaaacactgctctctcatttgcttgctcctgtgtgccccctcccacccacacaccctccctgctaacatttcccatatagaatcaaatcactaagatttttgttccagaataccttgttttacattgtgtatcaaaaattatttaaatcaagttatttccttttccttctttaatacattgtatctcttagaattgttatgttttgttggatagtcccttgactattctttcagaaagtggccacacatggtaaaatgtgggtccttgcttttccatctctgttttgctctttgaatggatacagaattccgtttccatta

SEQ ID NO: 14130 - DNA, 47347 bp, Human
  misc_feature (1)...(47347): n = A,T,C or G
agaccatctaggtttgtataagtacgctctatgatgagagtaaaatgaaattgcctaaggactcatttctcagaacatatccctgacgtgactatactttcataattttcacctttgggaccagcttatggtattggcaggggtctcccttaaaaccaaaccaaatacacaacaaataatgctaaaaggtagaggttggaaaaaaaaaaaagtttcactctcgcccaggctggaatgcaatggtgccaacactggaccagactcctgggcttaagcaatcctcccacctcagcctcctcagtaactaggaatacaggcctgcaccaccatgccttttttttttcttttttttttaagagatggagtctcactatgttgcccaggctggtctcaaactcctggcatcaagcaagcctcctacctcagcctcccaaggctctgggggcagaagccactgtgctcagcagaggtggatttttaatgagggataaagcatatttttacttgttagggattgtttcatgccttgatctctgtccgtctgcctagttccagagagaaataacagagatgttctcattcccagcaaacgtttgtttttccttccttggatttctgccctgagtttgtggctgctttcctacagtgccgacctaagctagataaaatagaaatttcatgacaaaacaaaggagatttaaaaaaaaactagaaatttcaagaatgcttcaaaatctaaagcgcagagtactttgcacacagggcagttattcctgccacaccttgccactacaggtggccactgtcagaatgcgatgttccaccaatgtctcttcatttcacaatttgaaaaattttttttgtggaggcagggttttgttatcttgcccaagccggtctccaactgctggccccaagtgatctttccttggcctcccagcagccacttgcctggctttcatttcatacatcattattgaatagcaggcattgtcctatgtgcttggtaatacatcactgagcaaaacagacaaaaaacggccattgaggataatcctcaatatataataatatatatattatagagaggatgtggaatatacatatatatgtgtgtgtgtatatatagagagagagagaaagactcattgtgtcacccaggctggagtgcggtggtgtgatcttggctcactgccgtcttgactcaggtgatcctcccacctcagcctccaagtaattgggacgacaggcacgcgccaccaggactggctaatttttttgtagagacgggttttcgccatgttggccaggctggcctcaaacaaccgggctcaagtgatccgtccgcctcggcctcccaacttgctgggattacaggcgtgagctaccgtgcccagtctctagtgattatattcttgccctgtttagccattatgtctctttactcacaacagtttataagtgaaactttgccttaccatttgcatgagtcggcctcagcttgtcattatatataaagcttactaatgtaaatgacgagttaatgggtgcagcacaccaacatggcacatgtatacatatgtaacgaacctgcacgttgtgtacatgtactctagaacttaaagtgtaatacaaaaaaaaaaaagtttaaatatgattggactctaccccagagcccagttttccagaaattagaaacagatatgcctaagacccagagggttatttattactcaaatctaaaacgttgactcaaaacctcccctaatgcccacctttggcaaacgatgcttaaacctttgcacgtggcttcaaaaattacctggctgggaacgcgtagctctggcggggcactctgcctccaagccaaaagggggcagtggactcacagagccgctgctcggccctccgatccctccaccccaccctgggaacgtcacgacctcctctcgccgcttctccccgttgctaatgcgcaggcgctggcgggatagcgcgccgccgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtaagaaacgctgggtggggacaccagcgaccgcgtcgggggcgggggccagggggtgcccttcaccccaaccgccaacggacgcggtcccagcgcatcccccggccggcgtcctgcggccagcggagccgttcagtttgggagcgccgcttggggctgctcgacttcggctgggagcgcggagctgcggcgccaaatgcgcggggccccgggagaggcgggggcgacaggggcggcgggacgcggggccggacggcgagcggcttggagcacacaaccccctttccagctgcgcttaccgcagcgcctctgacctttaacctgcagggaaagcttccgcggcgctgcagctttccccgcccgggagagccgcgcgcagcgccggggcttccagggcgcacggctaacgccggcacgagtgagacgtgggagaggccgaccctcggctagtggccgcaagtcccggcctgcatcccgtcactaactcccgtgctttcacgggacggacagaatgactccccccactttcacttttctctcacggcaaatctggccagggtcgtcgctgcctgtgggcctggatcttttcagaagaaatggaacggccccagggttctcactgcagggggcatgtccaagcttccgatagatagctcttttgttaagaaataattcttccaactcgggcagataccatttttgtgcagtacgaatgttgccaggttgtcccataatcttcagtaagtaggtcagcctttaaaaaagtaaccggaaagcaaaagcagaaagacctaaaattacggcctttagggtttagtaccgctagaatttgtaaatggaccttcgattttgagcttttttgaaccatttctgctgtgtggttggtgatactcgatttttttttctttttttttttttttttttgagagggagagggagtctcactgtcgccaagctggagtgcggtggcgcgatctcggctcactgcaacctccgcctccaggttcaagcgattctcctgtctcagcctcccgagtagctgggattacaggacacgagccaccacacccagctagtttttttgtttttgtttttgtttttgttttttgtatttttagtagaggtggggtttcactatgttggccaggatggtcttgatactctgacctcgtgatgtacccgcctctgatccacccgcctcggcctcccaaagtactgggattacaggcgtgagccaccgcgcccggccgatgattgtttttaaactttgctttaagtccagttagtatatctgaaaaagcgatgtgtatttctatcattaaaagtgggtcgcggctgggcgcggtggctcacgcctgtaatccnnnnnnnnnnnnnnnnnnnntcccagcactttgggaggctgaggtgggcggatcatctgaagtcgggagttcgagaccagcctgaccaacatggagaaaccccgtttctactaaaaatacaaaattagtcgggcggtggtggcgcacacctgtaatcccagcaactccggaggccgaggcaggagaattgcttgaacccgggaggcggaggttgcagtgagctgagatcgcgccattgcactccagcctgggcaagaagagcgaaactccgtctcaaaaaaaaaaaaaaaagtgggttttatgaaatgttgctaatcttagtttttcaaggggcatgttagtttcttctaggaaaggtttttttgttttgttttatagaaatggtggggggcctcattttgttatccagacagatctctggcctcaagctatcctcctgcctcagcctgttgagtagctggaattacaggcaccgcatcttaaggaaggattttgagggagcaaacatccccaaacacacaccgtctgtgtgtctgccacacaatgtataatccctactcttggggaataaaaacaaaacagcatacaataaataatagtataaatataattcgttgccgtttttcagtgacaagaccatctacagcctcttgaagtcttttatgaacttgtctagaaaaatgcacctttagataaaattttacagacagtattaggagttaacagaaatctatttctgaatcctagctaacaaccttagtctacaaaataattgttcgacccttcaagaaagactgggtaaaaaactatttgaatcaaaattttttttttttttttttgagacggagttttgcccttgtttcccaagctggagtgcaatggcacgatctcggctcactgcagcctccacctcccaggttcaagcgattctcttgcctcagcctcctgcatagctgggatcacaggcgccgtccaccacacccggctaaatttttgtatttttcgtagagatggggtttcaccatgttggccaggctggtcttggactcttgacctcaggtgatccacgtgccttggcctcccaaagtgctgggattacaggcgtgagccatcgcccctggcttgaaccaaatcttaaaagtcaggtggaatttaaatgagggagaaagtaggaatatgttgggggaataaagaacatcgtagtttgacctgaacagaggcccctcttgggagtgataggaaatgagaatagggggaagtcggattataaaagaactctccattgtggtgttcacagtgccaggcaccttgtgaatgcataataaatattgaatgaataccaagggaaggggttaaaactttgttcccttgccattaaagcagcactgatggtctgaagctggagaataaggataagtcgttctgtgaatgcctggcccctagtaagcattcaacaagtgatttgttgaatggaagaaaattgaataaatttttgagccagtcaatatgaacatttttaaggctcttggtatacattggcaaattacttttctaggaaggttaaaacagtctaaccttccaccaacagtgtataaagaatgtgtgtgttggctaggtgtggtggctcatacctgtaatccccacactttgtgaggctgaggtgggcggatcacttgagatcaagaattcgagaccagcctggccaacatggtgaaaccctttctctactaaaaatacaaaaagtacctgggcatggtggtgcatgcctgtaatcccagctactcgggaggctgaggcaggagaattgcttgaacctgggaggcagaggttgtagtgagccgagattgcaccactgcactccagcctaggtgacagagcaagattctgtctcaaaaaaacaaaaaacaaaaaacaaaaaaaacttgtaaattttacttttgtattggctactcaaggccagtttatcaggctggatcctatttgaagttgggaagaatgggaagaaaacagacactgctatcagagcagccttaacttacaccattacttacctacttctttctcatctcttcagggtagagaccatctttattatcctatcccagggtcaggcatagatcctggaagacatcagggactcaatcaactgaaaggtgtagttagggaaagggagagttgctttttttttataaggttgagaatccccatgcagtagcagcagtgagtgttggatggatggatggatgcatgcatggatgcatagatgcatggatggatggattaatgtttaaaagcattttttttcagtcatccagtcacaaaattatgggggaaaaaaaggaatgtgtgtgttgccttatcttcggagttaaatttagtcttggaaaatatagtcatatgttatggggatgtgttctgagaaaagcatccctaagtgattttatcacagatgaacatcatagagcatacttacacaaaactaaatggtataacttaccatacacataggctatacagcatagcctgttgctcttaatttacaaacccacacagcatgttactttagtgagtactgtaggcagttttaacacagtagtatttatgtaagtaacaaatctaaacgtggaagaggtgtagtaaaaatacagtgttatgggtgtaaacttgtggtaccgctattgtatatgcagtctcattcattgactaaaacattgtgcagtacatgactatatattgatctaatgagtccctggaattcattcagataaacaaatagtttatctccctaagttttcattaggaggtgacttctttgagtctaatgcaccaatacactggtgttgattttaggatttctggaagagatttcttatttgtttattactttaatttttgtggtaatccttgtatttaagcaaaatttaaaagcatcaaacacttattcaatgaaaaataagtctcccttccattcctgtttccaaacttgcagtttctttccttggaggtacttattggatccattttctttcttatgtgtccttttaagatgtagtttttctttttctttttttttcttttgagacagagtctctctctgtcacccaggctggagtgcagtggcacgatcttggctcaccacagcctctgccttccaagtttatgggattcttctgcctcagtctcctgagtagctgggattacgggcacccgccaccatgcctggctaatttttttttttttttttatgagacagaatttcactcttgtggcccagactggagtgcaatggtgcaatctcggctcaccgcaacctccgcctcccaggttcaagtaattctactgcctcagcctcctgagtagctgggattacaggcatgtaccaccacacctggctaattttgtatttttagtagagatggcgtttcaccatgttggccaggctagtctcaaactcctgatctccggtaatcagcccaccttggcctcccatagtgctaggaatacagatgtgagccaccggggccggtccaagtgtagattttcttgtctttaggcagcattttaaagttttatttgcctacctagatcttgcatgttccttattgggtttatgcctgagtgttatgggctgaattcggttctcccacaaaatcatatgaatcccaaattcctatggtgatgtcctgaccaccagtacctcagaattgagtatattggagataaggccttaaaagagataattgagttaaaattagttcattagagtgtaccgtaatccaaaataactgatgtccttctatgaagaggacacagacactcagagggaagaccgtataaacatataaagatacatggagggctggggccgggtgcagtggctcacgcctgtaatcccagcactttgggaggccgaggcaggcagatcacgaggtcaggagatcaaggccatcctggctaacacagtgaaaccctgtctctactaaaaatacaaaaaaattagctggcgtggtggcaggtgcctagtcccagctacttgggaggctgaggcaggagaatggcatgaacccaggaagtggagcttgcagtgagccaagatcatgccactgcactccaacctgggtgacagagcaagactccatctcaaaaaaaaaaaaaaaaaaaagatacatggaggggtgggcatggtggcttatgctgataattccaataccaacacttgggaggtcgagacaggaagattgcttgagcccaggagtttgaggccagcctgggcaacacagtgagaccccatctgtacaaaaaataaaaaattagccaggtgtggtggtgtatacctgtagttccagctactcaggaggctgaggtgggaggatcacttgagcccaggaggttgagactgcagtgagccgtgatggtgccccctacactccagcctgggtgggccttgttttaaaaaaaaaaaaaataaaaaagacacatggaaaaggcaacccatgaatggaaaaaagaaacttcagaaaaagccaaccctcccaccttaactagattattttgaagcaaatcttaaatatcatatagttttatttgtaaattatttaataagagtgttttgtgagtttaattataaaacatctttttatttttggcaggtagatcatggcaaccatagaagaaattgcacatcaaattattgaacaacagatgggagaggtatgtctagtttacggttgatgcactggcccaccaaacttttctaattcctactaaatgcatataccaggttctggagttccagaaataaaagatattccctaacttaagatagcttttcaagctactgagagatagttgaataatcagacaattcatagtagaatgtggtaagttctgtgacaggtcattgtatcaggtgcaatgggagcacagaagaaaattgaaaggaatgaagggaaggaaggaaggaaagaaattaaagagctgtagagtgagtaggaatgcttttgagggaattctttttagagggtacaatctgagcctagttttggtgggatcagtaggagttcagcatcaatactgacatcttcatttttttaaatggttgtgtcctattacttagtaagagataccacataatttggaagttctcaaagtattatctggggacacttcagagaatcaaccaggtgaagaccatttttataataatactgaaatgttatttgccttttcagtattgttctctcccaggtatacaatggaattttctacagactgtgtgacatgtgatgatactatatgatgaaatgtgtcagcatttataaggtgtacataactcaatgaatcattgctttccggatgaccagtgtataatgttacaaaattatgcatgagtgaaggatccatttaaattgcaggatagaccaacagattttaatatagtttatgactctacattgctgctaacctttgaaaagctgccacttgttgagttgatgtagtgtcgaacaactttcacagtttgaaaagggtattaaaatatccttccccttttcaaccaataaatacgaagctgaattttctttaacatatatacatatatgtatgtatgtatatgtatatatatggtgaagaaataggtttccggctgattttttgtggccattttttgtgctcacgtgcctggctgatgttttatatattttgtagcaacagggttttgtcatgttgcccaggctggtctggagctcctgggctcaagcagttcactggccttggccttccaaagcgctgggattacaggcgtgaggtgctgtgcccagccttgttataaccaaaacaacatagtctaacagattaaataaagaaacagatatgagattccaacttctgttaaactagatattaaagcaatttgtagaaatgtaaaacaaagccactctctgcactacatttttgtttgtttggaaaataaactttttagtcattaagaaataggttataatgggtacaaaaaaataggatgaatgaattagacctagtatttgatagcacaacagagggactatagtcaataatttttttttttttttttgagacaaagtctcgctctgttgtccaggctggagtgtagtggcgctgtcttggctcactgcaacctccgcctccctggttcaatggattctcctgcctcagcctcctgagtagctgggattacaggtgcctgccaccacgcccagctaaattttgtatttttaatagagatggggtttcagcttgttgctcaggctggtctcaaactcctgacctcatgatccgcccacctcagcctcccaaagtgctgggattacaggtgtgagcccctgcgcccagtcaataataatttaattatgcattttaaaataactaaaagagtataattggattgtttatagcatacaggataaatgcttgaggggatggatgccctgttttccatgtgattattatgtattgcctgcctgtatcaaaacatctcacgtaccccaaagataatacacacctatgtacccacgaaaattaaaaataaatttaaaaaaattatgttaacatttaatgggttgttaatttttaaatgaatcaactatttttaaaatttctctttgaatttctaactcacatgcagaaaaccccatctctactaaaatacaaaaaattagacaggtggggtggcgggcgcctgtaatcccagctactcaggaggctgaggcaggagaatcgcttgaacctgggaggcagaggttgcagtgagccgagatcgcaccactgcactccagcctgggcaacaagagtaaaactccatctcaaaaaaaaagctctttggaaccctcagtaatattttagaatataaagagtcctaaaagctaagaactgtttacataatttactactcttctctattgaaggctctttggattgcccaaatattcaattattacaattattatgctgcagtaatgtccttttactcatttaagcagaatgtttcaacccaggagcagttggaccatgaatgcgccaaatgctcttctctaagaagtcagtatgaactattagtcttttatccaaacaatttgctttagacataaactgattagtgaatcagaactttgttttaaattttgcatagaaaagaatcttgaaataatttcaggaaaataaaaatagaaaaaatttggtacagaaggaacaggattggaattttggaaaattagaaacaaacggactttgccattttaaaattgaatcaaggaatttaattggcttaatgatgtttaatctgggatatatttgctgaataacagaaactctcaatgctgaaatagttctgtgtattcatgaacttgttcctcccccccagatggcagatggcagttctgtcctcccaattgctcaagccaaaattttataatcatccttgactcttctttcttcatattccccttcagtctatcagcattattttgttacttctctcttcttaaaataaataaataatatataaataagtaagtaaatcccaatttaattgtttttcacccccagcatggctgctaccctgttcctggtcagtatttctgcccatatgtcataaccagatattgatggtacctgcagtagtgtcctttctgatctcccttaattttacttctgaacttttttttttttttttttgagacagactctcactgtgtcacccaggctggagtgcattggcgcgatctcagctcactgcaacctccgcctccctggttcaagtgattctcctgcctcagcctcccacatagctcggattacaggcacatgccaccatgcccagctaattttttgtatttttagtagagacgggatttcactgtgttagctaggttggtctcaatctcctgacctcatgagttgcccgcctcggcctcccaaagtgctggggttataggcatgagccactgtgtccatccccttttttttttttttttttttgaggcagagtcctctgtcgcccaggctggagtgtagtggtgtaatcccagctcactgcaacctccgcctccagggttcaagcgattctcctgtctcagcctccccagttgctgggattacaggcacccgccaccatgcccagctaatttttatattttagtagagacagggtttcgtcattttggccaggctgggcttgaactcctgacctcaagggatccacctgcctcagcctcccaaagtgctgggattatgggcgtgagccactgcacccggcctactcttgaacatttgcagtctgttcttcacactaaatttagaatgctttttttatacttcttttttttttttgagacagggtctcactgtgttgcccagtctggtctcgaactcctggcctcaagtgattctcctgcctcagcctcccaagtagctgggattatagataatgtcactgtgcctgtctgattcctttttaaaaaataaaatcctgtcactcctctgctccaaaccctttggtggctctccatttcacacattaggaaatctagacttttgtttggcctacaaagccctctgagtcccagctgtcactcagatcccatattctactgtaatccctgtcttcccttctgtcttactcatcatatatctctattgctgtgccttgtgcctcacatgtgtcaaacacctccctcctgccctgggacctacttatatgctctgtttcctctacctggaatgttcttcccctaggtagtcctaagccttggtctgtttcttcactcaggcctttgcaaaaatgacacctccttagcgtgagcttccctcattgccctcattctgttactgtctcaccttgccttgtttttcttcatagcatttagtaccgcatgacaatattattatttgcttatttattatctgtctttccccactaaaataaaagcttcatgaaggcaaaagttttgttttattcactgctacatcccagtatgcagaacagctaatataaatcacccaatatatgtttgtctaaatggaacatgggagggaaggggaaggagggaatcaaaatagtgaggtcaaaatgttcttactattgtacctttgtttgcacatttgtttatttctgtaggatagaattttgtggcaatagaatcggtagtttaaaaggtacgtgtgtgttatattgaatatatatgtaatgtgcttttctaagaagataattgtgtcattaaagaaaaattattgagtttcattgattatttttcatgattttgttagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcaggtaaataactatagaagtgtcttttcctcttacatatataaaaaaaaaattttaatcataagccctgccatgaagactttagatctatgtatattcagtaggaaaaaaatgcataaaattatgtgtaacacagtatctacagtgacagccctctcctatgggccactgtactttcctcacactcatatattttggggattctttgttgcatacagtaagatccactctggctattgtagccaggacaacagcctttaataaaggatacagagagcttgcagaattgttaggaaggttgaagaaacagttctaggccaggttttcaagatcgactattggagcatgctgcaaaactggcttctaagagacctcctacttcataattaggaaattgtcaaatcaggagcagcttttgtagctgtattttccagaaccaagctgcctgtgctacaaacaggaagctgccaaatcaagaagtttggactatagctgctggcttcaacattgtgcctcctttgttgtcatgcacatcttcatgaaatagcaagcagtgcagtcatgggctcctgctttactctggaatgaagtagtatatgttaacattacatcattttagttttcgctagaatagaaaattacacattattcttcaaagactcaaaaacttttatacaccacatgcctgtggttatgtcgatgttttcactgctggttgctatgattgaatacaaatataatgtactctgaagtttgccttcagaaactttttgaagggggtctacttaaaattgggttctatcttttatgatgaaaaactcacgaaagaaaattcctctttggattgaaaaactctgaattcataaaacacgaaattttgtctgtatatcctgatatcatctattcatccaatgatatttgtattagttttggaaataaaggtagaaagtggatacagtcacagatttataagaagttgttttatcaacaagacaaaagtcacaaaaaaatgtataacattatatgtaccttaatttttctttaagtagtagacttgatattttagaatagttttagatttgcagaaaaactgagcatatagaacagagttcccatattactcccccgtaaatacacacagttcccctattattaacattttacattcatgatataattaatgagcaatactgatacattgttaactgaagtttataggtgtttagactttccttagtttttgcctaatggctttgtttgtcccaggatcccatccaggataccttattgcattgagttgacatgtctcctgaggcttctcttggctaggacagtttctcagactttccttgtttttgatgaccttgacaattacgtgaggagtactggccaggtatattgtaggatgtgccactattggacttggtctgatgtttttctcatgaatgtgggtaaatcccttaatctctcaatatctccttccagacttaggaataatagataaaagattagcaccatttgcaacaggtaggctattaaagagtaatacttgccatagatgctttcataggacatctagtaccagaagcttaagtacttactgaagactgatttttgtggtgatataagaagaaatgatgctatatattacatagtaaggggcagtcattttaagaaccatttaaagttcataaaatcagaagtattcctggaggaattcaaatgccattccattttctttaattgaatttatttgttcacatttcaagattgaaagaaaatgatgaaaaggttgaaagataaacctaaaggaagaaactagtttgctgttttttgttttgttttgttttgtttttgagatggagtctcgttctgtctcccaggccaaagtgcagtggtgcagtctcggctcactgcaacctctgccgcctgggttcaagcgattctcctgcctcagcctcccaagtagctgggattacaggcactctccaccacacccagctaattttttgtatttttagtacagacagggtttcaccacgtaggccaggctggtcttgaacttctgacctcaggtgatctgcccgcctcagcctcccaaagtgctgggattacaggcgtgagccaccgcacccagcctttttttgttttttaaagaagaaactagtttcctttgccagtatcttattagctgtgcctagtgatgagctttttaagtccatacctttgtatagcgagcacatctgcatgattataattacctcaaggaaatttatttatagccccttttctatttaaaaggtttagagttatctctttatgccattataagcttatttttgtcgtcattacatgtggaaaggttctgagctcttcatagagtacaaagtttaaaaataacttgtgaaaaagaaagcaacaaagcaagaccaactgaatgttctttaatttttttaatagaatgagtgctgttgagtaacaacaggttttcgtttttgttttctttttttttttttttttttttagctcctaacagataattctccagaccaaggaccaaataaggtttttgatctttgcgtagtatgtggagacaaagcatcaggtaacattaagaataacctcctaaaaacagaaaaaaaaaataacctcctatatgtgtcgtgttgttgaaataactaccacactaccatgtttcttctactaaaagtaagaagagaaataaaggagtatgtcgtttttatggttcatatttgtagcctataacatttaactaattttttcccagagttctttgtttgtgatatagagtctcactgttgctccggctggaatgcagtggcgtgatctcagctcactgcagcctctacctcctggattcaagaaattctcctgcctcggcctcccaaggagctggggctaaggtgcatgccagcacgcatggctaatttttgtatttttattggaaatggagtttcaccatgttggccaggctggtctcaaactcgtgacctcaggtgatccaccctcccctccttggcctcccaaagtgctgggattacaggtgtaagcccccatgcccggtcccaaagttctttattcacttatattttttaacttcagtgcaatttaatatgatttgtaatgaaataaaatgcatatttcacttttgaaagtgaacatgtaaaaaaaaaattttttttttttttgagatggagtcttgcgctgtcaccctgactgtagtgcagtggtgcaatctcggctcactgcaacctctgcctcctgggttcaagcaattctcctgcctcggccttctgagtagctgggactacaggcgtgtgccaccatgccctgctaatttttgtattttcagtagagacggacttttgccatgttggccatgctggtcttgaactcctgacctcaagtgatccacctgccttggcctcccaaagtgctaggattacaggcgtgagttaccacgcccagctgtagaaacattttttaatgtgaaaactagaaattttggcaaaggaatcatttaaaaataatgacttctgatctttaataatatattacattaggccaggtgagatggctcatgcctgtaatcccagcactttgggagtggaggcaggaggatcgcttgaggccaggagttcaagaccagcctgggcaaaatggcaagactgcctctacaaaaaaaaataataataaaactggtcgggtgtggtggcgcaagcctgtagtcccagctagttggggatatcccttgagtccagtagttcgagactgcagtgaactgtgatcgcaccattacacttcagcctgggccacagagcgagatcccgtctctaaaaaagttatgataaataaaaataacttctaaaaatgtttttcatgtcagaagctcaaaaatcagtttcatcttatatgttgtttaaagggaagaaattggcttatgtcatttctgttctgaaataatgtgacttttatattttcttaaacattttctctctaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactgtatgtattagcttttaaggagaaaatactttttaaagattccagcaaactacaagagtattgaaattaacaaaatatgtcaaatatgtatactttttagtttacagttttccaactaaaaatataagaatacagacctacgtatgtacttttttatttattcaactaatatttattgaatacctgtgtaaaaagcacgtatttgtagtttgtgtttggcaaaaagaatgagagatgcaaattggtttgttttactaatctaaagcaactttgttgaacttgcacataatttctaaagattgatggttatctttggagtttagtatggtagccatgtctcctattagcagcattaagcttacctacagcttacatttctaattgtctgtaaatcctatattgtgatataatagtttaacacatttttgtagctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtaaagtaaaacagacactgagtagctggtcattttgtttttcttcccaatgaaactcaggccaaaatttgtgctgatttgttacaggtcaacaggactgttagattcaggaatgttcatgaatattcatccatctggagtaaaaactgagtcagctgtgctgatgacatcagataaggtgtgtttagtacaatttaaagcttagataattttaagcattttaaaatgttttctaatcacttcctttgctttggtaaattgctttgttcttaaatattccatattacaagttgcctttttttttttaatataaattagaaatgttcggctgggcacagtggctcacatctgtaatcccagcactttgggaggccgaggcacatggatcgcttgaggtcagaagttcaagaccagcctgaccaacatggagaaaccccgtctccagtaaaaatggaaaaattaactgggcgtggtggcgcatgcctgtaatcccagctactcgggaggctgaggcaggagaatcgcttgaacccggtaggtggaggttgcagtgagccgagatagtgccattgcactcccgcctgggcaacaagagcgaaactctgtctcaaaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggctgtagtagttcaccaaaaaaatcagatatgttcataatctcactaggatgattatcccttcaacatgaaagcaacaaacacgtactcttccctcatcttgaaatacgagtcctcagtaagacatttattataggtgtaaaagtcttttttttttttttttttgagatggagtctcactctgttgccgaggctagagtgcagtggcacagtctcggctcactgcaagctccgcttcccgggttcccgccattctcctgcctcagcctcctgaatagctgggactacaggcacctgccaccacacccagctaatttttttgtatttttagtagagacggggtttcaccttgttagccaggatggtctcgatcgcctgacctcgtgatccacccgccttggcctcccaaagtgctgggattacaggcgtgagccagcacgcccagccgtacaattcttaatatttcttttatgctcccttacagatttgttagtgccaaaatactttttttattttttagtgccaaaatacttaaaatatttcaggtaaaaggaaattcttagctcacctccatcaaaatatttacttgagtcaagagtaggaataggactgcaagagctctccttttatgtatccaagtcatccagttctcttagagattggagcagctctatgttagaccaagggtctaaaggaaaaacagtttgtttatttaaattgaacatgaagagtttctgtacttgtcagaagccctttgggagaacaagaagcaaaaatttctcctgaaaactcatatctgaaaacagattttaggaagcctatgatcagggtttctctcaaccatgtttgttttttaaacagggtcccctcttgtcacccaagctgggggtacggtggtggcacagtaatggcttgctgcagcctcgtcctctcaggctccagggatcctctcacctcagcctcccaagaagctagggctgcaggcacgtgacactgtgcctggctaatttttcctatttttgtagagaccgagtttcattgtgttacccagctggtctcgaactcctgggctcaagtgaccctcccacctcagccttccagattgctggggttatgtgcatgagcctccctacctagctgggatctgatttttttttttttttttttttttgagacggagtcttgctctgttaccccgtctggagtgcagtgtcccgatctcggctcactgcagcctccgcctcctgggttcacgccattctcctgcctcagcctcccaagtagctgggattacaggcgcccgccaccacgcccggctaattttttgtatttttagtagagacagggtttcaccatgttagccaggatggtctcaatcgcctgacctcatgatccgcctgcctcagcctcccagagtgctgggattacaggcgtgagccactgcgcccggccgggatctgattttatataacctataagattatttgtcctgtttatgcaagatttgttatatatttgtcacttgatgctttaaggcgctctaaatacttaggctcggaaatcaaatttcatctaccacttactagctatataacattaggcaagttatttgacctcttagtgccttactttctcatctgtaaaataagagtaataaaagtatcttacagtttgggctttagcatgtaattgctaggtgaggcagtggcctcttgccatatattttggaaaacttcacttagccctgtctgcatgattcaaggttagaatgataattggttttactgacatattaactcctttaagaaaggaagggaactaggtttccttgacaaactactctgcccagacactgtgctctcttgtatatctttgtattaaattgttatgacaaccgtatggtaagcttctctgataaattgccccaaaactctgaagtcacaagatgaaagttttctatgttggctaagagcctttaggggcaaaaacttaagaatctagttagaaagaaaaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgtggaacgctgcagggtcctctgcctaggaaaactagagacctttgttcacttgtttatctgctgaccgtccctccactattgtcctatgaccctgccaaatccccctctgcgagaaacacctaagaatgatcaataaaaaaataaaataaaataaaaaagaatctagttagatatgttgctaggtagaagagactatataagcttctaagttttaggtgaatattaaagcatttaaaattgtaactaatgtactttttattcaaatataagaaaatttcttggggcagtgcttaacattatgggcttttctgggcacagtggctcaagcctgtatcccagcagctcaggaggctgaagttgaagagttccttgaggctaggaatttgagaccaacctgggaaacatagcgagactctgtctctaaaaataaaaaaattacccaggcatggtggtacatgcctgtagtcccagctgtttgggaggctgaggcagaggattacttgagcctaggagttcaaagctgcagtgagctatgatcctggcactgcactccagtctaggcgataggagtgtctctaaaaaacactgtctcttaaaaaaaaaaaaaagcatagactttggcagtcagccagtcccacctctactatttgggtcatttttctggttagcaatagaggaatgatgatttctatttcagagttgttatgggagttaaataaaatgcatatataggtattaattatgtaagaacatgataactggtagggttttcagtaaatgatttttggaccattgattaatttggagaaggcacaaaaattattttattctactgattcaccaaaatctcacagaaactgattgttataataaatgaaacatcatgggaacatatgtgttattttagtattaagaacaccaaaaagggccaggcacagtggctcacgcctgtaatcccagcactttgggaggccaaggcgggcagatcacgaggtcaggagatcgagactgtcctggctaacacagtgaaaccctgtctctaccaaaaatacaaaaaattagctgggcatggtggcgggcgcctgtagtcccagctcctcaggaggctgaggcaggagaatggcgtgaacccaggaggtggagcttgcagcgagccgagatcgcaccactgcactccagcctggcgacagagtaagactctgtctcaaaaaaaaaaaaaaaaaaaaacaccaaaaagaaaaaaccatgaagaaagtattaataagaagataccattaaggggttggcccagtaggccatagaaggcaacttaaaaggcttctcattaggttaggatgggaaaggatttacaaaagaatttaataaatttaaatcaaatatatgaaaatctatgaattaaaaattatactcagaaaaactcatgtatcataattagaaattgctaggatatcagcttcttgctctgaaaattgataacaaagtaaaagaaaaataaagcacttacctgcctttcccgtacaaattatatttctgagttgtcaaaagagttgagagaaaattcttttttataaaagaattgtagctaatgcacaagtaatatacacattttcaacaaacattaaaaaaatgaagacaagccgggcacggtggctcatgtctgtaatcccagcactttgggaaactgtggcaggtagatcacttgagcccaggagtttgagaccagcctgggcaacatgatgaaaccccatctctacaaaaaattaaaaaattagctggacatggtggtatgcgcccgtagtcaggaggctgaggtgggaagatcacttgaacccaggagttggaggttgcagtgagctgagatcacaccactgcactccagcctgggtgacagagtgagactctgtctcaaaaaaaaaaagacaaatagatcagtatcttacctatataaagagagttttcaactccagtgacaaaaaagtgaagagaataatgggtaactgatctatttcttttaatgtttgtgtttaacacagtgccttttaacacatttaattaacacaatgtttggcaaaagttggcatcctaggaagtctgttcaacaattcatttgccattttttcccccgctcttcactagtattcttcatattccatacaagtttatagtttgtatagtaagttttagaaattgtactcaggaggctgaggcagggaggatcacttgataccaggagttcaagaccagcctgggcaacacagcaagaccccatttctaaaaatgaaaaaacaacccaggcatagcagtgcacacctgtaggatcagctgctcaggaggctgaggtaggaggatcagtgagcccagaaatttaaggatgcagtgatctgtggtcgtgccactgtactccagtctgggtgacaaagggagaccttgtctcttaaaaaaaagtaacatatacggccgggcgcgatggcccacgcctgtaatcccaacactttgggaggccgaggcaggcagatcatgaggtcaggagatcaagaccatcttagccaacatggtgaaaccctgtctcagctaaaatacaaaaaattagttgggcatggtagcatgtgcctgtaatcccagctacttgggaggctgaggcaggggaatcgcttgaacctggcaggcagaggttgcggtgagctgagatcatgccacggcactccagcctagtgacagagtgagactccatctcccaaaaaaaaaaaaaacaaagtaacatataaacatttcttaagaaatacacttgatgtttttaaacttgtattttcctcagtaaatttctgaaagctcagccctttaactttccaggtttcatttaacatactgttcttttgttggcatatcataatctataattggatatttcagatattgaaaaaaatagtgataccaattcacagaattttaatacccttttttttaaaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaaggtaaggtatcttttgattatcaatgtccttttgtttacatgtctttcagtatttcttaaaacatttttatgttaaatgctatttataaaagtttcagaaaacaaatacaggttgattatctaaatacaggttgattatctcttatccgaaatgctttgttcagaccagaaacacttcagatttcagattttggaatgtttgcattactctgggtaccatgcaggcctttctgaccttttcaaaaatatctttacaccacaaagaagagaatatgcaaaaatccacagtgagtaatacacataggtcttggctcctcatggggaatcgggggaacttgccattggcatgtctggcctgtacatgtgccattttatcatccttagtgggcgtgcttacttgggggagtctgggcgtatacagaaaagatttatctcagctgggaggatcttttttcccttggggacagggaataaacactgaataaactgtaatacacctgctttttgactgcaacccatcatgagaggtcaggtgtgaaatttccacttgtggcatcatgttggtgctcaaaaagtttctgattttagagcattttggattttagtattaggaatgcttaacctacatttctattttcacttagaaaatttaaggcatagtaagttttcactgaaaacctgcattcattatgaaaggttatattctaaatgacaaaatcagtaagtgaatattagaagattagaaatgtggtcttaaaacctaggaattttttcttctaaagatgaagatgtgtatggagagcgaaacacttgtctttctaggcaatcatattgatcctgctcctcaatttctagtgatgaaaattaatgtaaaaggtttagtttaatcaactacagttttaagttacagttgaagaaagtagtatcagaattctgttttttattctgtaaatattaatgcttaggatatagaaacagtttattcagggttttcctacactgcgtttatcatttaaaatattgaataagctgaacacattagtgtataggaggctgaggcgggaagatcacttcagcctgggattttgagtcaaccggcaactagaccccatctctaaaggaaaaaaaaagatatgataaaaatacgctgaattggccgggcacggtggcgtatgcctgtaatcctaccactttaggaggccgagaggggtggatcacctgaggtcaggagtttgagaccagcctggccaacatggtgaaaccccatctctactaaaaatgaaaaaattagctgggtgtggtggcgcatgcctgtaatcccagctacttggtaggctgaggcaggagaaccgcttgaaccccagagatggaggttgcagtgagccgaggtcacgccactgtactctagcctgggcgacaaaacgagagtctgtctcaaacaacaacaaaacataatatatatactgaataaactacatttaagagtcacaataagtaatactttgttgaacatgagattttaagaaactctaggaggcttattgaaaaatatggggaactattttgagtaattatttgctaacattagtttgttattattctaatatcaaattgttacagtttagatttagctatgtgaccacacattttaaaatactctctgcccgggtgcagtagctcatgcctgtaatctcagcactttgggaggccaaggtggcaggattgcttgagtccaggagttgggagaccagccttagcaacatagtgaggcccagtttctacagataatttaaaaattagctgagcatggtggtgcgcacatgtagtcccagctgctcgggaggttgaggtgggaggatcgcttgcttgaacccaggagttcaggattacagtgagccatgatcatgccactgcactccagccttgctgacacagggagaatgtgtttcaaaaataaacatgagtaaaatgttttctgaatttttaaataaaatttaagacctattgtactgtgtataataaagttgacataagttcttacccttgttctaagtaacttttgtatacaaaataaataggctgatagtcttgtagtatcatatatatatatatcatacatataatgttcttaaaaaataattaattgaaaagaatttcgtttaattgagacagggtcttgctgtgtcacccaggctggagtacagtggtgtgatcatagctcactgcagccctgccctcctggactcaagcgataaaatatataacttttaaaaacatattattatatgaaaatatgaagatgcttctcccccttaattatgcaagattttaaaaagagactttaggccaggcatgtggcttatacctgtaatcccagcactttggaaggctgaggcgggcatatcacttgagttctagaccagcctggccagttttttaggcttaaatcttaattccagaatcctatgtagaattgttattttattgcggtgtttggtcaagctcatagcttctgatgtcttcatacagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcagggtatttctatatgttttttttaacttgtatgttgtgttgcttgattttgatctacctttcaaaaatcaaagtatgtttgttgtgcttttaaagtcagaaatatccctgatagaatttcaaaacagcagctaaaacactcatctgggccaggcacagtggcttatgcctgtaatcctggcattttgggaggccaaggtgggcagatcacctgaggtcaggagttcgagaccagcctgaccaacatggagaaaccctgtctctactaaaaatacaaaatcagccaggtgtgatggtgcatgcctgtaatcccagctactcgggaggctgaggcaggacaatcgattgaactcgggaggcggaggttatggtgaaccgagatcacgccattgcactccagcctgggcaacaagagcaaaactctgtctcaaaaaaaaaaaaaaaaaaactcatctgcatatagaaacaaaatgtctttaggcttttctcttctgtttatcaagatactgaataagctgggcatgttagtgtgcatctatgcaggaggctaaagccttatgtagataagataatggcgtaataaagcatcctgttaagtcagttataatagcagttattgcgtttaaaagttagcttttataacttttcagcacattttgttaaactttaagtattggcattcatgatgtgttgaatggactgcttttgttcaatgcctagctactactatatcgtaatcaataagacccagatagtttgctcttaccatagtaactacaaagagctccatttgttatgtatcatcttaattagctggcttccagcattattataagatacaaattggccaggtgcagctgctcccacctgtcatcgcagtactttgggaggctgaggccagaggattgcatgagtccaggagttggagaccagcctgggcaacatgccgagacctcatctctattataaattaaaattacataataaaatttaaaaagatacaaattatttaatatattttaacttttagtttttaacttacactttttagccattttggagaaggtacatttataatttattttgttcccataaataattgtgggttttgccattacttttaaggctgcaattactttttcaccaacctaatttatttatgacagaaacaatacatgcagaatactagaaataatacatgtagaagactagaaaatcactttctactatttgtcattcaaataatgcttggacagagttatagccatgctcactgtggagaccttacattacgatcctgttgttttgactcttccattttaaccactcagctgtggatactcttagcaagatgtatgcaaagggattgaatgcatatagatttcacttagcaatatatagcagtcttggaatacctgagggtgactgctcatacttttactatagattataaaattccatggatttttttaggagaatatgtacagctatcaaataaatatgtataccagtagaagttatgagtgcaaagtaatatttgtatctataaaatttgacttggtagaaatagccacagagaaaactcagtagcttaaaatagtgtaatttgatgtagtcaataaaatatatcagtgaagccaatttttatgtaaaattttaccaaagataatttacatggaaaaaattagaaattttttttctacactctacaggaaaattttttatgagtgctataagaaaaagtaattggaataatcagtatcattctaaaaaattatggtaagatttatggacaagggtggagcaaggcaaaacttgatttttcccattgttctttcgtattctaaataaaagatactcttttgttttcttaggtttatgttctgctttggatttaaatgggaggaaggatgaaatgagacagatgtaggaacaggacccattgtgagggaaaaggaccagagtgctctttagaaagtaggggtagtttacctgtttattgttaatgttggtcctcaaagtttttgattgcttgaaatgttttggacagaagaatttggcaaattacaacttttttttcttcttaggattggcttttgtcattcccatctttgtcttcctaagtatcctcacagtcagcactataaagtttcttactctcctgaaaaggaccacttcatctttctcggagtcttacagccttgtgaagtcaaatgtttgacttttcagtgatttccctgcttagctcctagagtctggtaatttcatggttctcacattgaagttttctgatcatgggtttcaagaccttacatctgtaatcaaacaactcagtcctttcttacttgctgagctgaatagcattttgttcctctgttgcatttctatgtacactgtagtttgcagcatattttcacatacactgtttcctttgggcctcaccacataagctgaggttagaatttttaattttttttttctttgtgagatagggtctcactctcacccaggctggagcgcagtggcataatcacagctcactgcagcctcgacctcctgggctcaagggattctcctgcttcagtctttcatgttgctgagaccacaggcatgtgccaccacacccagctaatttaaaaaatttttgtgtagagatgggatctcactttgttgtccaggcttatcttatactcctggcctcaagtgatcctctcacttcggcctcccgaagtgctgggattacaagtgtaacccaccatacctggtagggttagaatttttattctcatttggtggatgaagaaagagatgtagagatgtttagtgtcttgttcaaagcaatcttggtagtagggagaaatagtctaataatgaaacttgaagtttgattttgaaaaatcaagggcagtagtaatatttaagatttttattggccgggtgtggtggctcacacctgtaatcctagcactttgggaggcctacgcaggcagatcacctgaggtcaggagttcgagaccagcctggccaacatgacgaaatcccgtgtttactaaaaatacaaaaattagccaggcgtagtggtgcatgcctataaccccagctactcaggaggctgaggcagaagaattgcttgaacccggggaggcggaggttgccgtgagccaagattgcatcactgccttccagcctaagtgacagagcgatactccatctttcaaaaaaaaagaaaaagatttttattaaacttcataatttttggtatgatttcatgtactttattttacttgattcttaaaatctccttagaagattttaagaatatggtagatcatattcccattttagaaattatatacatgcaacagaagtgaggtggttttggaaattgcatatacttatttctaaaattttattattttcacattagagtcagtctttctggtcgcccatgtttgcaactttagaggcagttactctccctaagcctcactcttctcattccataactgaattttaaccattccattgcttgaatttctcccttcctcttcatttccttcaccatattttaggccttttaaaattcctttcttgatttgttaccctaatatcttcgcttccagtctttcttttccatcttgtcctgtgtgctggtaccagcgttatatttgttaaaaatcaaattatgtcactctgcccagccttcagtagcttcccattgcccatatgttatgaaattaagtccggtctctataacttgaccttttagggccctccacattctgacccagctgctcatggtttctcacacatgccattagctttcttagcccttttctatagctcattcagtttttattttattcttccactgagacaatagcacttactggttcccagtgaactctaagtaaatagttactgaatgaatatgtaatctagggtcatactggtaattaggcgaagtgattaacaaaaagttggaagcagaatccagatctcctaactcaaatgatttttttctatttgtgtggagatgaggtttcactatgttgcccaggctggtctcaaactcctggccacaagcaatgatcttcccacctcgacctcccaaaagtgctgagattataggcctgagccactgtgcttgtgctcagcctccaaggattttgtttttgtttttgtttttttgagacagactggctctatagcccaggctggagtgcagtggcatgatcgcgactcactgcaacctctgcctcccagactcaagccatcctcccacctcagcctcctgagtagctgggactacaggcatgcaccaccactcccagctgatttttgtatttttttaaatacagacgaggtttcatcatgttgcccatgctaactcatgagctccaatgatccgcccacctcggcccccccaaagtgctgggattataagcgtgagccatcacacccggccatccagtgattttttaaaagctatatcggctgggcagggtggctcgcacctgtaatctcagcactttgggaggctgaggtgggtggatcacgaggtcaggagttcaagaccagactgaccaacgtggtgaaaccccgtctctactaaaaatacaaaaaaaaaaaaaaattagccgggtgtggtggcgggcacctgtaatcccagctactcaggaggctcaggcaggagaattgcttgaacccgggaggcggaggttgcagtgagccaagatggcaccactgcactgcagcctgggcgacagagcaagactgcatctcaaaaaaaaaaaaagctatatcacgcaggctgttataagatttcaatacagaaactgctagaaagataattgtagaagcaactaataacttctaaaacagattggtcaggtttagttcttgtcaatgctctttaaaaattcactcaatatgttgaacttttctaatttgaaaaatgtgtataattcaatttataaacctaaagatatacaggcattttggggaagctcactctttatataggaataaatctttgtcttttcagtctcaaagacttgtgaaatggactattgtttcttcagccaacattagctttctgattcagaatactagagttttattgagcatgtagaacagattatgaaacattttctctctttataagttaacatggtgtagtaatattttaaataacgagtccctttagtgtgtgttgtaaactatttccattttatgattaaaccagcagaaagttttcagagttaccaccactgttgtgtaaagcaaaaccattatatccagtgtttacacattacaagtattaatattttatttaaatgcaattttaaactattttgcaaaggattttttttttttttgagacagagtcttgctctgtctcccaggctggagtacagtggcacaatcttggctcactgcagcctctacccgctgggttccagctgttcttggcacctcagcctcccgagtagctgggattacaggcacacaccgccatgcccggctaattttttgtatttttagtagagacctggttttacctcattggcaggctggtcttgaactcctgacctcaagtgatctgcctgccctggcctcccagagtgctgggattacaggcctgagccaccacgcctagccttacaaaggacttttttgttgttgttttgcatcttacttgccccttcccccaaaactagtaatttttggtaattcccttagtttttcagacttcctttttactcaccttgggtaattctgaaaagatatgatatattttgttttttaagatgtggtcttgctctgtcacccaggctggagttcagtggcacaatcctggctcactgcaacctctacctcctgggctaaagggatccttctgcctcagtctgctaagtaactgggattataggtgcacaccaccatgtccagctaatttttttatttttagagatgaggtcttactgtgtttcccaggttggtctcaaaattcctaggttcaagcagctcttccacctcagcctcccgagttgctgggatacaggtgtgagccatcactcctggctaaatttttaattttttgttttgtgtgtcggtttttttttttttttttttgtagaaatgggtctcgttatgttgcccaggccggtcttgaactactggcttcaagcagtcctctcaccttggcctcccaaagtgctggaattacaggcacgagccactgcgctcagccaagaattgtcttaaataattgtattttaacttactgctgtagtaaacctttctcaaacattcttaaatatgtaaaaaattttcttctcacttacagaatttcaactattaattgcccttttgttttattacttggtacaatttataaataggtaaaccattcttggctaataatgaacaaaggcaggggttgttttttacatttttatgtaacttttctttgtttcaaacctcaagccttttagatagaagatacctttgaggggccaggtgcggtattttagatagcagatacctttgacaggccaggtgcggtggctcatgcctgtaatcctagcactttaggaggcccaggcgggcggatcacctgaggtcaggagtttgagacgagcctggccaacgtggtacaaccccgtctctactaaaaatacaaaaaaaattagcggggcctggtggcacacgcctgtagtcccagctactggggaggctgaggaaggacattcatttgaacctgggcagagagctgagatcacgccactgcactccagcctgggtgacagagcgagaccccatctcaaaaaaaaaaaaaaaaaaaagatacctttgagaatctgatgaaagctataatagtcattccccagaaaaatacatatggacacatctacctaccccacccagaggtagccactgttaactgtgtggcgtgtttccttctgtactttttaggtatacatatatatgtactctttaacataaattgggtcatctatttaatacatactgttttacagttttttccacttggatgtctgtgagattttttgtataccattacatctcagtttatctttccaattttaatgcccacatatattctatagcatggattattcttttctctagtgatagaaatttgggttgttgccagcatttaatttcattgttagatgtagagctgcaatggacatccttacacatgctttttttgtgcatgtatgcaagtattttgctggaacagagatttagaagtggtattattgcatgtacttactttcaaaattttggtagatggtagactaattcttctccagactaccccacccttggtagtgtgtacttggttttctgtatcctcactatacttgatactattggtcatttcagtaattacaaagtagaaaaaagtttcaacagtggtcagacattttaaagaactagatcagcaatataaactgaccacttactagtagtatgtccacaggcatacctgtaatttttaaaacattttttttttatttagtgccagtttgggtttttttgttttgttttgttttgagatggagtctcactctgttgcccaggctggagtgcagtggctcaatcttggctcactgcaacctccacttcccaggttcaagcaattcccctgcctcagcctcccgggtagctgggactgctcaccacacacggctcaatttttttttggtattttagtaaagatgaggtttaaccatgttgaccgggatggtctcgatctctcgacatcgtgatccacctgtctccacctcccaaagtgctgggattataggcacgagccaccacacccggcctgccagtttttttaaatagggaggtttcacacagaatgtgctctttgaaaaactgaaagagctggcagtgctcagcccacaattccatatgttttcactgcactgaattcaattcacagctgtgtcctttatctgggaataaatatgctcttcccagttggtaccagcaagcctgttgcactccttactctcctggctttgtaagcatttgaatttgttaaccccttagcctaaatgaaagaaacatttagcggacagaatttctccttaaactgaatttgttgtatgctatcattaatggagagaaggaaggaaaagaaacatattgttagaccaagacaggaagtaacataaccagataatatcatcgttgatatttgttgaggttctgcttgtctaaatattggcttgttagaaactatgggctacttatttattctaagccctgttagctgtaaattctagtgacttggattatttcaagattagctttttttgtgaatatattagctctcatttgatgtgttacgtttaaactttttcaaagaaatgataatttagaacttttcagtcataagataatttacctaaatccctgttcatactagctcaccatgccttctcctatgcctgagtacctgaatgtgcactacattggggagtctgcctccagactgctgttcttatcaatgcactgggcactttcgattccttctttccaggctctagggtgagtgttttgaaatcttgaatataaatgtgattttgtagtgcaaatgtacattaaacaaaactttttattttgggaagatttgcattaaaggaaaaaacagtataacattatagctttaagttgtgtcattcaaatgacaaatcatggcagctaactagtattttctctgtatttatgtggaagagtatccatattttgtagtttgactaagttaagaatttggatggaatatgatcagtagaattgataagactatggctagcatttgtaacaggcctcatctttcattggctcaaagatagagagactgtaagactgccctaggttcttgtttctctctcatcactactgtttcagtgttcatcccaggcatgttactaaagagctgaattttgcctacagtggttatgttaaaagtagagataattgttttccaatcatgtggttcaaaaaaaaaaaaagaaaatgtaaaacctcatagtaccactacaatgacttagagggttagtcttaccactcaagagtacatctgaggttgggcatggtaactaacgcctgtaatcccagcattttgggaggtcagggcaggaggatggcttgaggccaggagtttaagaccagcctgggcaacagagtgaaaccctgtctctacaaaaagaaaaaaaatgttttaattagctgggcatggtgatgcacactagtagttccagctactctagaggctaaggggggccaatcactttagcccagaagttcgaggctgaaataagccatgatcacattgcttactgcactccggcctgggacggagctagaccctgtctcttaaaaaagagtatatctacattctgttctgaagaaatcagatgagatagaaaatggcctactataagaaactcaagctttacctaaagtttgccaaatgtatttaaattgttttaaaataactggtgtgtctaaaggcaaagcaatggaaaaagttaagcccatagttagaaagtttttattcaaagttagaaagtttttattcaactcctaggaccctattcaccagtatgattttgtaaacaattcagtttcacatcctgtatacctgttcttccatttgccaaatgggaataataattgcccacctgttatcctcaaagactattttgaatataacaaagaaatatgtgaacatgattgtaaaaggcatacagagaattgaataaaggcatatttaacattataatttggtttattaatcagcattatactatgcattaaatcatgtgctcagatattatagttacatagactaaaagcctgatttaggatggttaacctttaaaatgattgttagtccttttttaacattcaattttcagcatttctctagttttctggggttttttttgtttaagagatgagttcttcctctgtcattgagactgatctggaactcctgggctcaagcaatcctcctatatggatgcctcccatacaggcatgcaccacctcgcccaacgtccagtgtgtgtgtttgtagaaaaaaataaaatgtaaatttgcatattggcaattgatttttttttagttagttgggttagagtcttttttctactttgtaattactgaaatgatcaatagtatcaaatatagtgaggatacagaaaaccaagtacacactactgaggggtggggtaatctggagaacaattagtctattatcgaccaaaatttttaaaataagtacttatactggattgcagtagcgtgatctcggctcactgcaatctccacctctcagtttcaagcaattcttatgcctcagcctcctgagtagctgggactacaggtgtgcaccaccaagcccagctaatttttgtatttttagtagagatgggatttcgccatgttggccaggcagttctcaaactgctggcctcaagtgatctgctcacttcagcctcccaaagtgctggtgttataggcgtgagcctctgtgcctagccagcaattgactaattttaaaatattaagtgtagttcactcatcttgtaactcacattcacatgtctaaaaagtaacgtggtgatatttttcatgataggctatcagttattataataaaacaacaaaagggaggaattttggggagtggtttgaactccttgaattatttacaccaccattgatcttaagtacttctattaaattgagtataattatcctatggaaataacgcagatgttgagaaaccaaaaataaggcctcaggaggtttctgtttataaaataagtcatttttatagtggtagccacattttcctgtgatctgtattgagaatcagtttcaatgtaacaaccacaagattctttgtaattagaataacttgatctagcagtcaaggccattatgtaaactcttattttttatccctatctagatgattcatagatcttatttatgtgtttacttaatcatacggataaggacaaagtgctcatgatggaaaaattctattatatggaaataaaagctattctaaaagtagaaactggcattaggttcctttttttttttttttttttttgagatggaggctcgctctgtcgcccagactggagtgcagtggcacgatctccgctcagtgcaagctccgcctcccgggttcaggccattctcctgcctcagcctcccaagtagctgggactacaggcacctgcaaccacacccggctaattttttgtatttttagtagagacagggtttcatcgtgttagccaggccgatctcgatctcctcacctcgtgatccgcctgcctgggcctcccaaagtgctgggattacaggcgtgagccaccgtgcccggccaagattgcatttttatctaaaaatataaaagttggtgacaaagtcctaattttacagagagaaacagataagcaacattaatcattttctgaaatcaagattgttttgatcactttaattgaagggaacagtaacttaaataattttactaaacagtgcatggttagtacctttgtattttacaaggcttctatattttacaaaggtgttgattgtcagtatacagttaatactactaatattttacaaggcttctgtattttacaaaggtattgattttctgttttaagatttatagtttcagtacttagagtaattcagttgttggttttaagttctccctgcaaaatttaggttaagtgactatatgaatagtggtagattccattgcggggtagtggagaatacttgtcatgatttgcctggagtaagtatggcagcagtcatctctacctagattcttaaaatataaccaaaagctccaagccaccaccgtttaccacaggagactttatttattgaataatgtaatcaatagccttccattaaatgccaagccagacagctgaatcttttaaattaccactgaagcataatgtaatgtttcctgtaactttgtagttttgaaacctgtaactttttaggttcattttgactatcactgatacttttccctgaggactggtgccttcagtattaccagatatgaggggctcaaaagttatattcctttatgaaaataaatagtataaacaattatataacctctaattgtgagtcctataatgaatgttaacaatataggccaggcctggtggctcatgcctgtaatctcagcactttgggaggccaaagcaggcggatcacttgaggccaggagttcaagaccagcctgggcaacatggcaaaaccctgtctctactaaaaattcaaaagttagccaggcatggtggcagctgcctgtaatcccagctacgcaggaggctgaggcaggagaatcacttgaatccaggagacggaggttgtagtgagctgagatcatgccactgtactccagcctgggtgacagagtgagactctccttcaaaaaaaaaaaaaaaagtaaacccacaatatagtgtagtagttagagaaaaatacctgtacctatttgtaaaagaaattaacatatttactaattttacaagttaatgcttttttaaaaactagagatggaggtctcactgttgtccaggctgatcttgaactccttgcctcaagcaattctcccagccgagcctcccaaagtactgggattacaggcatgagccatcatatccggcctttttttttttttttttttaatctcaacattcgtgttgctttttagatgccttagtgataaccttaactacagtctctactcagctctttttgcttcttaaagatgttttgaacataaactacaatagtcatttattttcctaacaggaaaaactggtagcaaacatgcccttaccatcccaaaatattaaccttaaatggaggagtctctactgagaaatttactgactttagcatttcacttgctaaattgtgtaatgaggtttaaaggagcataaaggttcaaattctgtttttatacatctgctggcttttgtgtctttggaccacgtaacttaaatgaggcccagtgtctgtaaattgggagcagaaacacttcattatgaactacatcacataggtgagataatgaatgtaaatgcatctaagccattgcctgctgcaaagtagataataaaaggtcattcttcgtcattctcttaaagaccatctttttagagtagccttgctgtttttctttcctaacataattgaacttttaaaaacatagctagctataccatcagggtttttggtttggggtttagataaatgtaaatagatacctttctgtagttggtttctacagtccttttcccttttcttttggaaacacaataatctggtaggttatttctcatctgccacttgtgtcttttttccttagtaataattttggtattcttatcctttgcacttatactcctttttttctgagcttctccagcaatgccaaggtactttcttactacaagatgcatagcacaagccagctctgatttttttccatttatttttcctttcctgtgtttactagcaaactactttggttagctgtttcctccttaaaacttcagaatcagaggttaaaagtgaaactgagtttactctaacttccttcatgttagcttttaattttttttaatgtttaaagtaatattgaagtataggattataaagtaaaacctcactcaccagaggtaactaaccccactgttaacagtttggtgtcctactagaatgtttctgtgagatacttattagacaattaaatacatacacatatttacacatcctattctttgccttgctttttacactcatagacttcttcctatgttagtacatgtaaatttaccccatttgtcctcatggcttctattatagtattccattttatgcacttattcattccttattagtagacatttgggttgttgccagttttctttgttattatatccagtgctacaatgtgcattttgtggcattgtgtatgtattttcgcccactttttttagtatggtcatgttagtataggcatgtgttgcccatttaatgatggctatgtaatctgagaaatgcatcattaggcagttttgtcattgtgaacatcatagagtgtacttacacaaacctactacacatcaaggctatatgctacagcctagtgctcctaggctacaaacctaggacaaacctgtatagcatgttactgtactgaataccataggcagttgtaacacaatagtaaatgtttgtgtatctaaacatagagaagtgtccataaaaatatggtattacaatcttaagggaccaccattgtatatgtggtacattgttgactaaaacattgtgctatgcatgactgtacttctataacatagtttcttagaggtgaaattgctgggtctaagaaagtgcacatttcaactttcgatgggtactaccaaactgttctctgaaaagatgttgatccagtttatgttcacgtcagcagtgtatgagaatgaatacttatttcctcacctcttcctcaattctggattttatccatctttaatgaaaatagtatcctttatttttatctcctttgattttgtttaagattgatatttttaagcattttctataggaatattataaaataccggttttctttgcatttaaactttactttcaaatgacaggcagtttcttgtggccagtgatccttcttggatactgaatggaaaagagatcagcctgaagttaaaatttcacattaataattctcagaaaaaaaaacttgctgtgactgagttgacagtattagcatttgttgcaagtatgttcgattatttaataaaatgtaatgtcataaggctgtgattcttaacgaatgatttctgttaaacatactgattatcctaattttaaagctttattaagaagaaaaatatataagtaccattcattaagttggacatatttcctatcaggacgttcttaccaacttatatctctccagagatttaaggaaagaaatcttatagtttcatcatcttatttataataaagtctgtaggtttggtttaaagattaattgtaaaagggcccacagctcttttcatcaaagttctcacatctgcctgttctgtactcgctaagatcagaaatcatttgcagaattctttctgtgtaccatgtactgcattggtctctgagatacagaaatgcgcaagggagtctctgccttcagtgaggatacgtgtgtgcgtgacactgaagggggaatgaatatgttgagagaggaataatgttccttctagaaagtgaactctgagctatattttaagggatcagtaggtattagccaggaaaacaaggctacgaaaggaccttccaagacaataggatagcatttagtaattcacttaacaatttttattgaatatctattgttttattgaatatgcttgttctcaccttagcacatttgcccttgttctccctgggatactattcccctagatctgatttttggtttttgtgtttgtttgttttaattctctgccatctttctccagtcaaatgtcaccacctcagaaatgccttctctaaccaccttatctgaaccttcccattttctaatatacatcctttatactaatgtagaatttttattacctaaaattatgtataatcatatatgtatatttatataaaatacttgaaattatatatttgttatttcccctttttttcatgaaggcaaacttaatctcttaattgctatttctccagtacctggcatatactttctcaattttttttttttttttgagacagggtcttcctgtgccaggttagaggctggagtgcagtgtctcttcacagatgcaatcatggtgtgctaccccttcaaactcctggcctcaagcagtcctcccacctcaaccctcctgagtagctgggactataggcatgtgccacagcacccagttaattctctctcttttttttgagacagggtctcactctgtcacccaagctggagtgcagtggtgtgatcacagctcaccgaagcctcaacttccccaggcttaggtgatcctcccacctcagcctgcgagtagctgagactataggtgtgcacctccacacccagctaatttttgtattttttgtagagatagggtttcgccatgttgcccaggctggtttgcaactcctgggctcaagtgatgcgtctgcctcagcctcccgaagtgctgggattacagacgtgagctactgcacccagccccagctaattcttacctttcacctcttaataactctgagcaagatataggacgtatagtgtctctgcattttgtatcattagacaacctgagacctgggaagtttgcctaatttcaaatggataaataggtttaagtagctgggacggcaggcacatgccactatgctcggctaatgttttcattttttgtagagatgggggtctttttttttttcctttttttttttgagacggagtctcgctgtgtcacccaggctggagtgcagtggtgcgacctctgctcactgcaagctctgcctcccaggttcacaccattctcctgcctcagcctccttgtgctgctgagatcagttacttagaaattcaggagagaacttttgacctttctaatctcttgttattcatagtaaaatcctgggtatcttatttatagggatactaatatctcctctgaaacatacaatgaaccatttttctcctaaaattggttgcttgcctactataaaataattctagaggctgggagcagtggctcacgcctgtaatcccaacactttgggaggccaaggcaggcggatcagctgaggtcaggagttcaagaccagcctggtcaagacggcaaaaccttgtctctactaaaaatacaaaaattagccacatgtggtggtgcatgcctgtaatcccagctactgaggaggctgaggcaggagaatagctttaacccaggaggtggaggttgcagtgagcagagatcacgccattgcactccagcctgggcaacagagcaagactctgtctcaaaacaataaaataatttgaattgctctttcttttaaaaggtatttacctatattcaaagcaaaagtttttttttaatatatgcttttgcttttaagaacaatctttattccatttctatgaaatgtgaagttaaagccccaacttttttagtttgaatattacttgcaattgttcttataaactggctgattgatgagctagctactatttaaatgcctaagcattcctcatttctcattttgttatcagctatacaaaacacagacttgctcaaatctttctagaataattttagtttagtaatatgctgtttttaagtatttggactagctgtaaggtttataaaacttattttaataatatctgatttgtgcttttattactgtttttaataggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaaggtaaaaagcaccttccttaccttttccaggttgtaggaggaggcatgagtttcattaaatgttatgactaaagttagatatctaataattattatattagtgttttaggtaccaatgctcttcttactttagataatttttacaattttataaatttactaatcctctaaaaatattttttaaatagagtgcaacaaaattgaaaacagtatacttaagtctggcaggctatttctgaccaggccttgtgaatttttgtgcaactatcaaagaatccagggtgagcttatgtagaggtggtcaaatattttaaaacatatactactcagcaatttttaaatgacctttctttattatagccctttgaatcctaagataggttgattttgtatcaattcatcagagtgtattctctcacctaaatagttctgaagagtcaggaacaatcctttttattctgtttttcctttcctagatgccaaggtaattgcagccctcattcatttcacaagacgagcaatcactgatttataaatgcttaactatagaatggcttatgactacccaaaacagtgccccatcaacaaatggggaaaattgccttttgagctcaggaataatttataaattggggactaccttttagttctttagcatattctatttcttattgttttatataatttttaaatcatttgcttcctccttatgtttaacagcagaggggtaatcaccttaaaatgtcatcaaaaatagatctactagaaggcagcatcacattcccatcttacttatggactcctacccctggttcatgtcttatatgcctgtaatggttataaagcctaccttcaggaaagctatggttgactaattactaatggatgggttttaaacatgtccctctacaataaattaaaatctttattgtaaaactttattctgcttcagtttttttcttcttaacagtgtttttactaaatatctgtttttattatagtagtcttggtagtgaaacatgtagatggttttgctcattttttcccaaccaatataagcttaaataaaatcctattaccaaaatttgagtcttatgtacttttagttgtctagtgtttcagatggttatctttacatcctatcttctcaaaggtatatcttgaaagcaaacatttcagccaggtggggtggttcacacctgtaattccagccctttgggaggctgaggtgagactgcttgagcctaggagttcgagactagcctggacaacattgtggtaccccacctctacagaaattttttaaaaattagctggccatggtagcgcatgcctatagtcatagtcccagctacttaggaatctgaggcagaggattacttgagcccaggaatttgaggttgcagtgagctatgatggcaccactacaccctagcttggacaacagagtgagaaccatttctttaaaaaaataaaaagggtggggaggggggtgttgggcgcggtagctcacgcctgtaatcccagcactttgagatgcctaggcgggtggatcatgaggtcaggagttcaagaccagcccggcaaacatggtgaaactccgtctctactaaaaatacaaaaaaattagccaggcgtggtggcaagcgcctgtaatcccagctactcaggaggctgaggcagagaattgcttgaacccaggaagcagaggttgcagtgagccgagatcgtgccactgcactccagcctgggcgacagagcgagactccatctcaaaaaaaaaaaaaaaaggaaccattacatttagagttttctttttttgtttgtttggtttgttgttttttttaacaagccaagtgccataaacatccaaatccattttttatatatagttttttccccaaaagcaattaccatgagaaaataattcattttttaaaagtacttttacaacatcaaaagaattaagatgaaatataaacctggctgggcacagtggctcacactttgggaggctgaggcaggcagatcacttgaggtcaggggttcaagaccagcctggccaacatggtgaaaccccatctctactaaaatacaaaatttagccattcatggtggcgcttacctgtagtcccaactactcaggaggctgaggtgggaggattgcttgaacccaggaggcagagttgcagtgagttgagatcgcaccactgcactccagccttgggcaacagagcgagaccctgtctcaagaaaaataaatataaacctttctacttacgatttttatacagattatactaacagcttgttcttgaatgaataatatcttaagattagttttagctataattgcagaaatacttaattttaaacatttctagattggttatactcaaagcttgaaattcatgagaggaaggccaggcacagtggctcacacctgtaatcccaagactttgggaggcacaggtgggctaatcacttgagcccaggagttcaagaacagcctgggcaacatagtgaaaccccatcctacaaaaaatacaaaaattagctgggcgcggtggcatgcgcctctagtcccagctacttgggaggctgaggcaggagaactgcttgagtccaggaggcagaggttgcagtgagccaagatcaccgcactgcactgcactgccacctgggcgacaggagtaaaaccctgtctcaaaaaaaatttaagaattaaaaaatttttcaaaattcctgagagggaaatatattggatgaaagtagttgttcattttagacaaacactagaagcatttgtttatttttaattaaagataaaatgtcaacagaaagaagaaaattattgatggagcacatcttcaaactacaggagttttgtaacagcatggttaaactctgcattgatggatacgaatatgccta

SEQ ID NO: 14131 - DNA, 29037 bp, Human
gaccctgtctctaaaaaaaaaaaaaaaaaaaaaaattagctgggcatggtgacgtgcacctgtactcccagctgctactcgggaggctaaggtgggaggatcatttgaggctgggaggttgaggctgcagtgaaccatgatcatgtcactgccttccagcctgggtaagagagcaagaccctgtctcaaagaaaaaaagaaaaaaaaaatcaccctggacaagtggattggaggaacagagccactatcaactcttccttagtctactacattaacttcctggtctcctgggttccaatcaacccatcctgggcctagtgtcagagcactgtctaaaatgatgtgagcatgtaactctcctgttgtaacttcagcagcttctcaaagctcccaaatcttccagaaggcttacagcaccctcatgatgtggccctctgcctacctttcccacctgatatgccctccaccccaccatcccaggctctggtcttttagttccttgagtgtgcggaagctgcctcctcctctctctggctccttttccttcagaattcagcttaaatgtcacctcaggaaggtcttaaccccctgctccatataaaatagatggtcccattatttcctaccactatgtcaacctgtaatttatatattagtgggtttagtccaagatgttactctaaactgcaccattttgtaagctccctgctattctgcagaccttggtcaaagtgaaacatttcacaggggtttgggctgtgagaaacatcctgcctaaccacccgaccacaaggcagacaaaggcccaactaaagaaacatccctctcatatcttcctgggcaaaggtccaagggacaccatgatgacatcccactggaacaagggccaaaccgcctcatcatgagaacatctttatatcaatatcctgctaggcagcaacccatactgcccagacccctaccgcccatacctataaattgcccagtctgtaagcagtggtgggcactggcattaggctggttccccacttctgtaggttattatgctggacataaagcctgcgtttgctgtcgagccgccctctttctgtgtgtgtgtgtgtgtgtgtgtgtgtctttctttaacccttgccttcttttcaaaacctaacacgagtagacaaacgttctttctgaagagccagattgtaaatattattgtaggctttgcaggctatagctcttctgcccttgtagtaggaaagcagccacagtcatacttaaaggaatgagcgtggctgtgtccccataaagctttctttacggacactgaaattttaatttcacataattttcatgtgctaagaaaatatacatatatattttgtgagatggtgtttcgctctcgtcaccctggctggagtgcaacggcgcgatctctgctcactgcaacctccgctacctgggttcaagcgattctccagcctcagcctcctgagtagctgcgattacaggcgcccgctaccacgcctggctaatttttgcatttttagtagagacggggtttcaccatgttggccaggctgctctcgaactcctgacctcaggtgatccgcccgcctcagcctcccaaagtgctggggctacaggcatgagccaccacgcccggccaagaaaatatagtttttttattttttccaactatttcaaaaggtaaaattcattcttagctcccaggttgtccaaaaacagacgcgcaggatggccaagcaccagagtttatcgtttgcccataataatcgggttgattcggccaaggtttccctcccccaacacggtgcgcactgggaagcgcgaggaccacgtcccttggtttaccactgcgcacctcacaaggcgcccagtgcatccgggtagcgggatgccggttggaccaacgcgagggtgggcggggtctaagagctaagcgttgggggcggggcgggacagtggggaagaggacgggtcgagtgctggcttccggcggaaaagcgcgcgagcaagatggccaccaccaagcgcgtcttgtacgtgggtgagcaggaggggttgctaggcggagtctgagtgaacgcgacccccaagggtcggggcgtggggtgggacgcatctctgaaccaggaggacggcgagctgctgtcaaggccgggtctctggcggtagtgctggcgatagctctggctgtgcttaaactccttccaaggtttcccactgtcctcaggaaaaagtgcagacttcttagcagtacgcacttctccagcttctttgctttgcttcccgattcgctgggtctcccgaaaaatgacccacttgcccccaaggttcaggttatttcacacctttgggcctctgcttttgcgactcccttgcagtgaacagccttgccacacacctcaggtgcgtgaacccgagacggaatgattattctgacttcctagcccgctgagctccagcgggccccgaggagcggtaaaggagtattatggcccttcggatcctctcgttcatttgttttacaaacattcagtgcagcgacggctcagccccagcccctgccataaaggaaggagttcccagactagccagaaaaaaagtggaattacctcagtagcacacttttgataagcgctgtagtgaggatggatcatgataatatgggcctggctgcgggacaaatgacccatccatctggagaagcgagggcaaattctggatgcggcgatgccagagctgatgagcaggagttagctacgtaaccgaagcagaggcaaggccgttcactgcaagggagtcgcaaaggtgtgaaatagcctgacacttgggggcaagtgggtcattattcgggagacccaggaaattaggaagcaaagcaaaaaagctggagaggtgggtactgctaaggagtttgcactttatcctgaggacagtgggaagcctttgaaggagtgtaagcgaaaagttacgggttcaaatttgcattttcctaagatcattctagttggctttgtggagttgatggaatggaggcagggaggtcagttgtgaagctattgcagtaatcccaggactagatgagagtctgaaagaagggcgaagagaggaatatttttcataagtatgggtgggcagagatgagagggggatgtttgtttacccaaagaactgaatggaagggtcctgtcccctggctagcatgctaactgggctgcaaggacttctgcaagagtatggagatcagtggctcagaaggcccttggcttatttgcaggtggactggcagaggaagtggacgacaaagttcttcatgctgcgttcattccttttggagacatcacagatattcagattcctctggattatgaaacaggtgagttagtgtctctcacgttcagaatcctcttactaggaaaataccttaaaaaattaaagtcacatcacaattctaaatatgcattctaaatatggttagtatacactacaggtaagttcaggaaggtgtctggtgacagtgatctcgatggagaaggaatgttctgaggccatgtggttgtgaactctgaatactttccagagtcttcagctgttgggttgagataagacagatttttcaatagaccagtagggagataggtttgaactacattgagatttgaatgttgttttaatctacctgatgggtaccccatcccacctgcaccttcttgcagctgtgctattaaatgaggcagcgggaaagcctagccccataatgggggtgggtgagggcgggggttcttggcctctgcacccctgggtgggtttcccatcgattggtatcacaaccacagttcagttttctgtttacctttgttgtcatttttaagattatagttttaggcctagttttatcatcaaccttgcatatgattgttagcaaagtctttaaactctctgggcctggggaatctttatttgcaaaatgataaggttatgttggctttctaagggccttctagtctctgagttctatgataaacattattgtgcttggtctttctagttagttcagcattttcctgaagataaagactgagcatctttatcaggttttaggattcatgctttatgcacagttgatgcgcaaaatatatatttagatagataattgataggtcaaatgactttatttttctaattgctttgcatgcaatggttaaggttttaagtttggctttcgtagaataattgaatacttatcaattaaaaatacagtttactattcagctatgtccattaaaaaaacaaagtttattattgcttaaaatattgtataagaagaatcaagaatgagattccttcttcctaaatagtgattggatagaacttctggtgtttggatacgacatgtaactgacttcactttgtgaccatcctgtttcttcccactaccccacatagtaattacttgtttttgtttttccattttgtagaaaagcaccgaggatttgcttttgttgaatttgagttggcagaggtgagagtctgtgttactagtgtctagtccttggtttgtgatgttgttactgattacaaaggaagcttttcaccatttggttaggtttttgggccttaggctgatgcttccagagagatcagaagtaagtgctgttctaaggaaagcgtctctcacataatcagactggactgtgaataacatgtcagacctgccaggccctcccattcttgccctgcagaggagctagctcatgcacccctgttcattgagcattcttgcctggaagtagtgattatttcttgtgccttcaactagatggcaaattgttgcaccaccagctctaaaatcagccaggaagtgctctttgttagaaacacacaaaacctaggcaagaaatacagaggtggcatttttctggatttttgctactgagcatgtgtttagacaccataagaagcatttggctgcaagcctaaacttgtacctttgtctttccttggcaggatgctgcagcagctatcgacaacatggtatggctgggaatcttaattctaactaaagttgctttttggtggtacagaggctccttattcatatatcagtgttctggacttccaaagttacaaggttgcatggggaggtaaaaattctcacatgaaaatattcactgtgaattgatcacttataaaattagttcttactcagactccttcgccatttcagaataatgtaagtcctcatcatccttgttgaccagtctctcactggctctcccatgtttaggataatttgcagacacagtgcaaattgattgcacggtgtaactgcatattttgcaaaatagcaggatttcatgaagtgttagaccaatttacaattgagaagagaaatttaattatggcaggtgcaaatcactgatacaaatgatttggatattctggaaaggtccttgggaaaaatgatgatgctctttagtatttgtgccttccttgagatccttttagttttcatgtctgataagaagtgcaaagataccatactgttgatagaattttgttggaaaaataatacttcagtgcctgttacttttctttctttcttttttttttttttttttttttttaacaatcttgaactcatgagttcaagacttctcagcttctcaagtagctggaattacaggctcaagccaacagggctacctgggctacctgttacatttctttctaccaagttacatttctttctaccgattagtgcatagttagtcctgaatattaatggtaagaaacttgtttttattatttttagtttcatcacagtaatttcccagtcagccttttaaaatttttcaattttaccacgaaatcttcatcaccacttcaagtggagtcaccttaaatgacctttcctggtaccgattatctttggataatgagatgttgttttatttgttgttctgttatccattcaccaaacatattcatcagctgtcagagatcatttttctttcatttcaaagcttatcttgacttttgaaggtgaactcaaatactgggaaactgcatttatttttgtaattttggagtgttctgaacccagagttacttttggtaatacaggtctttgtgtgctgctatgaaagaaaggggtgtgagttccctgaaacccacaggtggctttggggtggctgcatagcttactggtagaggcccagggattaagggaggacaaatcatgagtgtgtctcagaagtatatggaaagctggctggccctcttttaacctaagagagtttaagcagctggattttcaatcttttcagaatgaatctgagctttttggacgtacaattcgtgtcaatttggccaaaccaatgagaattaaggaaggctcttccaggccaggtgagtaggagcaacttccagattccctgtgatgttctgcagtttggccttagttgcattttttgtctctatttacttggaagtagatgctaaatgctgcttcctggtagataggagtagatgatggttcacattgggaagggcatgcaccacctttttagagaaacaagtgagtttgagcttctcagcaaagccaaagtgattgtttctgttatgagagaaattcctgcctgagctcatctttcccagttttcttgatattccattcctggggtctccatcaagggctgaaatcagcaaaggctacacctttgctttcggcatagctattttccttagccctactgagagctggacttcagggcctacattctggatgggaactttccttacccctgggagttctcagtggggaattgtctggcatacaggccacatagcatcttccactttgctgaccaaagcagctacttttcagttcaagctgacagcttgaatgaacatttgtttgattctttcctttcagtttggtcagatgatgactggttgaagaagttttctgggaagacgcttgaagagaataaagaggaagaagggtcagagcctcccaaagcagagacccaggaggtgagaatgaagctcctgcttccagagcacaggccggcgctgtccacaggagacttttttttttaagttttaatggaaatttgccaatatgtatatcaaagtggagggaatgaataatgaattcttagtactttggtaaagtcaatattgagttcttagtactttggtaaagtcaatatcgagtgaattcaagggcgaaactttgggtctcttgtccatgttgtgttctatgtgatgagtgtctcagctctgctcaggtatggatttgtgattatcaactgacagggaggaagctgaggtgcccctcttcacccctcctgatcagtccccctccttcactgaagagtttgccacaagggtcgtggtcttcctattcctgtgctaatggaggggagacagaatagggtagtgtcccttccttcaacctgtacatgggttcagggttctccagtcctacgagaacctgctggggcacttccccctgattctcagcatagtctctgacagttgcttcctgggcgtcccctcctctgagtactttgtgaatgttgtcattcttctgtatttctttcttggctcatggtttctctctcttctctcagctgaaacagtagcagtctatctctagttttatgcagcctctgttatgctgttgatcttcatggtctctttctagtcctgagcttcagatatttctgcctgcaagtctcatgggcagcttaagtttgcctaaaatggattctcccgcttctctaatcctgtcttcctgtgttctcaatcttggctaatttgccaccattcatccacacattgacccacgccagaaatttgaatgcaaatcagaactcataaagtggccatcacagtcagtggagtccccctggatcatcctgtatcctctgcttagtcttacctacttggagcacaatgcaaggcccaacatcttccactgtcttctgagcacttaggcctgagcaagagggctgcccccttgcttccatgtagttagccagtgtatatgcagggccaggcacagagggacgaggtggtacatggatgggtctgcctaactagaggacagtgggtgggctggaactggcatttgaagatactgagagttgtggatcatggaccagaaaagtgctgttctgtgactgtgaagcaagaggaggaagcagatgcatctgagggcaagcatgatgagataacacccccgtgtgtgaggctcaggttagccagtgctgagacctcctgtcgctgggcatccagctgggtgctacggccatggctcctgcctcctgcagccctatcagggcccaaggccttccccgtcagcacttgctccagcctacgcactggagttgtgttctgggtgggtgtgtagaatactcgcactcctacttagggcgtcagggagctctctctaactagcaatttcttctgcacctagggagagcccattgctaaaaaggcccgctcaaatcctcaggtgtacatggacatcaagattgggaacaagccggctggccgcatccagatgctcctgcgttctgatgtcgtgcccatgacagcaggtgagcaggacgctgtggtcagaacggcgggacgctggtggctgagcagtgagcctttcccaggttcttactgcttcacttcttgtgtccttgatattgcttctgacctaagttgatttgaggcatctcagatcctgggatctagtaacagataagtcagagcaggtgtttttgaagctttataagtgctggcttactgttttttaatcgttttttaaaaatacaagtaaataatgtattcttttttttaaagaatagcatatacatatattccaataatatttaagacaataaattgaaaattcattttcccctctctacatccagtcctcaattctagaagtaactagtgcttttattgagtattctttgtaatttattaaatattgacttctattctctttttaatctaaattttattatctagacatataaagagtcaattcagtttcacaaagcttgttttgaaaaaacagtcgtcccctggtgctgtccctgtgccctgctgccaacaccatttgctgctcctcagaggagcggatttcaactcttaggtgttttggtttttatttccatgttgataacagttttatatttctacttcctgttttccattttaaacattatcttctgattttctacttcagagaacaaagaattagttttttaaaatccccttccctgccccctcatcttccctgtataggtaccataattttggttaggtcctaagttattttaacaatgtaagcatcatgtgataacctcctttcatgcacagcattttgttttgcctggaattgataattgccttgtttttgcatagttttctgtgtaatcattcctgattttctcccagaccatcctgctgggggttttgcatccaggtgtctgcatcttgttaaggggagatgagggcaaggctgaattcctcaacattcagtatataaactttcacataatctccatttgtcattatggtacctcagccctcactatgcgtaggatgtcctagtccagagaccctctgctttaacctaccaaagactagacccccagctggctaccaggttggggaggggtggcccccagctgcagagtcagggaaaggatcccaaagattaaccactttcttaaatgggctttcagccaaacttactgtctccaggattacctgcaccctttcctctgagcttttggagtgcaaattgagttgcttcttggcttttaccagcttaagattcagctttctcgggtctgctatatcatttaggactcatctattttgttttctaacttcagaaattttgttgctgttgtctcttcctccctgctttttaagtttattttttggctattttagccactttaaagtgtttgttagcagtaattactctgttcgaaatttttgaatcatcctaaacaaaaccacttattaaaggtacctattaaataataactccccattttctcctccccttagcttctgataacctctaatctttgtgtctatgaattggcctatcctagatttttcatgtaagtggaatcatacaatagctgtccttttccacgccttgttgattttgcatagcataatgctttcaaggttcatccttgtaccatgtatcagtgcctcattcctttttgtggctgaataatattccgttgtatttggataaatatcttgttcattcatttgttgatgggcacttgcacattgttttcaccttttgactattgtaaatgcctgtgtgaatatccacatgtaagtatatgtttaaattcctgttttcaattcttttggatatatatgcctaggaatggaaatgcttagtcatatggtaactctgtatttaactttttgaggaaatgccaaactattttccacagtggctggaccattttacatttctaccagcaatgtatgagtgtttcagtttttccacatcttctctttttttttttttttttttttttttgagacagagtctcgcactgttgcccgggctggagtacagtggcgtgatattggctcactgcaacctccgcctcccaggttcaagtgattcttgtgcctcagcctcccgagtagctgggattacaggcgtctgccaccatgcccagccaattttttgtatttttagtagagacgaggtttcaccatgttggttggccaggctggtctcaaactcctgacctcatgattcgcctgcctcggcctcccatagtgctgggattacaggcgtgagccaccatgcctggcccacatcttctcttaacaggtgtgacatggcatctcattgtggtttttatttttattccctactgactaatgatgttgaacatcttttcatgtgcttgttgaccatttgtatatcttctttggagaaacatcttttcaaatctttggcttatttattaactggattgtttgttttgttttttttaagagacagggtcttgctctgactcccaggctggagtgcagtggtgagaacatggcttactgtagctttgaacccttgacctccagtgatcctcctgccttgacctcccaaagcactgggattacaccgtgcctggccattttgttgttgaattataggagttcattatatattctggatattaaacccatgttaaatatgatttgcaaataagcattctcctgttctgtgggttgctttgccctctattggtacggttctttgatgcacgtcttaaattttgataaaatctaattatttttttctttcacctctgcttttggtgtgacatttaagaaaccatcaccaaatccagagtcatgaagatttgcccctatgttttcttctaagatcctttggtttttcttttaaaaaatcagtttcctaccaatttagtgtggttttaaaagggaacagagctcgaacatgtatattcaatcccccttcaacagaatctcctatagtcctggccaggtgtggtggtttacacctgtaatcccagcactttgggaggccaaggtgggcggatcatctgaggtaggagttctagaccagcttggccaacatagtgaaaccccatctctactaaaaatacaaaattagccaggtgtatggtacatgcctgtagtcccagctactcaagaggctgaggcaggggaatgacttgaacccaagaggtggaagttgcagtgaactgagattgtgccattgcactgcagcatgggcaacaagagtgaaactccgtctcaaggaaaaagaatcccttatagtccttacaaggttagtatcacaaaggtttataatgagtatctcttattttaaaacaaaaatatgaacactaaaccaaagttttttcgaggttttttattttgtcctattttttaaccccagcgctttttcctttctcaattccagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtaggagccagttggcatgtggtgacgagggaggctgggcaagggtgggatggccaggcaggatggaaggacaggttgtagttctggctggcggacactaagagtctggaggagacccagccaccagacataggagaaccatgcagccttgctagggtggagttggcttgttgacattcaggtactgttcatcccccaaccgtgtccacaattcctattagccccgcttggattctgtggtctgctgttgcaggctcttatgctctcaaccccactgctctccctgccctcaccatcagatttactcagtaaaatctcggtggttagtcccccagcaactagagaaaaaacacagaattgtactgaacaatcccacttgaaatttataactatagttcttaaggggacccttgccaacctgaccagatttccctacttgatgctcagtcccaaccggagatgatgtgtccatgcccgtcttcacttctgaagccctcatatcatcaccttcccacctcatctaatgcttcacctcctgcatctctccactcgtgcatgctctttcttccaattacaggggatgagctgtctctcctaggccagcctctccacctgtggactggatcctgtccctctcctctacttaggaacatggcttctaaagttgtccccttcttgtaatccatttcccctgctctgctagatcagtccattagcatgaaagcatgcagttatcaacctttaaaaaaaatcttcatccggttgccgggtgcagtggcttagtcctgtaatcccagcattttgggaggcagaggcaggcggatcacctgaggtcaggagttggaggccagcctaactaacatggagaaaccccatctctactaaaaatataaaattagccgggcgtggtggcgcgtgcctgtaatcctagctgctcggaaggctgaggcaggagaatcacttgaacctgggaggcggaggttgtgatgagccaagatcgcaccattgcactccagcctgggcaacaagagcgaaactccgtctcggaaaaaaaaaaacaaacttcatccttgtactcttgttccctctccagctatcacccatgcccctggtcccccatcttttttcaagaagtaaaagcataacttcttgaaaacatggtacagacttgctgccttcgcgttttctctaatcccttctaggcagacttctagtcccatctcgccattgaaaccactcttgccaaaaatacgagtagccagttcttggcgatcatcttatcccacctcccagatgttatcccacctcccaggagcatttcatactacaggttgagtgtccctttcctgaaatgcttgggaccagaagtattttgtattttggaatatttgcattatacttaccagttgagcatcccaaatctgaatatctcaaatctgaaatgctcgagtgagcagttcctttgagtatcatatcagtgctcgtgaagtttcagattttggggcattttggattttggattttcacatttgggatgctcagcctgtactaactctgttctccttgactccttcttcacttggctggcaggactcctgcctcttcttgtctccttttacctagatggctgctttttctgtctttgctgtctccttcttttcctgacccttaaacactgaagtggctcagagcccattctttggttctccagaagcctgttaccctgtgctccgtttttctaactggtggtttgtagggcccctctttactatactgaactgacatgtgtaggtgatatagcccactgacccacatcgttattttaaaaatcagtattcatctgtaactataatagggaagaacatcagaggaaataaacgaatttgtataatactcgaatatgtttccagatgtacatgcttaagcacagctgtgtcagaacacaaagtgaattattcaggcgtctgcccctgtactcaaacgcagcagttagaaatgcagacgggagtgtcaactggataccactaggagtgatgctattggtgatacggctttgtgaaatggtagataaagttgattagagtccaaagtaaagaataatctgtttatttacatagtagttacattcctagaagattccatggaaaatcaaaagcactccaaaactttgggcttatatgtataatggaattatgttttaggtgcagataactgtaaacacattttttacctataccaatatctggcaggatatttgttgttttgttgttgtttggtttttgtttttttgagacagggtctctttctgttgctcaggctggagtgcagtggtgcaagacggctcactgcagcctcaacctctccagctcaagcagtcctgcctcagcctcccaaatagctgggattataggtgcacgccatccataatgccaggctaatttttaagttttttgtagagacagggtttcattatattgctcaggctagtctggaactcttagcttcaagtgatcctcccacttcagcctcccagagtgctgggattacaagcattagccactgcgcccagcctctagcaggatgtttgtaagggccaagaggatatgagacaattcattgtgccagacattgcagaacatctagcattccaggcccccacctgctaaatgccagtagcacccccacaatatttcagacagtcaaaaacactttcaggccaggcacggcggctcatgcctgtaatcccaacactttgggagtctgaagtggcagcccaaagccagaggatcacgtgagttcaggagttcgagaccagcctgggcaacatagtgagaccctatatctactgaaaaaagaataaaaaaattatccaggtgtggtggtgcacgcctgtagtctcagccgcttgggagttgaggtgagaggattgcttgtgccccagagattgaggctacagtgagctgtgatgcactcctgtactcagcctgggtgacagagtgatccccatctcaaaaaaagtaaattcagatttccaaaggtttcctagggacaggacaccaaccccactgagaagcagtgccctaagcagtcacacccggtcccagggctttcagcggtatctctgagttaagtttgtgcagactggcatctgcatgctgatggctccctgagctccagactcctgtccaactgcctgcctgttgtcttcactggatatcccacgagcatctcacactttacatgtctaaaacagctcttggccttctcccctaaactcttcctcctcctcttccctgtttcaataaatgactccaccatccacttagccgcttgatcagaaacttaggagtcattgtggacacacacacacatacatacatgtacacatacacacacagacacacacatatacatgtacattctcttacgtgacaaatgtccatgttaccaggcctcactgtgtcatagctgtcattttgaatggctcttttccactgattgtgagctccaccagagcttggactatgttctgctcatcagtgttcccagggcttaacagggacctggttgtcaagtagacacttaattgttaaataaatgaattaatgaaagaacagaccagtataaagtgattgaaacacctcacttaccatttcactgactattaactgaatccaagataaggtggccgcatttgcatgtgatctgtgcatccccgagtctgagcctgactggctgaagggctgtcaacagcctgcacagacgtcctttaagggctggtagccagggttcggggagctgatggttgttctctccctcaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggtatgtggccaggaatgggcctcctccttacccaggccctaggagcacagccctgtgtgagggctggagagtctctgtggcctgagagagatggccaggggctgtgtccagcgggaggggctgctgctgcccaggttccggggtggaagtgggcaaatgggcaggcaggggttggtatccctaaaccactgttagtctccggccttactccctcacttctattctgccacaaaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttcttatattgctcttcctgctagttcttgggagttgtcagagattgtgtctgtggctaagctggacctctgaggcaggctggtgagtggggagagcagagcatctttttcacagctttcatttcctcccttgggccgatccccttagatgtcaggtgatgtatcttcacaccaggcatcgatgtcagggcaacggaaattaaagactggaaagctccggtcttctgctgcctctgctcctaaacccagctgccggccttacagccagcaagtgtactctcagtggttcatttgtttatttgttcactttcaccctacagattttaaaaaatgaaatttttataactcaaagtgccttctctgtgccaagtactatgcctatttgtcaggagacaggaagccaacaaactacatgtgcctaatccagcccactgcctgtttttatgaatcaggttttattggaacacagccacgtccatttatttacatattgtccatggtggtttcttactgcagtggcagaggtgcgtaaggggctatagacacaatacaggctatggtccctgtattagggttttctagagaagcagaaccaatagggtgtgtatatatgtagaaagagatttattttaaggaactggctcaagcagtggtaggagctggcaagtctgcaatctgcacaacagaccagcaggctggagactcaggaaaaaaactgatgttgcagttcagctctgaggcagtttggaagcagaattcttcctccagtgatctcagtcttttttctcttaagaatttcaactgattggatgaggcctacccacattatggagggtaatctgctttactctctactgacttaaatattaatccatctaaaaaataggccaggcatggtggctcatgcctataattccaccactattgggaggctgaggcaggaggatcacttgagcccaggagttcaagaccagcctgggcaatgtagagacccccatctctagggggagaaaaaaaagccaggtatggtagtgcacacctatagtcccagctactcagaaggctgaggtgggaggatcgcttgaacctgggaggttgaggctgcagtcagccatggtcatgccactgtactccagcctgggtgacaagagggagaccctgtcttgaaaaaaagaaaccatcatcacagcaacatctagactagtgtttgactaaaaactggataccatggcctagccaaattgacacacaaaatagaccatcacagtcccaaggcctaaaatacttactatctgagcctttacaaaacaggattgccagccactgaagagaacaaatggtcccaccccctgctgagctcacagtctggctctcctgtgtgcagccacttcttggagctggcttctctccactccccctccagatgctggtcagccaggcggttataaagaatctcatctgctgaaggcttttagcagggactgagtcctgtagctgttggacacctcctgtgggttgggtcactcagaccattcagaatccactgagctgagcttttgcatcttggattgagatctggatgagccaggaggcaggagaggctaggtggtcctcatgaccctaggatagctcttgctgagggatggtggcattctgccctacctctggctcccatgtgccgactggactttgtgagctccagctgctacagttgactgagttcaggctccatgtagctgggatatactacatggttacccctcacccctatggagcttccaaaagagaccctccctcaaagcacagccccttctctgagtgcaaataatggccatcagaggtcagtcacaggtgttaggcaggcatctatgaagctggggatgatagcactgacttcagtgcttggacgagaaccaggagagagtgtgtagaaaaagcacagccagcctcccataaaaggacagactcctgtgacaaccttgtcactctgttcctccctgatactctggggaggtggaggccagtgggcagttctgaaagctcagcaggtttggagccattgggtgtggactcctctcccagtgttcctcctgggtgtccacagatgttattgaatgcacactggaaccctgcacaggtaaactgaggctttattggcgtgactgccaaaggtcacacagggtggtttggcagagctgggattagaagcccagcctgtctctcttcagtagtaatggagtcctgggaggtttactaggctttagcctcaatctgtggcggcagggtccacagccctggggagtgacacagtcatggtccccatgattggccaggacctgtgtggagagacacaggagacaagaccctgctcttccaggccagaagggaggggagccccagagctgggcagtggcatgccccacagcctggccacctgcttcggctacgcaccatgcagcagctgcacctggctgcctcgggaaaactctgacctctctgggaagtggagccagtggctctgtgggcgtcctttcctgcagcctggagagcaaagcggctttccctgggactgtgtggctcctgtcccaactggcctccccattccacattcccattgctggaccagcaccaggactgggcacagggcttccttttgctgattcatttcccccctaactcattcagagttgagccccatctgagtccccacatgctggccctgaaacggttacaaaggctgaaaccagggatggcaggcccaggatcagtgctgtggctgttggagtgtcctctccaacagcatgacagccgcctccaggtgctcccagcatctgttgcagtcatggcagcctcacggcaacctctgaagaaggaattatagaaccaactttttattgttgaaaatggagtcttgtagagttcagtgatgggaaactaaagtagaaaaagcacatcacaaagaaacatatatagtacagtgtgatcccaattttgtaaaaatatctgtaatatgtaagcataggtatttgtatatcttaagaaaaaaagcctagaaataaagccacaaaaatattaatagtgtgtttatttgacttgtgggactgtagtgatttgaattgtattttattttttatatatcccactttcctccaaaactgcattatttttttgagaagtgaaagacatttttgaaaaagggggtcaagtgcccatccagggttcctttcaaaaagggggccaagcagttgacctggatgggcagttcccccatgcaaattgccacccaagacacctggtgggtacagacctctctcagcaggacatgggatcccattgtctgggaacacagcaaagtttcacagccgctgccacaagtgacacttgctaggcctttaaaggctataagaatacaagtcccgccctctgagggatgccatgtgtagatggtttaggaaagagcacagctctgaaataaatacatcatcacctgcagaacacattttggtttaatggacagacatagaagtggctcaaaaataagcaaattcatttgtaataataccagcaaatacctattgttaagcatttatatgtcagacatcccaaagatttgtgtacatatttagtctttataatagctttgggaggaaagaaccaatatcatactctacaaaggaagaagcagaaccaggattcaaatctatttggcaccaaaaatctgcctcttgctacactgcctctattcctgtttctttggaccttttccagaacatgttacttccctgcctcagttagaagttagtgactacgaatcccctgctgacttggcctcaaggccagtattgcaccgcaaggaccaagactgctgggcattcctcttttgcctgttgtatgcgtcctctcttcctgtcaactgtcattgatttctcattgctgtcagtagatctgaaacaaccaccaccatcatccttccaaccctcatctggtgcaacgagataaacaggccatgccctgagcaaagaaaagggaaatggtggtatctgtgctgccagcctgggccacccactgcagatgcacatgcttggctcagcaaacggataaggattaaattcatggactttgtgttcattcacaattgtttcattgctcaagggatttttctattttatttcatttggtgactatctggatgataaaagttgctgaaagtctgatggccaactaggtagacaaagccttatgtttttccattgttctgtatgaaccaggaggatcacggctcgtattggttcctgctatgcacagcttgattaatgggtaaggtgtactccatatctacaaaccttcaggtagtttacagacattcttggtgcacccctaactatgccagatcattggctgggcactaaagatacaggtggagtaaaaaattaattgtcaaaataactggctaatttaaaatttacaattgcctagaagaccatctttgatgttaagaaggaacaattaagtaaatactaggatggcaaacaggttccataatttcattttgttgagacaacagttttgctcatgtcaccaggctgaagtgcaatgttgtgatctctgctcactgcaacctccacctcccaggttcaagcaattctgcctcagcctcctgagtagctgggattataggcatgcaccaccatgcccaggtaatcttgtatttttagtacagacggggtttcactgtgttggccaggatggtcttgaactcctgacttcaggtgatctgcctgccttggcctcccaaagtgctggggttataggtgtgagccaccatgcctggccaggttccatgttatgtgccaactctgcttcgtgacagccaccagagccccacattcagggttatgaggctgcttctggctcactatgaggagttggtagacagattctttggctgaaggttgtttggagatcaaaaagtgcagatagaaaatggaggcgcagataaggaagccacctacaaggcaggtctcttcacctccaggccagagctgagatccctgtgctgatagggaattctccaacttccagacagcctggggctgccctttgcgtacatgggagggtctcttcctctgcgcttgcacatggaggccctccctggtccaggtggaggggctgctgtcccgcagtgtggccccagcctccacccctgctgctggaccagctttccccaggcccctccctgggggtgcagcacgtgaactccagagaggcgcatccttgggcccatggggaggtggaaccactctgccgggctgtgcctgtggatggggcgggcgcaggatctgcttttaatgacacggtttgggcagctggactctgtctattccagcaggtaaattacaggcttagcaagtcagaaatcaaataaacactccaactcccagtggctgctccaaggagaacagcagtttccgagaacagcagaggctgagacaaacctctccacccaactcagcctaattactacttgtcactccctgaaaaggaccttttctttgactcacaggcccaagacacaggacagggctgctgggcatccagggtgacactgactttggtgatcagcctgtttttgatggcccctggcctcgccccagacccggtcacaggctgcccatgttgccgatacatgctcgggcagggatggactgctcctcagcatggcagaagatggcaaccaggtttcactttacatcatatctgttggcagtggctgtgctgatcatttgaaaattccactcagatttggaagaaaaacattccagattgattactgatgtctgccattcagaggggaaagggaaatgatggcatctgtgctgtgcattgtcatcctgggccacccaatgcaaccacatgcttgctcagcaaagggaaaactccacagagctgagctcctggtggggcaacatggtggcagatagatgggtcaattggaagccccaagatttttctgtttctccaaagtaaaatgtccatgctcttacatgtctttcctagatggcagaggcaaatgcaaagcaggaagacaagggaagataaatgccattggctttagccctaaatcatgctgttcactcagctttttcttgagttgactccacatgtctacctgtgaccagtggatcagtgcttcagatccatgaatatacaatacttcaggggttatccagttttataccccaccttgcacctcgggcaggcaatggggagccaaccagaccctgactacacacaccacaccctgtgatggatggtgaagagctcaaggtggccaacagtgggctccaggtgcctctcaggtcattccacatctatctcacgacctgagccagtaaggggcatggataggacctcagacaggacttctgtgccaaccccaaagaaccagccaggacatgcctccgggagaggcgtttgcatttgggtagaacactgcctgatgattgagaccacctgggctggaaacaggacagtcacacaaatgcctggcagggcaaggggagcataggagcctggcatgaaggagaaagggtcatgtacgtggttgtgagggtcctccctggcaatgccccggcctggggtctggctgggtttgagggtttcctgcttctgaggggcccgatccagatgagaagggtggctgcagctgggccgggcgggtggactcagtggcagccgcaggccttgaccaccatgttgcggtgcttgcgcaggatgacattgttgctgctgtcatagtagagcacagaggtggcgctcagcttggtgggtgcacagcacgccttggggactgcgtctggcatcatcaggtgcacctggccaggaagagggcacaggcaggggcatgagcccagtggcctcctccaaggacccacccagccccaccccagctccacctgctccctgccctggccatctccaggccacatgggagcagcacaataataataactattaacaggaataagagcagtcctcaaggctccaggagtgggagctgtagtaacacgcagtgcccagggagggacacatggcagggggtgtgcagcaggtgggcaaggcgctaatgaggggcctggagtcccaggccaagggctcagacttcctcctggggataatgggaaggagaactgtgtggccaggtttgtgcccttagtgaggtccccaagggggagcctggaaggaccactttcttcttttggcccttcggacccccagaggctctgcctcccacaccctggcctccctccccagtctctgggaggccaggcctccgcccctctcctgtgctgctccttcccccagaggactgcatccgccctcagcacttcaaggccctgcacgtgcccgcacctctccactccccaggctcagcttggacctctcttctgaactccagacttgtggatcctgctcccctcgccacttctgcacttggggtctaatggggcctcagcggaacatggagttcctcccgccctgacatcatagcccccgcctgggaggcctcctggatgactcctcttgcctcctcccttccctgggagcagcccctggctcaacctccacctccatgctgccttggaccacctgccccgtccagctgccatcacctgtcaggtgaccacagcagccttcactcatcccctgctcctccaccttccaccaccacccccacccccaatcccagcctcccccagcagccagagagaggtccttctggagggtgacatggaccagaacactgctttgctaaagagctccgacagcctcttgggttacttggaataaaacaccttcattcagacccccaggccctaggggagccggccctgcccaccctggtgtcacctccctccgccctcctcccactcactgcacccagccccttctccctgctggccctgaacctgccaagctcactgctgtcttagggccttggaattgctccttctgctggaacattcctcctccagctgctgactggccccctccttctgtggagaggccaggcccagtctctccccactgatggagcagccactctgctcttcctcacaggaggcgtcacctccacggttgttttgctttggacaaaccaacaaaccgacagcctcccctagagcgcagcgcctgtctgtttgctgcccagcaggttacgagtgctcactttagttgagcccctgaggggcaggggcaagggcagaggagatggagtctgggagctgcagatgcagtcaccttcccgcgtgcctcccacacatgcagccatgagaaccacacggcataaagggtggctgggctgggccgccccacgcgtcctcatcatccctgggcctttccaaggaggtggctccaggtgtccagcaaacaccatttgactgcccagaaaggaagcattatcataggctcagagcagcttttggtaatttatttcctctcacaccaaggcatagtgtgcgcacgtgtgtgtgtgtgtgttttaatttttattttagagacagggttttgctgtgttgcccaggcttgtcttgaacttctgggctcgtgtgctgcgattacagggtgagccaccgcacctgatcaaggcatcaccgttgaacctcctaaggggaaaacataaggctgtgcaataccaggaactgggattctaggtaaaaagttctagaaggaagcctcggtgccagaatccacaaacacacagagcactcaacagtgagcagcaccagtgatcccatcagaaacctgcttttgtcctttaaggttgccccagataccaaggcatcaaaagccaggggatccagaaaaaacaaagatggccaagagagaaactgggggaaaagccaaaaggttgagagccacaccatctagaagcttcctgcctgcggtgcggcacaggtgggtgagtgcacacgcacaccccacacactgtgcacacatatcacgggcggtcagacttgccagcgtactcggcggcccgtgtgctaagatcacacagcccccacacagtgtacacatctgtttcatgtgctgtgcctctgagcgctgcacacaggtgcgtaagtgtcccacaggagtttgttcggtgcatagaacaggcatgtgtacacgactgttcacgtatgtccgtgtttgggtgcgagtctacgtgtagtgtggctgtataaggaccagttcctgcagagctgtgggaagttagcgacgttactgactgtgcagacaaagccccctgagacgcggagcaggtggcctcactgccctcccagccagctggaccagacccctctccacagggccccccaccccagggggctgggcaggatgggcatggtactgaccagggactgcaggatggcgtggttggtggcattcatgcaggagtccagtgggaaggagcactccccctcacagtaataggccgagtagccttggggagcgatgacccagtcctggggggcaagggagaaggtgagtcccatccatgtgcccctccctgagcctcagggcccaaacccatcctccagccctgcagggccgtctcccccaagaggcttgaatccacccaggaacccccggcagaaaaggctgggcaggagctcaggcccaacatcccccatatcttcactttgcgtcccctccccagccggccctcccctgcccacgcctcccagagctgcagtcgtagccaatgcagggaggtctcagttaccctgcagcaatgctgacagcttagttggttgattcagtcttcattttcatggttttaaaaaaaacaaaaaactgaacaaaaaaaaaaccctttctcaccatattctcactttagaaaacttggaaaacacagaagaaaaaaatacataagaaaattgaagtcaccatgattctatgtcctccctgcagattcacttctgatctacaggtggtgattgtcatttcagaaacaagaagagtcagcaattaccagccagccgaggtcctggaagctgacgtagagctcgtgccgacggcagacctgccggccgtgggagccgtggacgtcatctgcagggacagaaggggcaaggtcttttctggggttcctactgtgtgcagctactatggggtaccagggtgggggatgccctgatgagcacatttgtcaaataaatgaatgacaggaaaccatttggtctcataaagcccatccctggaactctgcttgtaccatgacccagctcagaagcctgccatggctcccaatggctagagtgacactgtgcccagtcctcccctgtccttcagcctatgagcgtctttatgctccagtaaacagcccagcaggaccctcggccatcctgtgcctcctcctctctggagacccctgtgactccagcccaccctctcctgccacacccattcccgaggttcaagtggctcacgaccaggccagtcaagggccgactccctgggaaggagggcacggggttgggtcaggcctgtccctgatcctgaagggcttggcccagttggggagaaaactcgcataagcaaccgaggatcccacagggtgcccaggcacaaccgcaggtcatgaggggctgcggctcccagggaaggggcagctgattctgaaggaggctcctgagaaagacccggaggagccagggggagagagggagacttctgggcagcagggacagccaggacaggcctccggagtgccggtcaccagggtgcatcagggccaagatggtgtcaggaaaggtggctggagagtggccgtcagcttgaaccgacctgagcctgagggctctgggccaccacttggttctcgccctgcctctctcagccagaagcccacagggcctcggccccagcctgcccgaccctcaccaaagatccctgggagtcggttggcctgcggcagctcgttgcttttcttcggctgcctcctcctcagtggcctcactgcccgaggggtgcggatgggactcggactggccctgaagaaagtgaccacgaaaggctgttgggagcgtggggcccgttgacccagcaggccggccaggccaggatccacgctgtgccctgagacagaaaggagagaggggtcactcacgggcagtggccctgcagcagacacagcagcggtctctctgccggggcctgggcaggtccaggagcgtggaggctgaggacccaaggggtcctgctgagcctcagtttccacatctgaagcctggagtccttggtccagccccagccagtccacgtctctcctggggacagatttggaggaggtgggagggggtgctcagtgagctgcaggcggtgttattagtgacagctgcgtcacaaataataacatttgtgaagtgttttacaagttggaagatttttcccatggatcacctcattgggtccttacagtgaccctgcagctcctacttcacaggagacccagagtcctactgccagtgactccgagaaccagcgctcccaccttggtccaaggaccccgagacctgtgttctgtcttccgtcccgcactttctggggtgtgaatgtcaaacttatcaccgagacagctcgtggtagcatctgccaggttgagcgagtgcttgttctgctgggcacagcccaagagcagggcattaactgtctccctgatgcccacaagggagatgccaggcagagcagaaacattgaaccaagtcccagagcccaggttgcagcctgcggcagtctcattccagagcccgagttcttatgcacgagctgggcttatggacagaaaagaaagaaagaaaaggctgaaacagagatctgacttgggcctcagccccaggaggagtgaagcctgtaaacgggattgtcccccacagccgcttccagactgaggatgccgctgaaaacatgataactaaccctggagatgccaagcctcaccaataaaactgtgtatcatcctgtacttgtttggatttcaataacctttctattgtaaaagcaattaagtaaagaaacttttgaggccaggcaaggtggctcacgcttgtaatcccagcactttgggaggccgaggtgggaggattgcttgaacctaggcatttgagaccagcctgggcaacatagtgagaccctgtctcaacaaaaatataaaaacaaaaatgagctgggcatgg

SEQ ID NO: 14132 - DNA, 122772 bp, Human
ggccaaacttaaaatatttaaggaggcagctctaggctacatgtaatttaacagggcatgttcactgacatctttggtttgacttgcataattcaaattttattttaaaattttatttttctacctgtaagatgtaagatatcagagggtgagtgtgatggctcatgcctgcaatcccagcactttgggaggccggggcaggcagatcacttgaggtcaggagttcgaaagcagcttgcccaacatggtgaaaccccatgtctactaaaaatatttttaaaagattagccaggcctggtggcaggtgcctgtaatcccagctactcaggatgctaaggcaggagaatcgcttgaacccgggaggcagaggttgcagtgagctgagatcacaccacagcactgcagcctgggcgacaagagtgaaaactctgtctcaaaaaaaaaagaaaaagagatttgagatatcagacccaaagccagattctgcttctcttagaacacaatccatgcattgcatcagtctcctcaggctgttataacaaagtgccaccgactgagtggcttaaaacaactaaaatttagccctgtcctgaaggccagaagttcaaaatcgaggtgttggcagcgccacgctctctctgaaacctgtaggggaggattcctctttgcctcgccctggcttctgggtttgccagcaatccccagcgcgccttggctgcagctgcattgctccgatcgctgcctctgccagcacgaggccttccctctgggtatccgtttctgtgtctcttttcctcttcttataaggacaccagtcacattgcattagggcccaccctagtccagcaaaatctcatctagacttggttgatctgaaaagaccctgtttccaaataaggtcacattcacaggtcacatcctacctgtgcactgtgccatgatttatttaacctcttcttgacgagcctctgcatctccagctctgctttcaaaagcaccatggtaatgaattaggtgtacactcgccacttaaaaattacataaataagtctatggaagaaatagacttgtttctgttagttagaaataagtcaaagtggagaacctttaactcccagaagattcatgtctccagtcttcctacaatcctccactaacaccgttgcccctcccattatttgtcccctcccttttcctgaccatctaaatctgtttcactttttagaccccattccagtcccaccctttccctgaagtctccttgggtatttatcttcgcagtgaagtcttgctactgggaacttacagtggtgatgttcatgttgcacgttttggtaggaataacacatccatcccctcccctcccctcccctcccgtcccctccccctccccctcctcagatacatggtcccatggcttctgcagcattggcctgcatctctgctgcacattttccgaacttccccatgttttacctcaataaataaggcaccactgcgtttgctcttggcgccatgctggggaaagaaggagaggagatcaaatgatatttggctgaatggaggaaaatagcctctggagggtgtgtgtaaaagttcaccagataactcgggaccgtgtgagcaccccgttcccaatgaggggatgctgcccacaaccgagcgtggatagtgaggtgtttctggaaacagctgattctaagagactagaaattggtttttaaagcttttcctcaacattcagaataatttggcttcttgccatttgaggttttgggcaccaggaatggtgagagcctccctctgccatggcgggacctctgaccacctccaatgtcccttcctggaggccggacctctgactgcccccgacgtcccttcctggaggccggacctctgacctctccccatctcccttcctggagaccagacctctgaccacccccgacgtcccttcctggaagccggacctctgaccgtccttggtgtttcttctgcagcctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagccgtaagtctgggcccttctgtgggtggggctgccgggtggcagagggagggcagagcagttattgccccaagctgagcagtctatctgcagccgaggctgaggtcgtgtgctcccgacatcttcaggatattgtaccataaatcacaggctgagggagaaatggtgagggcacaatagcaaatggaaatacacaaaaaatagctgggtgcggtggctcacacctgtagtcccagcactttgggaggccaagataggcagatcacttgaggccaggagttcgagaccagcctggccaacatggcaaaaccctgtctctaccaaaactgcaaaaattagctgggtgtggtggcgtgcacctgtatcccaactactcgggaggctgaggcataagaattgcttaaacctagatggcagacactgcagtgagctgagatcatgacaccgcactccagcccctatgtaacagagcagactctgtctgaaaaaaaaaagaaaaaaagaaacaaaatgaaaaatggtaacatctgggacatgaccaggaggaggtttttttcccctcagcttcttaaaaatcattcattgaaagctttatttgaatttaccttgcttgggatactacagtattcataaaatgtcataggtaaagcaaaaaaaaaaaagtaaaacagaagtgttattctagaggtttaagattttgagtctgatgacatcatcagacttaggatgccctctttggaaggggagcatttcatagaggagtgggatggagcgacagacgtgtgcagcctccagcacttcctgagaccgaggcagcgaatctccgtggcttcactaagcacttaagcactctctgtttcaacacagtgggccctactgagaccccagctgtcactgctggtttaattaccgcaggtacccagtattattcccgtgcccagcgacactgtgagagccacatccctgggtctacctgtatggctggaaccactccattcagttgtcacattagtgtcgcatgtcactggggcatgacatagtgccacacactggatggcttaaaacaatagaaatgtactgtctcactgttctggaggccaaaagtccaaagtcaaggtgttggcagggctacactctcttcaaagcctctagggagagttcttccttgccttctccagcttcagcttgtgacagtgttactccagtctctgtcccgttctcacatagccatcttccctttgtctttctttgcatcccaatttccttcttataagaatacaaggccaggtgcggtggctcatgcctgtaaacccagcactttggaaggccaaggtgggtggatcacttgaggccaggagttcgagaccagcctggccagcatggtgaaaccctgtctttactaaaaatacaaaaaattatcttggcgtggtggtgggcacctgtaatcccaactagtcaggagactgaggcatgagaaccgtgggaacccagaggcagaggttgcagtgagccgagattgcaccactgcactccggcctgggtgacagagcgagacactgtctcaaaaaaaaaaaaaaaaaaaaagaacacaagctacattggatgagggcccacccctatcatcttaacctgattatatctacaaagaccctatttccaaaagtcacattcacaggtactgggacttagaacttcaacatctctttttaggagatacggtccaatctgtaacagttgttatcttttaggagaagatgcgttgccatgctgagaacatactattcctattcttgttcattcagttattttattaaacacaggtgtagcaaagtattatttcaggtgccaaaggttaaactgcaagttattgttcctgccttctagagcttacaatctgattgggaactgaacagtactggggcaaaacagctcagtaaagggggagagcggtttcgccgggataatgagtggcacagtcggccctacaggagggagaaacggaaaaccgctggtctgataagggcaatgacagcttcaaggcacgtcacctgctgggctgagcctggagtactgtcagtgtttacattaagggagagggaagggagaaccttctagaaaagaaaattaggctttgactagggatcatggattagaataaccccatttaagaagagacagtggtttgacgagaaaaccacgatttatttgagatcatttgaagggatagtgacagacacagacgcagggctcttccacgagtccctgatgtttgacggcagcagctttgtgctggggacaagcccagagccttcccagttgaaagaaaagagaatacagggagtgctctgggtttgctgtcagcttcctccccgcgagtgtaacaggaaagtggtgttcttatctccttataacccaactgtttataccccacacaaccacgcagcccttggtcaaggccaacaagtataggtccttccaggcttgccacggtgatcagagagggagtgtcctggggtcagagagagagtgagtatgctcagctgtgtcccatactcagcagctgacccagagcacgtgccctgtgcccagcacgcggctggcagcaggagtgtgcagtcgagtgggatttcaacaacaatccaaatgtcgtgaatggataaacaaatgtggtgtatacagatgatggaatagtacccagccttaaaaagagaggaagttccgatgcagggagtgacacggaggggccctgaggaccttgtgctgagtgaaataagccagtcacaaaaggacgcatactgcataatgccacttataggagtccctagagtcatccaaatagagacggaatgtagaatggtgggtaccgggggctggggggaggggaaaagatgagttagtgtttgacggagacagagtttcagtttggaaaagtgaaagagttggggcaatgaatggtggtgatggctgaacaacagtatgaatgtacttgctgcaactgaactgtacacttgaaaatcgttcgaatggtggctgggcgcagtggctcacgcctgtaatcccagcactttgggaggccgaagtgggtggatcacgagagatcgagaccatcctggctaatacggtgaagccccgtctctcctaaaaatacaaaaaattacccgggcgtgatggcagacacctgtaatcccagctacttgggaggctgaggcaggggaatcgcttgaacgcaggaggcagagcttgcagtgagccgagatggcgccactgcactccagcctgggcgacagagcgagactccttctcaaaaaaaaatagttcaaatggtggccgggagaggtggctcacgcctgtaatcccagggcaacaagagtgaaactccatctcaaaaaaaaaaaaaaaagttcaaatggtaacttttatgtatatttatcaccataaaccaaaaagaggaatgatctggtcaagactccaatttttatgtcatttgagcttctgaaaatcaggctgatggcccaaggctccccacttacattttgaaagggtgtatttcaaggaatggaagagaatgtccccattggttacctgatggtaagcaagcccctcaccccacttgtaagtttcagccctcaggccagcaagggctgccttcacctgcgtcattcacagcctctgtggccaaggtttggctcaagccctttctgctttcagcatcctggcagcaggttaacctgattactcagcaaagactctgcttccaaataaggttgcagtcacaggtaccagggcttagaacctcaacctcttttcagaggacgctattcaacccaaaacagttgttatcttttgggagaagatatgtttggcatgcagagaacatatcattacattctggcagcagggtgggtggtagtttcaagttcgtagaaatttgctcctttataattggattttattgagtatctttatgtgctaagttccttatgtgcttggctgattctgttaatttggctaccaggataatctctgtggaggaatgtgagttacttaaagacttttgatggtctgaaaatatttggatgtaatttatctctgccttttgtaataaaaagatactttctgtaaacatcgaccatgaagatcatttttataaaatctgttcccatgaattttattctaaaatagggaatggaatggagaaaattagtctttagaagacagcactccttttttttttttttttttttttttttgagacagtctagctctgtcacccaggctggagtgccttgccgcgatctcagctcactgcaacctctgccttctgggttcaagcaattctcctgcctcggcctctcaagtagctggggctacaggcatgcaccaccacacccagctaatttttatatttttagtagagacggggttttgccatgttggccaggctggtcttgaactcttgacctcaggtgaatccgcccaccttggcttcccaaagtgctgggattataggcgtgagccaccatgcgcggccaacagcactcattttatcatgtatttattcagcaaatacctattaagcaacttatgtgcctaaaactgctagcatgggtaataggatgacaaatatgtgagccctgctaatgggaaaaggccaatgtttgttttatttaccatttgattaacagctccgtgcattatgcataggaaggtgtcagtgaatatctactaattgaacaaaggaaggagcttttgtttctttgggaagaacagacaggtaattcattacaatggagtgtgatagaacccgttccgttattgtgggaggaaaccccatcctatcttgatgagtggaagagctgatcccagaggaagtcgaaattcttttcaacagggaaaagcaataatcagctgtgcattttagggtgatcccctaactggttatggaaattagattggaggtggttagaacaggagcccagacgagatgcagtgtgaagtaatctaggcccaggttgcagctgaaggtagaaagaaatggaatcgtgtttaaaagtagagggcaattttgaaggtaaaattgaaaggaatttggaaggtagtggttgattaattgaaggggaaggagacaaatcaggggtgattccaaaggttttgccatggaaaagtggatggatgatagttccagctctgggggtatggagcagaggaggaagagggcagggtgtatatgtgagtacatgtgtgtgggtgtgtgtgggcatgcatgcaggtgtgtgcacaggtgtgtgtgcatgcaagtgtgtgtgcatgcaggtgtatgtgcatgcaggtatgtgtgcatgcaggtgagtgtgcatgcgggtatgtgcacaggtgtgtgtgcatgcaggtgtgtgtgcatgcaggtgtgtgcacaggtgtgtatgcatgcaagtgtgtgtgcacaggtgtgtgtgtgcaggtgtgtgacaagttgtacatgcaagtgtgtgcacaggtgtgtgtgcatgcaggtatgtgcatgcaggtgtgtgtgcgtgcaggtatgtgcatgcaggtgtgtgtgcatgcaactgtgtgtgcaagtatgtatgcatgcaggtgtgtgcacaggtgtgtgcctgcaggtgcacaggtgtgtgtgtgtgcaagtgtgtgcacaggtgtgtgcgtgcaagtgtgtgcacaggtgtgtgtgcgtgcaggtgtgtgcacaggtgtgtgtgtaggtggtggtagtccaataaggcgcctgtggcacatttaagtcgaggtgcccaaagggcaagtggatattgagtctggagctggaacttcaatttgaaaatcattcagatataagtggcaattggtgctataatagtaggtgaaataattcatagaaatgtatggcaggtgaaaagagaaccagaaaacacgtggacatctaagggacaatcgaaaaaaacggattctgaattccctggaaatgaggcagaaatccaagtgaacacagcatcacaggagcaaagggaatgtgtgtaatcgtgtttcacatactaagagtgttgagtgacatcaaatgcagccaactagttgtgtaacataaggtcgttgtgacttcggcaaggatacttttagtggcagggtcgacagcagaagccatgtaatgtgagttgatgattaagggataaagaagtggtgatctctagtgtagatagctcaagtatcctgatgtgagagagaggacaggggctgtagctagaagaatggaggtgatggcatcttcctacaaagaggaatagactcaaaccctactggggaaagagtgagtgcagggagaaattaaagattggagagaaaagaaagtgtcattcccgtcttacaaaggaaaggagtgcgtttccttataggcagtgggagcacatcaagcacttgcgatggagacgtttgtcttggaccaatgggaggagagtcatcttctattggtttgaaaacttctactgcaaaggtgttaggatgatcagcgcttttccaatttccttccacagcagtcactcccatgctccccatctttttctcctaggaattcacttttgatttattggaagcagagcctgagctggggtttcaggagcaagtttgtttgtttattaagggagtgctctcggaaggaacctgtaagagggtgagagaaaggaagaagaagctgagcaaagatgtggttgcagatgagatccactctcagcctgtgacagcagaggagattggtgctgtaaattgccccagaatttgccctaccttgaggcaagacagctggattttgtgccctcacacaagacaggctttagttataggatgtcccaggacaagggagatgcacctccagctgagatggctttgatcacccaagaacaatcctgctaaaaaggttgcaggtgtgagccatcggtagcagcttctgcagcagctgggtgcaccagagcccattaaaatgaatcgaggacatattctatagtctgaattctctatgctcttcttttgccagctgattcatgtatccagcagatttgagtcttgtctgtttaatgttgctgtaacaatatacctgaggctgggtagtttataaagagaagaggtttaattgattcatgattctgggggctggaaagctcaagatggagcagctgcatctgatgaaggcctcatgcctcttccactcatggaaagcagaaagggagcagacatgtgcaaagagatcacctggcaagagagagaaactgaggaagacaggcactttttaacaacctgctctcaagggaactaatccattcctgtgagatacccctgcagtagggtattaatctattcatgagggacctgcccccatggcccaaacacctcccactaggccccacctctcaacactgccacattgggggatcaaattgcaacatgggttttgacaggaacaaaccacatccaaaccatagctgatactacatcagtttttctattgctgcatagcaataacctccccaaaacttaacataaccaccatttacttaactcacaattctgtgggtcagcaatttgggtgggcattcttctggtcttgactgtgcttattcatactacatctttggtcacctaccaggttacttggggactggctggaccagagtgacctcggcaggaacagctaacttgtctcaattccacatggtctcttttccagcaggctagccccagctcgttcaaatgcctgtgacagggttccaagagagacagaagtatatgcaaggtcccttgaggcctaggctcagaacaggcacacggtagttcctcctatccaaggtagaatctgtttcctcctccccagatctgggttggccttatgatttgctttggccaacaaaatgaagcagaagtggcagtcacattacagagggagtggatacaggaagaagtggaggattaggcacacctctatctctaccaagacaatctaccttatcacttggtttcaacagctaggtctgcagttgaacacatgatgtactagatagaatctggaggttcatttggctatttttagatggttgacagctctgagaataatcttcctgtaaagtagattgttgcggtttgcatcccctcagatacaaactctaagaagagattggtgtgcaggatgtttatcacgaagtgctctgaggattgacacctgtgggagaagggaaggcaggaagattgggcagagggtgaagttgtgatgcaatgcagtctcaacaaaggcctcagctaacccacagggaggactaagctggggcggctcatcagagttatcccaggttggtgcaaagaaactaggcctttatactctgacaccagccagtcagtagacgacagctgtcctgggcagggagctgaccttgggcaaggcagctctctttagccaagggcaatcccggctaatagttgaaggttgtcagttggcagggttctcaacagctgggaaaatacccttcatttctgaaaggggatctgggtagtgcaccatggaaaatacatgggatttttctccccttcatttttaaatttatggtaccaaaatcctgacaggagaaaataagggctgtcctatttcttcttattatatatttaatatataactaaactaaagggaaggctgcaggatggttggttaggactgaatgaagaagtttcattaggcccaggcagggaggaactacggccccttgccaacagccatcactagcttgccagccatgggagggcataccatggaagtggatcatccagccccagtcaagccttcagattaggcagccccagctatacccaactgagagacctcataaaagaccatgaaccaggattgtccaactgaactggtcatgaattcctgacccacggaaaccataagagatactatattagtttgctgggactatcataacagaataccacagactgggcagcttaaacaacagaagttgatgtgtcacggttctggaggctggaagtccaagatcaaggtgttggcaggttcagtttctcctgaggcctctctccttggcttacagaggcatcactgtgctttcatccttggcagctcctctccttcttttaaggacacaagtcctattggactagggcctaccctatggcctcacttaattacctctttaaaggctctgtctgcaaatacagtcacattggaggttagggatccagcatatgaattttggggaaacacataacacataaattcagtccataacagataataaattattgttgtctgaagccactgagtttttggtgatttgttatggatcagtagataactaatacttgtttcatccggtgtgaggggaggtagcatagctcagtgaattgagccatggataataaactcaagagctttgggttgtttttaaaaatggactgtcttttgccattcagtcagtctccaagacccctagttctcctattatgaaaatctgggagaagatcactgaccagtctttcaaggttgttatgtgaaataattaccttttctttcaaagatagaaaggcacttaaaaaatctataaatatctcaaatcgcttgacattaaggaacagttaaagactttatatgcaccactttgctcttatattcctgactgccattttaaatacccttacaacctcatcaggtcttgatgttaaagctgtctgcccagaaatggtaaactagcagctctatagtctgtgactcacaacagattagatactttaaaaatagtttggaaaaatttcacattgggtcaaggagtaggagctacagagagaactgattctcagcgggattggttatcacgagagctggcgcttagacaagtgctgcctgtgtgctgaagagacaggcagagtgtgtctattctcccagctgtcaaaaaaatattataattggcattcttcctatgttcctgcactgttggaatcatgactcaatgaacagaaagaaggcagagagagagacacacacgactgggagcgtggcccttttttctgagcagtggccggggtctttgggattcttactcattctgttccccagggtagctgagctccaaagaaaagctgttggatctttttaatgtgataaactccctgcctctgtcgtctccccagggacccatgaggggactcacttgttcagtggtcatttcctatctgcttggcactgtcctaggcactgagcactcagagacagttgagatcattcctctctttgagagtctccccagcaaaaagggggtgcatcctgtagaagcagaactctggagctaaagccattgaagggtgcatcctgcctcttcactcacggggcagcaaaactaacagatgaaatacctactcctacagatgcacagattgcatggccttggattagcatcattttggtcacagggatgcaagtgtagggtgaaaaatggaaatgtccagtagtgtattattttgctctcttggttgatagagttctcaagataaaatctgcatcccttaaccatgacgatggccactttagggttcatattgaatttttccatcctagagaggcaaccctgccttcacctgggtgaggccagggctcaaatattggtgttgtagagttgagatgttcactagagtgaatcacaggtaacctacatatagcacctctattgggaggcagagtgcaccgtgattatctttttccctaacttgggctggcaatgtcaataaaggacatcacctaggtatgcagtagaccttaaatatgtgtatttcttgtctaagaaaccatcatgataaaactgtcaccaatttcaaagccagggacagaagccagttgcagagggttgcaaagtgagtgtgagatgacaaagtaagggtggaggatgtggacagctttatcaagaagcttggtgtgaagaggagatgtgagtgagggcttggctggaggaggagggggacccaggcagggagggcacctcttttaaaagatgagagtgactcggcatgtccctgtgctaatgggaagttcctgcaccttggatcccactgtacccgggcctctgttaaatgggaatatcggatttatctcacagggttgctgtgaggctcaaatgagataaaattgtgtaaagttactcccccaaaggctcaatggctagcaaacgctaaagccaagatttgaaccaaggcagctgggctccagaatccgtgttctcagcatggttgtccgtcacctctggagagatccgagattctcagctgatccaaggttgacgcagcatcttagctcatatacctgattaggggtttggcacatggtgtctcatgggtcaagtctggcccaccacctggttttgtgattaaagttttattggcacacagctacgtgcattcatttatttattgtccttgccgttttcatgctgcaacagcagagtgagttgctgcaacagagactatatggctcacaaagccgaaatatttctatctgggcttttttcagaaagtttgccaatctgtgactaatctgtgccagagcttccctttatactgctagccagttgcttgttggaacatccaatgcaaaggggcagattgagtctcatccccagaaaggcaagggacaaacagtagtgctttgcctcactaaagacgtggagtgcattccactggagagggcagtggaattagttatttgtcctgcccttaaggaggatcagactggccactaagctggcaaagtgggccagacgtggtggcttacgcctgtaatcccagcggtctaggaggccgaggtgggcagatcacttgagcccaggagttcgagaccagcctcaacatggcaaaaccccatctctcttaaaaatacaaaaaattagctgggctggtggtgcacgcctgtagtcccagctacttgggaggctgaggtgggagaatcatctgagcctgggaggtcgaggctgcagtgagccatgattttgcctgggcgagaggactgagaccctgtttgaaaaacaaaaacaaaaagaaaatgttggccaagtggtaaataatccagcagagttaggacttgaagattatactccttgccttcagagcgttatagaattacacactctgcttttgggctgattgaggagatttggagtaacataaagtgaaggtggaagggtctttgttcttccccttaacctccttgagtaaggaagggctgcacatttgaagtggcacagacaaacagcataaacttgcccttccctcccttgccatgatttccagaggagggacttgttcagatttgtgtcgtttttttgttttgttttgttttttaaattttggaagagaccagcgttttgccatgttggccaggctggtcttgaactcctgacctcaggtgatccacccacctcagcctcccaaagattcccaaagtaatcccaaatccaaagggattacaagtgtgagccactgtgccaagcccagacttgtgttttatgtatttgtttgtttttagagatagattctccctctgtcactcatgctggagtgtgatcatagctcactgcagcctcaaactcctgggctcaagctatcctgagtagcctcctaagtagctgggattaccagcacacaccaccatgcccgactaattttttttctgttgttgaagagataggttctccctgtgttgcccaggctggtcttgaacttctgggctcaagccatcctccttccttggcctcccaaagtgctgggagccaccacgcccagcaacagacttgcattttatggaatgattactctagtaacaggctagaggctggaatttatgcggaaaagactaaaccagaaaaccagtaaagtgctgcagtagcccagtgagaggtgacaaaaggctgaattacagccacaggagtggagattcagaggaaggaattcattataaaagtgcagcctggatatgtggcgtgtgggaagaggactctagggggactctccagtttctggcatgaaaagaaggatgacagtgtcattaaattagaaaaacactggacggagaagtagagctgggatgaaacctcagttccatctggggcacattttctttcattcctttgggacatcaaatagaaatggcacggacgtggatttagaagtctgatgtggagaagcagaggttaggaaaatgattctctttgtccattttatttcccatgccttaagtcaaccaaatcaagactctgaacactttctacctatgtaacagccggtgcggggaagaaagcaaatgtcgtttaattctaataagggacacttctttaccaatagagttgtgtgaaaatgcatttggggggctgaacattaaatggtggaaaaattactgtacctatttatgcatcctagacaggcttgtcttgatttgcatttagatgagaattccttcagctcagaaccgggactgtcccctaattcataagcacttagaaaagcattaactttagctggcgaggtatccttggtacaactgtgacacaaaacctaataccagtgttcccttaatgactcaggagaaagtagccattgaaatggtggaaaagtttagaacaagcttcctttgccatctctttgagaaggaacgcataccctgttaatcaatgaccgcccagcctctctcaccgtgcttgagtaaacctgtttcgaagggttgtgtattttttccactcttttggaggcttcgtgcaggactctaaagcattattattctaagtcctgagtaagaatgtcagctgctcatcgtagcgtgattacagacagaggtatattttatttttttaaaaaatggaaattgaaacaggtggttcaatgaaaagctttctaaggaactacacagatgaaattctaatacgatttctacagctctgcccgtgatttcctcttcatgtgctgaatcaaaagccctttgggaggccaaggtggggggttggatcatatgatgtcaggagttcaagaccagcctgaccaatatggtgaaaccctgtctctaccaaaaacataaaaattagccaggtgcggtggcttgtgcctgtagtcccagctattcaggaggctgaggcaggagaattgcttgaggcggaagttgcagtgagccaagattgcaccactgcactccagcctgggtgacagagcaagactccgtctcagaaaaacaaaaacaaaaacaaaaaaagacagtgaaaggcccatggctagttctttcacgaattggtcaggctattcaattatggtggttcggtctgattaagccattacttactttgcatttgatttttcaaaacacatacatctggagaagtatttggttctctcttttaaaaacaacattcctgtaagatgaagaagttctggagattggttacaccacagtgtgagcatgcttaatgctactgactgtctactgaaaaatggttaagatggcaaactatgctatgtgtattacaccacaactcaaaccttttaaaaatgacattcctctgattataaaaggaaaaacataaaaaagaaaattaaaacttcctggaatcccgcctctttgagacaaatggataaattccggtgtcacattttcgtctaacttttgttgttcctttatacacaaatacagaaatggacagataacagatgtagaccctgctagagactgttcagcaacttagcttttcacttaatagtataatcaggtccctgtcttcaatttacatggtttcattgttggaggaatgtcatcttttcaagtcttattttcataaaatctagtagacacacagtataagtattgctttatacaattcaaattataaagcaaactactggttctaatatagtaaacaacgaatgttacatatagcctggagagcatttattatataccaaaagccattggatagaggttgtattgctatttggatacaaatcgtgcaatttcagtagaatggctcactatgaatcagattcttttaagaaactaagtatacagtactttagtaccagggagaccataaacgtttctgagtcatttgcctgctcaagactcagctacgggtttgagaagctgggagattgaaagaaaggagattttccttcttaagatctgtccacgttcctggacttgaatctgccctttcacttttattatgtctaacaattaaagattgatttggggaatctctgaataccagtctatgtgttcactactcagatctaataatactagcattgggatgtggtattaatatggtttattcttttccggaatgtaggaatgaattgtggaaataattttttttggagacagggtctcactctgtcacccaggctggagtacagtggcatgatcatagctcactgtaacctcgaactcccagcctcaagcagtcctcccacctcggcctcccgagtagctgggactacaggcatgcactaccacgcctggcagagaaataatttcgcatgagccgtgagtgatgtgttcagacacagctagtgggaaaatatatacttaatccattccgaattttttctagcggagcctccaagaggctatctatagccctacatgctgaaataatcaaagacattatcttcaaactaaagcctttgtcttagcttaagaatgtgtgatcctttctgttcccaagacacacgtctatagatggggctgtgtttacactctgcctgcctacttattcaatcttacaaatgggcaattaaaggaaaattctgtttcccaccaggcattaactgtatattgcatttagtctacacattagtttcacacgcatctgtctgcccggtcaccatgtgtgaacccctgtgttaagatatctgcgtggtgtgagaagaaaagcctcaaggtcaacacaaatactgatccatgcctttttataaggtggtaaagcaaatacaaagggcttttagaaccagtagactcagtgcatcgtcagcatttaccctgttaacctgacttaaatgggagtggtggacatgccatggactcccctgaacaaagcaaagtcaattttctatttttctgagaaacagaagcaggaggcaaaaagagcagtagagcaggaatctatggcctggataaaacaaacacaaattttttttaagtctatgcaaaacaaaatcataaagacccagctttttaaataaaccacctagatccaatgtcagaagatggaattgtatttacaaatatattttgttgagtggcttgggtgcatagaaaaaggtcaaattttatttctgttcaaacagcactgtagcaagttactatgaatcatggttgattgctcaggcaccagatcccctcacttctcaagaaagtcagcaaaatcttcctgcagctcaacacagtaccagcaatactgtacccatccattatattgcattcccttcccctccaatcttactgaatcacattctgacttgactcagcagatcattgtcatcagtaattaggaaattctttgcctcttttccatcttagtcctttaatacaaatgggcaccagtcaaataatagaaactggcttttcgtttgtctacaccagaaataacctgatagaacgcttataatgtgttctgctagatgcttagtgatagagctgcagattagtttaaaatcatcttataacatgttcttcattaatgtgcttgggataagcctatttttgtactgtttcggcgtgtgttcgcaccccaatactgaattagatcaggcacatttggtggcaaataatttttgaaaatgttattttcagtcttaaaataattttcaatggatttggcaaatgcataaaacaactcttactttgtaggtgctctgggatctgtgaaatacttttttttttttttttttgcgacaatcttgctctgtcacccaggctggagtgcaatggcgtgatcttggcttactgcaacctttgcctcccaggttcaagcgattcttctgcctcagcctcctgagtagctgggattacaggcacgcgccaccacgcctggctaattttgtatttttagtagagacggggtttcaccatgttggtcaggctgttctcaaactcctgacctcatgatccgcccgcctcagcctcccaaagtgctgggattacatgcatgagccactgcacccagccctattatttttatttatttatttatttatttatttatttatttatttatttatttatgagacggactcttgctctgtcaccaggctggagtacagtggcgcaatctcggctcactgcaatctccgcctcccgggttcacgccattctcctgcctcagcctcctgagtaggtgggactacatgcgtgcgccaccatgcccagctaatttttgtatttttagtagagatggggtttcactgtgttagccaggctggtctcaaactcctgacctcaagtgatccacccgccttggcctcccaaagtgctgggattacaggcatgagccactgcacctgccctccatcattctttaaacacaatattgtttatgtgtcttactttacaaataaaaacaagcatttgacacatttgacttctcaaagtagatggagctgcttttttgtctcatcctcacagcccaaagcagttagtctcttctgcctggtgtctagactatgaaggtaggggcttggattcaaacccacttgttgatgcctgttatgggccagccacacacaagttcagttcattctcacaacagtcctgcaaagaagatattattatctctattttgcaagttaagaaccaaggtttagaaaaataaaatctactggagattgtatgactagtaaatgattgagataggattcaaattgagacctacctttggaatccatgttcttttcattttaccaaatggcactccccactcccaaaccaacaacagcatttattgccacctagcctgagccaagacctataccaggcacacagtggacattggcacgaggcttagagactgacacacagaacagtccagcagtgagtcagtggcatagctgggactcagagccagaactgccgagagaggaaaggtgcaagctttgagcccaacctatgtcttcttccataggcgatgtttgctgtcttcattttatatacactatggtcacacaatttgactttgagaatattcttcaaaatcttaattaaaatcagttaacagctgatgaataaccacccccccttttttttttgagatggagtctcactgtgtcgcccaggctggagtgcagtggcacaatctcagctcattgcaacctccgcctcccaggttcaagccatcctcctgtctcagcctccccagtaactgggattccaggcgcctgccaccatgcccagctaatttttgtatttttagtagagatggggtttcaccatgttggccaggctggtctcgaactcctgacctcaagtgatccacctgcttcggcctcccaaagtgctggaattacaggcgtgagccaccgagcctggcctaaatatgcttttgaggttttacctttgcacttttgaattccacgatgttacttgaatcaaactactgatccaatacaatcaagttacctttcattcttaaatcaggaaacaacaacatcaaaagagaaaacacattttttatttatttacacatgctacctaagacattggcatccctctacctgcatcctaataaatggattcaatccttcaaaggtttatgtttagctaaatatattgttggattaagatatttgcatatggaataaatcctggggtttgttgttgttattgttttgagatgcagtcttgctctgttgcccaggcttgagggcaatggcgcagtcttggctcactgtaacctccacctcctggattcaagcgattcttctgcctcagcctcccgagtagctgggattacaggtgcacaccaccatgtgcagctaatgtttgtattattagtagagatggggtttcaccatgttggccaggctcatcttgaactcctgacctcaggtgattcgcccaacctcaacctcccaaattgctgggatcacaggcataagccaccatgcccggccaaattctgggttttcttattgtcgtgaaacgtagtttgtattgtcatccttttaaaattgttggttatttccagtttttcgtgactcattcattagataacaaatttatagttatcaatggctatgataaatgattatgtacttataatttttaaaacttaactacaataaagcacaatatagtgctactcaggtttcaggtttaaaaaaattagactgagtttttgtttactgataaaaattccagggtttcaaacagctgtattgctgttaatgaaatttacaaattaagtttgcctgtttgacttttaccatgtcacagagaaataactaaatgaattttcaccagatttgggtagtatgtttgagatggcctgactcaaagtgtaggctatgtggggtgtgataataatttactgagctcttactaagtgctggcactcttataagtgctgtctgtgtaattaactcacatattccttaccgctctatgaggtaggtgctgctacgatcccattttacagatgaggaaactgaggcacgagcagcttcatggatgtttcacagcacacagggccctgtgtttagatgagtcccatccttgatttgatgctctattgtcatagtctggaaattcccaatttttgaacaagggacctctcattttctttttgctctggatctggcaaattatgtagccagtcctggagcaatttaataaattgctcaagccagggttaagcccaggtagtatgtccagaatccatactccttaccattgctaaactacccttggaaactgagttttagtcctagagaggctgccaagccaccaagcagctgtgggcttcttgcccagggtgctacttcacacacaggtgattctgcatgggctgtgttagggtccagcagcagagagattaaggagggctcacgattcttaggagcgatcagctcatatctaataggctattttgaagaggaaaatggaaaaagcaatgccgcacagagtacttttgggccaaatacctttgaatggcagtgtagggctgtccagagatggcgtaccctttcatttctctgatgtggtgtccttcaagaatacaaaactattgctgtttctttctgaaagaatacccaagaaataacaagtaaaaaaataaaaatataatgacttgttcacatatttcccgagtaatacttgtcatttgagtccctctcctcaggttaaatttgggaatatttcattttcaagagtgaattcaacaacaacgtatcccagccgggcatggtggctcatgtctgtaatcccagcactttgagaggccaaggtgggtggattacttgaggccaggatttcgagaccagcctggccaacatggcaaaaccccgttgctactaaaaatacaaaaattagccaggcgtggtggcacatgcctgtagccccagctacttgggaagctggggcatgagaacagctcgaatccaggagatggaggttgcagcaagccaagatcacaccactgcaccccagcctgggccatagagcgagactctgtctcaaaaaagaaaaacccagcatatcctgagctactttgacatttctcctcctcctctactttgtctccctttactgtctctggcactttctccaatatcagactgagcatagtaaaagcacaggagaaaaatgacaaaaaggaaggtgaactatagtacactatatggtttggctcaggtatcagtagtatttgcatagtcgtaataagttgaaaccttgaatattgacatagcaaaagaattcataactatatggacagtgggaggaagggtttgggggcaaggtgcatttgtgagaggtagtcttgataggcatagagaaaaaatagaaatgactaacatcagtgagccatatgagttaaggaggggaagctagcaatgctgtgattgtgtctggggtgcaagaagactgcagcacagaaggcgggccaggggatggcttgctgcaagcctcgtcctcatccttcaccatgggacatcctgtagacacgtttctttgaagacaaagttaaatggaagaaaggctttcctggttggcatatctatgatcagccaatgaacactgtatgactatttcaaaaggatgggtttgtctgtccaaaaacagataaagaaaaccccagcatctataaaacacaaagaaattatcctcattttgaaaacaccatgatttaaaacatctaaaataattatgataatttttaaacaagtaaaattatattgcatataagggtatttatcaacttaagtagggttcagtctcttttgaggaatagaaatttgacagatttctgtcattatgagtatatgaaaggattgggcttatctgcagcgagacgtgtaccaagtctgtaagatttttgttcgttttgagatggagtctcgctctgtcactcaggctagagtgcagtgacacaatctcagctcactgcaacctccagctccagggttcaagtgattctcctgcctcagcctcccaagtagctgggattacaggcatccgtcaccatgcttggctaatttttgtatttctagtagagacttggtttcaccatgctggccaggctgatctcaaacccctaacctcaggtgatcggcccgcctcagactcacaaagtgctggaattagaggcatgagccactgcacccagccccaagtctgtaacatgttaaaaaagaattttcaacccattcctgtttgcttctctgttgcatttccaacccatgatttggattctagtagcctgaggttatccaggttgtcgtatcggtgggtgagaataactaaattatgtacattttgttaattatccagtactcataaggacaaattttttcctgttttctatctaaaggggactgaagctatattaatcagcactagaatagtctaaaaccccttgcactttaaaatatgtatgtggtatttaggcaaaaagctaacgtatttttttttaacaagcaaatttaatgataattttttcacactgaaaacactactaatgatgtggttgagataaagggaacaggacctcttggtttatagaaggtagtagaaatttggattatagctgtactaggctctgctatgatgattaaagttttttctgttgatacctcacacaattctagggcattaagttcagagaaaaggaggaaagggatatttcctttaactttcattagcgcctgagttatttctgagcttgaggtcttgctgtacggcagttcagtagttatcaaatcagttggtctcaggacccctgtgtactcataattattgagacccaaacaagccgggtgtggtggcttccatctgtaatcctgacactctgggaggctgaggcgggcagatcgcttgagcccaggagttcaagcccagcctggacaacgtggtgaaaccccatcactacagaaaaattagccaggtgtggtggctcacatctgtagtcccagccactcatgagaaggaccacttgagcctgggggtgaagaggttgcagtgagcccgatcatgccattgtactctagcctgggtgaccccatctcaaaaagaaaaaagagacccaatgggcttttttggatattgggttccatctactaatatttaccatattgtgtgcctgctttgacagcacatatactaaaactgggatgatacagagaagattagcaaaacaagaaaagaaaaaagaaaaagaatttaccatattataaattaaaactttttaaatattaatttatctgaaaagatcagtaataaactcattacatattagcataaatccatctttgtgaaaaagaactccttttacattgctgcaaagctttttcatgtctgggttagaagaattcggtggaattctcagatctgcttcagcacccggtctgttgccatatgttgttttggttgaagcacatgaagaaaatcgagcctcagacagataggcggttggaaaaaaagagaggagtgtattggtttacctcttcagataattgtggatagccttcttgacaagtggtggggttttttaaatatttaactgctaaataaaaatcgtatataattatggggtacactgtgatgctgtgatatgtgtatacaatacagaatgattaaaccgagctaattaacgtatctgtcacctcacatacctatcatttctttgtgagaacacttaaaatctacacttagcagtctttattattaactgtagtcacagtgctgtgcgatacatcagaacttatttctcccatgaaactgaaactttgtacactttggccagcctcctgcctttccccatccaaccccagccccagtctctggaacctccattctactcgctgcctttatgagtttcactgtttataatctacaagtgagctcatgcagtacttgtctttccgtgcttggcttatttcacttagcctgatgtcatctgtgacaacatggatgaacccagaggacaagtggtagtttcttgaaggttagccgcagtgtgtaatctgacaccatatcattgaacttttcggagcctacttacctagagtctattatgttagaatctgtccatctatcttgcatttttggttttttgtttgtttttaggtggagtctcgccctgttgcctaggctggagtgcagtggcgcaatctcagctcactgcaacctccacctcccgggttcaagagattctcctacctcagcctctcgaacagctgggattacaggcactcgccaccaagcccagctaatttttgtatttttagtagagacggggtttcactatgttggccaggatggtctcgaactgctgacctcaagtgatctgcccaccttggcctcccaaagtgctgggattacaggcatgagccaccgtgcccagccctatcttgtatttcgaatggatctttcacccatgcatgattttataataccatgcattagtcatctggaaaatattggctcactgactaatgcagatcttccaaataggaacacattttgttacacaataactaaaaagcatttcttaataacaccactaatctccccagagaaatctctaagtatggggaaattgtcaagctcatcgtggcagacacaaggtttccaaaattctaatttttgcttgaaaactcaaactttatcattgacaacaaatatgtcagttgttttccttgcagtgacaggctcagtttattcattttgaaaaaaaactgtctaccaaatacccaggtccaaataactacaatttttcagggttttaaaagcagctcaattgcacatgttttcctcaagaacatcatcataatttgcaacggaaaagttatatgtgcacctctcatttcatcacacagaatattaaaaagacacatactcaagagctgagatttgacaaaatgaataaatgtatggcattatcaaagaccttcttaagtgacactggccttctcccctggagtaggaggttgtcacagtttgccactgccttgttgatgtgaattaaggcaccagaatttgccacggtgctgacattgatggggaaaagcaatggtgggtaaaaagcaaatgacgccttagtgttggcacaaaaagtttccacctgtagactccctgaaaaggtttcatggaccctcaggagtcctctggccagttttcaaactgctagtatagcgtgtcagcatatgtcactgttgtcaagcattactgtcatccacagatctttaggaacacagcgacaggaactgctgagtttggtaggatttaggaccataaccccttcccctgctctggttccaatcttaacatgcaaaccattccctagaggtaaagtttgcgtaattgcccacttctcagcagaaaaatcattaaccattaccatttttcttctaaatttttttttttttttgagactgggtttcgctatcacccaggcccacttctcagcaggaaaatagtcaaccattaccatttttctcttaaacttttttgttgagacaggctctctcactctgtcactcaggctggagtgcagtgatgtgatcacagctcactgcagcctccacctcccaggcaatcctcccgcctcaggctcctgagtagctgggactataggcgcgtgccaccgtgtccggctaattttctttttaatttttgctgtttaaaaagaaaatagaaataccaagtagtcattacgctttgcaacacatacaggggtgtgtgtcggggaggtgagggggacatttcctccagatatgtagaattagatacctgcatatccctttaaaaagcactgtatgagtccattctctcattgctataaatacctgagactgggtaatttataaaggaaagaggtttaattggctcacagttctgcaggctgtacaggaagcatgatgctggtatccgctcggcttctctggaggcttcagtaaaattataatcatggcagaaggtgaaggggccgcacatacctcacgtggcgggagcaggagcaagaaggaggggaggcactgcatgcttttgaacaaccagctctcatgaaaattcactgactatcacgaggacagcactgaggggattgtgctaaaccattcatgagaaaccgcccccatgatccaatcacctcctaccagccccacatccaacactggagattacaattgggcatgagatttgggtggggacacagatccaaaccatatcaagcacaaccaacatgacaaaagttggtacacactaatttttcaccatattacttgcaacttaaaaatgcagtcttggccaggcacggtggttcacacctgtaatcccagcactttgggaggccaaggtgagaggatcacttgagatcaggagttcaagaccagcctggacaacatggtgaaactccatctctgctaaacatacacaacttagccaggtgtggtggtaggtgcctgcaatcccagctactcaggaggctgaggcaggagaatcgtttgaacctgggaggtggaggttgcagtgagccaagatcacaccactgcactccaacctcggcaacagaatgagactccgtctcaaataaaataaaataaaataaaataatcattccttccctcaggtctaacttagtacagacactggctacttgctcttcgggtgaagggaaatttgagcacatttagtgacaagaacattcctttaactcatatcccatatgaatgactacgtctttcggtcaagaggcatccgaagatgtacactctatttctttattatgtagtctctgatcataaaaaggaaaaaaagaaaaaaaaatcctggtcctctctcacatacctgatttttcccctttctttctgttttttaaagagacgggggtctcactatgttgccttgggttaaaactcctgggttccagccatcctcctgcctcaccctcccacgtagctgggactacagacatggaccactgcacccagccctctattacatttcattttaaagtaaactattattttacagtacttgactcataattgatttcatgacccatgagtgggtcacagtttacagttttaaaaacactggtttagattttcattccctaaagcctggtttctcagcttccaattatagcaaatgcctttgtgttgcagctactagggctgcttgttaaatcgatgtctcttccctttcaccctttgagaagacaccggcccctcctagcaatgtctccgtgcttttcccgggtgccccagcccttcatgctgactccgcttgttctcacacaccagttttcccaaagcagggggcatgaggaccacggtgggatgcaagatgctttcaggcggtacaaggatgaacgttttcatagcgacatttttgtatatcatggaaaaatatatctgaaacagcaaaacctatgatttcatggaattgttgcctaagggaagacttgggggtttaagtcaatttaaataactgtgtaggttgtatggggatatgatagaatgacacctgtccaaagtttgggaggcatagctgatgaatcaaaaatctctgtcattcttcctcagcatgatccacaccacccacccctcctctccgccaaatgacactggaagctactctagttacacaccaaaggtacttttttggacagccttgtaatagctgaagtttaacagattgattgcagcattccccctttattacctcacacaggcccattcaatccctgttccctgacattcccaatctctttcctatttacttcctaatccacaaagtcgaaactgttcttatctctgcagtacctctgacctgctcgcttaatttttacattcattgtaaagacgtcttcaatgtccccgctgactccaggctctcctgcagccaaccctctctactgtatgcagatattaggatttttttatattgccaaaaacgatttgagattatctacattcacttcttacatgcaatcctaagaaatccaattccattcctttcactcccagtggtctccaatctttctttcacttctctacaagaatgttctactctcagataaagaccatcagcacatcctgaccttcaggctcttcctctgccacagccgccacccgaatgtccacctttccttgctcccttcaaaatctgcctctgcacatctctgtaggaagccttcctctcaaaggtttccttagcatttgtgcccacaatgcagtcgctatagctttttattatttaaattactttgtaattttttacagtgtgacatatgcagaaatctgatttccccaattataactgtcacctaattagaatataaccttctgagggccgggcctgtatctcattgaatacccaaatgttacctaggctgtttctggctgcaaagcagcagagaattccaactcaaactggcttgaaggataaggacatctattgtatcatccatacaggtacagaagcaggccaggccccaggcaaggtgagatacagccctgctcaatgctgtcacctaggacccacgttcttctctctctctgcaatggcttcatctgaaggctgtttctcaatagcagtcagggctgcatgcttgcttgtggcaagaacaggggatggacggggctgtgcacacatgcatgtgcggtctggctctctccaaccctgagtcctccctggtagcccagggtagctcgagagagcttgtcactatcatgaaagcatatatactgcaacagcatttgggttattctaggaaggaaggtagaggaagaggaatggatgccaagtaggcagccatgagtacccgctccagctggctccagtgtgcacacgtcaaatggtggataccactactgaggttgtgcacgtgagctgaaagcagcagatatccatctatccatgtgtaatatgacataggtaatctgtaatattacatatatgtgtaacatatagtacatattttatatgtatgagccaaggaataactaaaatgatacattttgataagaatcagagttatgtataatacactgaacacatagctaaaattatacagtatcggggaattgcaaaataatttaagaggcagtagatgatgtgattacttatgcagaaaaatcctaagaaatctacaaaattaccactagaacttacgagtgaatttagcaaggtcacaggatacaaggttaatgtatgaaaatccactgtatttttatatgctaacagcaaacaattgggaaatgaaattttataagcaatttcatttatgagagcatcaaaaaataaatacttaggaataaatttaacaaaagatatgtaagacctccatggtgaaaactacaaaagattgctgagagaaatcaaagggctaaacaaatggaaagatatgccatgatcatggattggaacacttaatactgttgtcatttcttcccaaattgatctgtagatcaaatgccgtcccagccaagattccagtaggttttatttttaattctggaatgtatatagaaacataaggaacttaaaggactcacagccattttttaaatgaagaacaaagttggagaatgtccactacctgattttaaggcctattatagagctacagtaatcaaaacagtgtggtcatgatgaaagtatagatataaatcaatgaacaaaatagagaatccagaaatagatccccatatatggtcaattgattttaaataaaggtaccaagggaatccagtgaggcagcaaaatcttttcaacaagcaatgtggaacaattggatttcagtatggaaaatatgaacctcaacccttgccacatatcataatttaaaaattaaatcaaaatggatcctaggcctagtaaaaggaaaatgtaaaacttctagaaggaaacatttaagacaatcctcacaaccttggaagaagaggaggcaaagatttcttagctaggacagaaaaagcatgagtcataatataataaataggatcttatcaaaattaaaaacttgctctttgaaagacatgactaggaatatgaaaaggcaagccacagaaggagagaaaatattcactattcacagtacatgtgtctgacaaaggacttacatcctaaatgcatttttttaaaacccattgtattatctagttgtgtaacagattaccacaaacttagtggctgaaatcatgcattgattatctcatagcttctgtaggtcagaagttcaggtacagcttagttgagtcctctgcctcaggctcttttgtgaagcttgcaatcaagatgttggccaggaccagggtctcatccgaaggctcagctggggaaggatccctttccaagctcatgtggttagtggcagtgtttagttccttgcaagcggttagactgagagccttagttcattgacatgggcctctcccgcatggcagcttgcttcaccaaagccagcaagatagtgatctgctagaaagacaagccacagtcttatgtatatagacagaagcttaataatggaagtggtgtcccatcacctgtgctgaatactgttggctagaagtaagtcactaggtcctgctcacactcaagaagagggatacacaagtacatgaatgccaggaggtggggatcatgcattgggggccatctcagagtctgcttgccatattcatacaactcaataagaacaaaaactctaataaataaatagacaaaagatgtgtacagtcacttcacaaaagaaaacacattaattaccaataaacacaaaaagatattgtcctcaaggaaatgcaaattaaactcacagcaagaaacctatacacccactagaatgactaaaatgataaaaaatgttaagagaccataccaagcattgatgaggacatgaagcaactggaactctcaaccactttgggcagaaatgtaaaatggtacagccagtctgtgaaatgggtggtttctcatattaaacacacacctaccaaatgactcagccattctactccttggtatttgcccaagagaaatgaaagcatgttcctacaaagacttgaccacacatgttcacagctttattcccaatggtcaaaaagtgaaaatatcccacatgtccatcaactggtgaatgaatagacaaaatggggtctatccatagaatgggatgctacttagcaatagaaatgaacaaactactggtatactgagcgacatgaatgaatggcaaaataattatgctaagtgaaataatccaggagcaaaagcacatatactgtatgattccatatacacaaaattctaggaaatatttatagtgacatagtgataaaaagtagatcagtggttgccttgaagaaggggtgaaccacaaaggagcatgagcaaacttttggagtgataaaaaaattttctctatattttatttttttaattttctctttaacatttatttactttttaaattttatttttccataagttattggcatacaggtggtatttggttacatgaacttacatgagtaagttatttagtggagatttgtaagatcctggtgcatccatcacccgagcagtatactctgcaccatgtttgtagtcttttatcccttgccccgcttccgctcttccctccaagtccccacagtctattgtatcattcttatgcctttgcgtcctcatagcttagctcccacatatcagtgagaacacacaatgtttcgttttccattcctgaattacttcacttggaataatagtctctagtcttatccaggtcattgcaaatgctgttaatttattgctttttatgactgaatagtattccatcgtataattgtactgatgatttcatcctagctcatcaaattgtacacttggaatagaaatcgtttattgttggtaaattacacacaacaaaaagggacactacaaatcattctttaaaggatttgcattatgaggtatgaaggtcctgcttctccatttccttggctctgtgtctgcagttcactctaatccaccataagtggctatgtaacactgtggatagtaaatgaagaccactgaagtctccagaatgtagaagatgtggtggaggcattagtgggtccctttaatttcagctggaatattgtacttccttttgatcacgttatgtagagcagaactgaagtggaagtagtctgtctcaatcatgtttgtaatttttcaccaatttaggaatagagcttccacccaatatgggatttaaaggggctgaaaaacagttaacagtgatctgttctagaaagggttaatgaataggtcagttgcaggggagggagcagagaatagaaaacagagactgccttgtgacactatatcattctgtacattgcattctaatataaatacaacatatttcaaagtttgtgacttggctgcattaagaattgaaaggttagatgaacttggtgagcattacttatttttttatttgcaatgtattataagacaatactaagagttatcaacctataagagaatataaatattccgctcccaataactcatgttaaacacaaagctaataataaaatattttgattggcaaaaaaatggatttatttgtgaaaggcaagagatgtatgcatttcagactgtaacgaatgaatttgaagggtagcaaggcaatcatgctgattctccatgttccttgagctccttcttcatatcttctatgccaatttctagtcatgctagcacatgttcgttcaacagatattttattaaccaactaccctggttctgggcacatagcccatattaagtaagtatttgctgaatgaatgactgtcttcaaaagcttaccattgtctcctattttggaaattcgaagataatttaacatagagaatccaaaggactttttgggttaatcaattttcttcaccttttgtttaacaatacttcctttgaaacaggttttcagctgacttgagctggacaaattggttgctactctctctgaaaagatactgtggaataaattatctttaaagaaatcatgaatgttagggaggaactaatatttatagcatctgaaattgttattcagaaagctgtcaaaatgaacaaaaccttctctccaaatatattgattaaaagcaatcagcagaattaatacacttctttttggggagtggggtggtctcagtttgttgcccgggttggagggcagtggtgtgatcacagctcactgcagccttgaactcgtggagtcaagcagtcctcccacctcagcctcctgtgtagctagctgggactacaggcatgagccactatgcccagctaccttttgttttgtttgtttgttgtttgtttgtttgagatggagtctcgctctgtcgcccaggctggagtgcagtggcgcgatcttggctcactgcaagctctgcttcccatgttcacaccattctcctgcctcagcctcctgagtagctgggactacaggtgcctgccaccatgcctggctaattttttttttttctgtatttttagcagagacagtgtttcaccgtgttagccaggatggtctcgatctcctgacctcgtgatccacccgcctcggcctcccaaagtgctgggattataggtgtgagccaccacgcctggcccctttttttttttttttttttttttaaagatggggtctccctatgttgcccaggctggtctcaaactcctgggctcaagtgatcctcccacctcaacctcccaacatgctaggattacagaccgagctactgcatgtggccaagaattaatactcatagtgttgaatatatatttgagatttttttcaaatttctacactacttttaaaaatcaattgtcttcccttaacagaaactaaaattggccaggtgacgtcactcatgcctataatcccagtgctttgggaggctgaggcaagaggatcacttgagcactggagtttcagaccagcctgggcaacattagccaggtatggtggcacgtgctggcactcccaggtacttgggaggctgagatgggaaaatcacttgagcccaggagttcaaggttacagtgagctatgattgtgccactgcaccagcctaggtgacagagcaagacccagtctcttaaaaaagaaagaaagggccggttctggtggctcctgcctgtcatcccagcactttgggaggctgaggtgggtggatcacttgaggtcaagagtttcagaccagcctggccaacatggtgaaaccttgtctctactaaaatacaaaaaatttgctgggtgtggtggtgtgcgcctgtagtcccagctacttgggaggctgaggcaggggaatcacttgaaccagggaggtggagattgcagtgagccgagatcgtgccactgcactccagcctggcaacagagcgagactccatctcaaaaaaaaaaaaaaaaaaaggaaaaaagaagggaacaaaaaagctgaaattgtagggtggtggcaagagctggcaaagctctcagccagtatccatgccaggatctcatactgccagcgaactttggtcctcagatagaatctattacaataaaaactaccctgccatcatttcttggcacagtcactttttttccttcaaaatgttaattccaacactaaagggaaagtgactataatgatttccaaacagcaatgaggtccaagggaagcatgagtaaattgagtgaaataacttctaaacccatttatgctactaaaatcaactgtttccctaccaagttttaatggatgtctgaatgaacaattcatttcactcaaatattttttgaatgcctactatgtgtcacacacaggcaatacaaggatgatgagtcattcgttcccttcagagagcaatgtgggactcagaggaaacagaaaagtaaatcccaagccagtgtgttaaatgccatatggaagcatgtgggttcagagaagtaattaaccaggcaagttgtgagaaaaggtcgtgaatcggggaaggaaggaaggaaggaaggcggtgggggaaggaggaaaagcagactgaaagaaaagaatcgggaaaggctttcagagaaagattgatctgaatctttaaaaatagtaagaactggccaaggaaaggaggaagaaacaaggaggccagaatgctcagaaacccttacagcagggagtgtatggtctattccaggacaatgccttaaggtttaggtgtggggtacacagagggacatggcaagagaaggtgaataaatgatcaggcccttccccccagctcaggagtttgccaagaaaatcctaaagattgccgagagccactgaatggttctaagttagtgaataataagtctgttttgtttttgtttttgttgagacagagtctcactctgtcactcaggcaagagtgcagtggcaggatctcagtttactgcaacctccgcctcccaggttcaaacaattcttgtgtctcagcctcccaagtagctggaattacaggtgcatgccccatacccggctaatttttgtttttttcatagagacattgtttcaccatgttgcccaggctggtcttgaactcctgacctcaggtgatccacctgcctcgtcctcccaaagtgctgggattacacatgtgagccactgtgcctggccaagactacatttttaaaatgtcactcttatcagtcagggttcttcagagagacagagccaataggtgatagatagatgatagaaacggatggaggtaggtagatagataatagatgattgattgattgattgattgactgactgatagatggatgagaggggatttattgggggaattgcctcatgggattatggaggctgagaagtcccacaacaggccatctccaagctggagtccctgggatgcaggtaatggtagcgtggctcagtccaagtctgaaagcctcagaactagagaagccagtggcgtaattctcagtccaaggccaaaggcctgaaaaccagagggctgctgctgttaagtcccagtgtcaaggcaggagagcctggagttctgatgcccaagagcaggaagaggaaagtgtcccagctccaggagaaagagcaaggaaatcctctgtcacctttattgttctctccaggcccccagctaattagatggcgcccgcccacactggaggcagatcttccccactcagtccactgacccacatgccagtctctggaaactcctgcacggacacacccagaaataatgctttaccggttgtctaggtgttccttaatccagtcaagatgactggattcaaatttaaccatcataggcactctggctacacggaaggaaatagactggaaagcgggcaagactggaggagctcaagctgcccggctggccaaccctgagaaaatggaagcctgaaacaggggaggtgtagcagggatggagacaagtgggttgtctcaaaagaaaccaagacggcaagacccagaggactggggcacagttttagatgaagtgcatctgcgttggtgtagaaaactccagtggagatgatggcagtgtggagctcaggagagggctgggctgggactgagacctggacatgtcaggcacagtggtgggttggagctgcctggagaatgcccagtgggaacgggagcagagtgcatgtgcagctcctgtccagcatccagggggtttcacgtcgttctttactctttggaggacgcccttgcagagcagagtggagctcaaggaagacagcaggatgcacagaaactaagagttctgtatgctaaattattcaggagctccttacccagtatttgaggttgatttatttcttgcaggagctatttaagacttcttttaagaggcagagcaaactcatatccgacctctgtgcgtaaaggagtgcttttttggcaattgttttatgattaagttttcaggctgaagttttcccttctgatagtcattcaaaatacagtgttttgctgcacctgggcacaattatgtaagacacaacttaataatttagcttttttttttgagacagagtctcactctgtcgccaagctggagtgcagtggtgcaatcttggctcactccaagttccgcctcctgggttcaagcgattctcctgcctcagcctcccgagtagctgggactacaggtgtgcgcaaccatgcccggctaatttttgtatttttagtagagacggggttttcaccatgttggccaggatggtctcgatctcctgaccttgtgatccgcccgcctcggcctcccaaagtgctgggattacaggcatgagccaccatgccgggataataatttagcattttttaccaaccaagaagtcacacttgtgatggctccatgtttctcaggcattctctccataaagtccaacttgggtccctctgttccctcccaccacactagagtccagtaacctcagactggctgatgtgatataaatggaaatgttccctgtggtggaactgtgccaggctgttagcagaacccagttcctccctgccatggttggcccattttgttctccctggggagatcggtctggattatcaggagggtttgggtggtggatttggtctgtttttgctacatcaaacatccctgatgctgatggactgagagaggagtcggtgtcacaagtgcacgccccttccctttgcttgcatgacattgcccacgcccttcccctcccttcgcctcttctcccggctttccctgcctgcctgaaacagctaaaattaagtctggcataagtctgttgagactttaagaaaacattgccataaaagggcaacgacgaccaccagcttcaagttctgtgtgctgacaaattcgtctgtcttttgaccctgtgcacattaatgtacatacctaaactgtaaaagccctcaaattcctgaaattgacttagtgtgttataaaaaaaaaaaaaaaacctcatgactttttctgttgttccatgagtagcctcctttctaaggaagaaaacataagatttcttactaagtaaaaaacctgtagaaataaattcaatcccactagcatattacataaaaacatttttattttaggctactcctgtacacccattcattatcaagtggagttgcataaaacattaattgttagaatttctactctctaccaacttctgtagtgatggtttataggtcttttcagtctgtgaaccacttttgcggtcctcctgacgtacatactgccatttgttgcccatttctgcctcccaaaaaacaacccctcacgattacaggtgaaattgatggtgcttatcataaacaccggtaagaatttttttaaattattgcaagagacaaaagcatagacttagaacgagagatacttcctgtgtaccttggctcactccaagtttttttaaaaaactttttttaaaaattaaactttttattttgagataattgtatattcacatatagttgtaagaaataatgcagagagatcctgtgcaccctttacctagttccccgcagtggtaacatcttgcaaaactaaacagtacaggagaaacttgaatcctcatacattgctggtaaaaatgtaaaatggtgcagccaccttgaaaacagttcagcaggtcctcaaaatattaaatgtagagaggccaggtgtggtggctcatgcctgtaatcccagcactttgggaggctgaggcgggtggatcacctgaggtcaggagttcgagaccaacctggccaacatggtgaaaccccatctctactaaaaatatgaaaattagccgagcatggttgtgcgcacctgtagtcccagctactcgggaggctgaggcaggagaatcacttgaacccaggaggcagaggttgcagtgagctgaaatcgcgctactgcactccagcctgggtgacagagtgagactccatttcaaaactaaatttaaaatatatatatattaaacatagggttaccctgtggcccagcaattccactcctgtatatatgaaatgaaacacatgtccacacaaacacttgcacaggaatgtccataggagcattttcaccacagccaaaaagtggaaaccacctgagtgcccatcagctgacgaaaggataaacaaggtgtgtgtgtccacacaacagagtatcgttcagcagtcaacagaaatgaagtgctgatccgtgttacaatgtgaatgggccctgacattaagcggaagctagtcacaaaagaccacctattgtatgatcccattgatgagaaatacccagcatcggcaaatccatagagacaggaaatagttgcctagggatgggtgtgagggttgagcaggtaatgggacgtgactgctaatgggtacaagctgtctctttgggatgatgaaaatgtaaacttagatagttgcacaattctgaatattccaaaaatcactgggctgcacactttaaatgggtgagttattttatggtatgtgaattatatttcagtaaagatttttttggctgggcgcggtggctcatgcctgtaatcccagcactttgggagtctgaggcgggtggatcacgaggtcaggagatcgagaccatcttggctaacacggtgaaacccagtctctactaaaaaaaatacaaaaaattagcctgtagtcctagctactccggaggctaaggcaggagaatggcgtgaacccgggaggtggagctggcagtgagctgagatggcaccactgcactccagcctgggggacaaagcgagactccgtctcaaaaaaaaaaaaaaaaaaatttattgtcatttcctccacagaattaaatcagcttggcctgactcatagggaaaaatacagggtgatatcacaagcaggatattgacattgatacagtcaagatgtagaacagttcggtcaccacaaggatctcttacattatcctcttatagccataggcacctctggccccctaccccagcccctgatccccggcatccactaatctgttctccatttcgaccattttatttcaagactataatataaatggaatcatacagtatatgacgttttaggactggctttttccccctcagcataattccctggagatctatccaagttgttgtatgtgtcagtagttccttcctttttcttgctgagtagtattttacggtatagatggacctaccacagcccgcttcaccattcatccattgaacgacatctgttatttcgtttgcactgttgcaaaaaagctgctatgaatattcatgtacaagtttttgtgtaaatgtaagttttcatttccctgggataaatgcccaagagtgtaactgatgtgttacatggtagttgcatgtttagttttataaaaaactgccaaattgtttttaagagtggtggttcctgaccaggcacagtggctcacgcctgtaatcccagcactttgggaggccaaggcaggcagatcacctgaggtcgggagttcaagaccagcctgaccaatatggtgaaacctcatctctactaaaaatacaaaaattagctgacctgtggtagcatgtgcctgtaatcctagctactcaggaggctgagacaggaaaattgcctgaacctgggaggtagaggttgcagtgagttgagataggtccactgcgctccagcctgggccacagagggagaccctgtctcaaaaaaaaaagaaaaaaaaaaaaaaaaacagtggttccattttgcattcccaccagcagtgtagaagtaatcctgtctgtctctctacatccttaccagcatttgatgttgttactattgtgattttagccattttaacagttgtgtagtagtatctcattgtggttttaattcgcatttatataatggctaatgactttgaacatcttttcatgcactaatttgccatctgtatatctttcttggtgaaacagctctgtgtcatttgcctatgttctaattggattattttctccattttctgtttaatattggtagtgtttatgtattccagacatttttattttattttatttttgctattccttggagagcagggctaaccctataggcagtgtgctagtaatttgttggctatgtgatttgcaagtattttctcctactgtgtagcttttcttttcatcctcttaacagggtctttcgcagagcaaaaattcttaattttaatgaggtccatttatgtttttccttttatggactgtgtttttggtgtcaagtctaacttttgccttgccccagttcccaaatattttctccaaaaagtttcatagttttaagttcacgatccaatgtgagctaatttttgtgtaaaacgcaaggcttaggttggggtttgtttttgtctttttaccttttgatatccaattactccagttctattgcttttacacctccatcaaaaattggtttgccatgtttgcatgggtctatttctgggttttctatttatttctattgattattatatccattcttctgccaataccattgtcttgattgctgtatctatatagtttgctttaatattaagcgacttcaagattaaagaattctactgtagtcccagctacttgggaggctgaggcaggagaatggcgtgaacccaggaagcagagcttgcagtgagccgaggttgcgccactgcactccagcctgggtgacagagcgagactccgtctcaaaaaaataataaataaataaatagaattctagagcttgcacctttccatataaattttagaataagcttatttatgtctttaaaaaaaaccctaatttggtagcaattgcattaaaccaaaagattaatctgggggagaattgtcatttttactatgttggggcttccagctcaggactgtctctccatttattagctcgtctttcatctacagtttgtgattttcagcatacagctactatacatggtttcttgagtttatgcctaagtattaattttctttgaagtgattgtattaagtgatattgttttatatatttttccatgtgttcattgttagtttatagaaatgtgattgatttttgtgtgttgatcttgtatgctatgaccttaccaaactcactaattccaggtgagttttttctttcttttgtagattctttgatattttgtatgtagataacatgttatctacacaggtgtttttcttcctttccaatctgtatgcgttttctttccttttcttgccttattgcagggcctagtacttctagaaccatgttgaataggattagtgagagcagacaccctggcctggtttctgaacttcatagggaaaacagtctttcactatgaagtatggtatctgctgtagctttttaccatgaaacatcttagttttgttttctttttctctccccaccccttttctttttttaagaggtttaagacttagggattggcgcaagtaagatgacaaagctaaacgagaggcattttcaggacttcctctttcaggcccggcttgcaagagcgctagggccaagctcctttcagccctaatcggtactggagctaatcgcattcgcggcgcccgtgcactctgcagggatgggccgtggggccagggacctcagtcccctctcggcctgtcctgcccttccaggaggctagcggctgctggccgcgcagcctgccaacctgagttggccatagtagagtctcagatacccagctcctgagcggccagggccagattcagggtgtgtacgtttttggcagcggctccccaaccgagaagacactcggctgcgaagagaggacgcgaattaagagttccatgctggaaaaaaaaaaatggatagcgacaaagtgcatctacaatacgtgtagcccacggaacgatttttgttaagggggccgaggatgggcagttacatctaaaatttggaaagggaagaggaaagcgagaaaggatcccctagctggcgccccggggcgttctgcagcctccagcccctctccccctccccgcgccgcggagcccacacctgcgcaggtggagcctgccgagcgcggccgccggtgctgggaaggtgagcggcgccggggggcggagtgggggcgggccgcgggcctctcccaatggcggcacggcggggaggacgcgggccacggccggaggggggcgccccgggcccaggcgctgccgccctcgagctcccgggtcccttcccacgcttcctcccgggcgggccgtaccaaggcgcgggggggagcggcgcgtcccactcgcggaggggcacgcgggccgcgcgcatcccctgcggcggcggcggcggcctcgggcgggtgggggcagcgctcccgctccgcccccggcccccgctgcccgcgtcccctgccaggcccctcctcccggcggcgcggcagagccaggccccagcgctcggccggccgcgagcccgccggccggggacgagcgtcgcagctcatgctgatcgctgtcctcctcctccccctcaggcggcgctggcggcggccctgggacccgcggaagccggcatgctggagaagctggagttcgaggacgaaggtgagtgcgccccgcccgctgccggcccggcgctcccacggcccggccgcccgaggaccgggacccgcggggaccccgcgccccatctccggcgctgccccacggcgagctgcgtcctgcggaagcccaggggccggggcgggaaccggggcggggatgcgggcgccggcgagctcgggctgcggggtaccgggcgtccgcggaggggacgcgagccaggctcccagagcgcagccctgagcccggcatccacacggacgggcggcccttttgtccttactcgccgaactcgaattacagcaaggtgtcagggagcgctaattgtttgtgcttgtcaccatgcactcggaggcaaccccgaatcatacccacagtccagaccctttaatcatagactggtgcccttatctgcgcctgtgaagatatgaccggtagggtgtgtcttcttttttaatggggaaagttaaataggaaaacctgaagaggttattgaatcggtgttgagttcaggcgaccctctcactccgtcatttctgtcgcctctcctctcacttggttgttttttttccctctcctgtcttcttcttgtatcttacaggtaaataacttggatcttatttggaggctgttaacatttgaaaggcatgagctcgttctttggcaaaattaatatttaaaatggaatgtgacgagctttcaccaggatcttattttgaagctgttaacatttgaacgggatgagcttgctcttacgcaaaattaatatgtaaaatgaaatgtgatgagctcagagtcgggaaagaactttatataagatgcttgacaattcgaggacttgaaaaggcgttcacactgtcttgtgtgcttccattatttatttagcaacttctcttttttccaggagtattgatagaataaagctctcgaaacaaagaatgtgccatgtggatgctgtcccttgtgccaactttactttaatacctctgttcattcacagtcaggcaattacttaaataagcctgcacagccagcatggacgtgttaacccaatagaattagccgggtgcctgttatctttgagattcactgcagcatttcacaaacatgttagctggaagagaacgcgttcatagtcattgtcattaaaagtgtttgtctgtatttattggtaacaaatggtgcatttcagaattttaccggacttaatttgcatttcatcctacagaaaaataatccagggtcttcattcgaacccatctcactattcctcagttttattatattgcaggccaaatcttggccgctgtccacagggtggaatggtgtgcccgttccataagactttgaatgtctaaatcaccagggttttgtctcttatattagtaagaatgagagtcttttacagttacaatttttgcaaattagcagggaggcaagaagaactagagagcagcttctgttcgagaggaatcgctactacttatttagctgtgtgaccttggacaagttacttaacctctctgtgccttggttttctcatttctaaaatagagctaatatcaggtgttttgaggattaaatgagccaatccgtatcatggcatttaaaaacagtgtaaacccatagtgagtacttcataaatgttagttactattatcgcttaagtgccattaagcattgtactgaattcatgagctttttaagatttttattaatgaaacccaacacagagattcttctcaacacagatttggtgtcctgtcccttttcttcttcttacttgagatttattaatttaattatgcatttctctaagcagatatacactcttttttttcttttcattgtgtctgccaatgtaatgaatgtaaagtattaaacctaagtgtctaagagaggaatttcccctcttcacccatctatttttatctatattgctgtcattcctttaaagcacaccgaatcccacgaataaccctgtcaaacttttctagattcttaaggaggcagaatgttaaacagtgactttgaggctgagctgagctggaagaaagaacagtgttggcgtggtagtccaaatgcagctttgtttcttttgaactttaaattgcttattcatccaaaatacaggaaaattgaatatcaagcagaatctcacacttatttagcagggacaaaagtcccagcagtaagacattacacctctaaatatcctacataatagggagcccttgacgagatcctcatttcatctttcagcatccagcataccctgttaacgtcttcatgtatgcattgatgtctagaggcattgcttcaaccgagatatattcgctgtacgtggaaacacatgattactcatattttcattaccaagatttttctatttcctaataagttataactgatactatatttgttagaaacatcttggaagcactggtgaggttaggaagaaagattgagttctaccctgcctagttgggtcgtctttggcctgggttatgacaggagctgccatcccttttctgctgtcaacccttcttaccacgacaagagggacatggtacgggtgggtttgatggcctcactcctctatgggaaggtcttgaccacgttcctctgtccgtatatccgacaggtgcagacttctcttactccgcaggctcagtgcccctccctctctgtgcataagaatagccacagatctttttgaaaggcagattccagttctctaggtctggggtgggacttgcctagcacaggggccgctcctgctgccggttcacagacccctcttggaataacaggacatgggccggccaactttttctgtaaagggtcagatagtaaatattttagcctttgcgggtgttatggtctcagtttctgtcacaaccactcaatttgcccttgtagcaagaaagcagaaagcagctaacacaatccaaggggcggggctcggctccagtaaaacttctttaccaaaacccagatttggccctcaggcatagtgtgccagccccctgctctgtgtctccctcactgtgcctgtgccttagggggtggcacgtgatgagggctgcatgctttccatgccacaccgatcttagtaagacttcaaggctcagctcaagtctcatctggtctccgaggccttctctgaataccctctgtacttctctggcattcacctttctctcccccgtgcctgctaccacagctggcacatagcaagttctcagcagtgctttggatctcaatgatttcattaagtgtttgtagttactttgtgggcatattgggggaggaaatgattttgtgtatgagaagccttgcccatagcaatttttccctccctccctccctcagggtctcactcttacctggggtgaagtacagtgatgcgatctcagctcactgcagcctcaacctcctgggctcaagtggtgcttccgcctcccaagtagctgggactacaggcgcatgccaccatgcctggctaatttttgtactttagtagagatggggtttcactatgatggccaagctggtctcaaactcctgggctcaagtgatctgccggctgcagtctccctaactactgggacctacaggcatgaaccacggtgcccagccagcaatccctttctgtgtttgctttttacatttgtaattgttacaccgaccacgtctttgctgtgtttgtgtttatctatattaactgccttgaactaacttactggccaggaccaagcacaaagtactttgtaagcacctaaacacaactcatgaatgctttttgaagtaggtaattattcagcagttttatccgtgattaataaacctgctctactctggtaccacttcatgaagtctgcagcctctttagagcggtccgcattctctcccagctgccggaggagctgggctctttcaagtttttgataacttgctgtggtgattttacccgcttcttagcagagagtgtcttgccagactgactgtctctcctcttcctcctcatttgccgcttatttcatcccagttcagccattctgtcctattcttcttcacttgcaaagattttccaaagtagaatccaggccgggcgtggcggctcaccattgtaatcccagcactttgggaggcagaggcaggaagattgcttaaggccaggagttcaagaccagcctgggaaacatggtgagaccccgtctttataaaaaattttaaaaattagctaggcatggtggtgcacgcctgtggttccggctacttgggaggctgaggtgggaggatcacctgagcgcatgtggttgcaccactgtacttcagcctggagtaatttcatgtctccaaaaaacaaaaacaaaatgacaacaacgaaatagaatcttctttccagaacgtgcctcaatcttgctttatttttctctctttttatttttgtctcgctctgttgcccaggctggagtgcagtggtacaatctcggttcacggcaacctctgcctcccaggctcaagtaattctcatgcctcagcctcctgagtagctaggattacaggcatgcaccaccatgcctggctaatttttgtatttttagtagagatggggtttcaccatggtgcccaggctggtctcgaactcctggcctcaagcgatctgcctgcctcggcctcccaaagtgctgggattataggtgtgagccactgcacccagccaatcttgcttgtttctagcaaaactggtcagcctcacctacagtgatcaaaataggtaaaagtaggggccacttttcgtaggagggaaagaaagcattgtctttcagtgaggcatctcgggattcaggcccagatctgtgatgaagggcctgtatttccttggacaacccgtgaggcctctccgggctttgttttgttgttattgctgtcgttaagagttttctctataaaaccagggggccggcacttggtgatcttttgctttttctctctcgcttaaaaatcagaccccaaagcaaccaataatcactctttacaaataaacaaaacaaaaatgtgtgttcactcaaaactcattcattctcaactggagtgagtaacaccctgagtaagtgaagatcggttcttgttgggagacaaaaaaattgcagctgttacagtggattttggccacccaaagggccacggcacatgaacaaatacacagtatatctgtgctattaaaatgtcgtgggggtaggacagttgggggagaatgtataaaaaagactcagggaggggagtataatgaaaagaaggcttagaagctgctggaacttgcttaagggagaattgcctccctgtgtatttgtggtcatctattgaattattcccttgtcccttgactctcacagccaagcgtcaacttgcaggtttcttgactctactgcggggcactgacctctgctggtggagatatcaaagtggcaggtgtgtgggcacagtctggtacttgtcgatcattacttagggcacgagaaggctcgggtgattatctgctttccaaactctacccttccctgctgagttcacacactcctcgtagataagagacttattgtttctggattatgagtagttacaattgtatgaaatccctgtaattaaagttgttcctctggagctggcgccatatgtaacatattgccctattctgtagggtctaggtacacatttcagtatctctgaagtcaggacgtgacttcacatttggtggtgtctccgacttggtgaggtagggttgttgtcttggagtagatagaggttttgtcaccggaagatccctgactagtttaagcagaggacaatgctgggaggattcgggggtattggtaagtgggactcgtcaccagtcttcgcaagtaactggaaccagctggaaagtcatcagggcccagggcattgagcacctctggccattgctctagggccatgtgacctcccatctcagaactttctctgcttcctggtggatgtgttgaagaatggcctcttggccctacagctgttcagctccaaccccacagccagctgtgctgagtccttacccatgcttcggacccctgtgatataactcacatcccatacgattcccctccctcctggagcactggatatgggcttctcgctgccctgtctgaggcctacatctcatcctgtgccttcagcctggaggtcgtgccctcctccacggctcagattcccctgacactgatctctctgtgcccatctccttccttccccttccttcttcggtttgttttctttctttttaaccagcctgattccataaatgcccgcatcctcccagctgttttaacaggaaagctgcttgactccaggtccaagagaacagctccttgctgctgcttccggcttgttcacctctctccctcactcccggccagtgtcatcttcctatggaccgttccagcagccaagctctcccagcacctgctctgccccctccaattaatttgccatgctgctgttggagatatttccttcaaacatatttctaatcccatcgctttcatttctaaagcctccggtacttttcctttgcctgtaggagtccgcacttcccggcacgccctccttgcccccttctcctccctccccagcctcacctggtgcctctttcctccctgcatttccctccagctactctggccttcatcagcttcctcaaactgccttgctcctccaggcctgccagactttacacagacagctcctgctccttgaatcattccttcctctcctttggccacctgctcgttttctccaagtctcaggttagatgtcgcttcctcagggaagccttcccagaagccccgatgaggacttcccatgctatctcatgatccctcacaattgataggtgctgttagggggacgcacttctttgtgtttcccagtagcccctcccatttatttgccattacattgtaagctctgtgaggatggagactgaaatcttaatatttgccaggtcttgaggccactgggatgagtgaaacttggttttcagtaaacatttgtcacacaaatgaacgtatgtattttggagcttatgcttttactgtggcacctaggcttgccatacttcaggtggtcaatgttatttcttacaaagacataaggcatttctatttgaggcattggagaaatgagaggaattgcatttgccatgttgatggtgcgctaatcaaagagcagtgagggcggagcaacggaggaagtgaaatgactgagtgaaccctggaggtgtgaaaggcttctccacccgacggtgggtgacatcagggcttgtgacgtttgcagttgaataactgaaggcagtagcaagtgggtagagtgggatggctcgcctgcggaatctggcatccgaggaaatcgccttgacaccttcctttcatggccgtgattacacttgtgctaaggttagggggaacagagccaggttcatctctgatatgaaaagggaagagcgattttgggggaagggaactagtctgggaaccttttggctaaattttagtcactttttaatctgtttaatatgctgccacggccgggtgctgtggctcaccccgtaatcccagcactttgggaggccaaggtggatggatcatttgagtccaggagttcgagatcggcctgggcaacatggcgaaaccctctctctataaaaataaataaataatacagaaaattagccagacatgggaggtgagtcccatgcctcctgagtccaggaggttgaggctgtgctgaaccatgagggcatcactgcattctagctggggcaacagagcaagaccttatctgaaaaaaaatatatatatatatgtacacacacacacacacacacacacacgctgccttctgtcccacttggagctgtttcccatgtatctgaatttatataacatcaatgaggtttctgaacatcatgctaactgattcattttattttaggttgtactttggtcatttgtaactgacaggaagttgctagcaataagttgttattttatgaatcattttccacattttcttggaagtggaatgtttcattgttccgtcaagacctcctccccagtacacacatgcgcattgtaagacgcttatttaccctctttccttggctctcagtcttcacgttgacttctctagctttgaagcttatacatacatacgatgtaacccccctttttttaatgcatgtgtaattagagccatagcaattaagagcatgagtcagattcaccttagagtctcatttcttctacttaataactgtgagaactttagtaagtttcttaaagctttggtttcttcatatgtaacttggaaataataatagtacctagccaggaggattatatgtggattaaataacatgggcatgatatccactagagcaggggtccccaaccccctagccacagaccactactgttaggaatcggcccacacggcaggtgagcagcaggcgagcgagcattacctcccgagctccgcctcctatcagatcaacagcagcattagattctcataggagcgcgaaccctattgtgaactgcacaagcaagggatctaggttgcacactctttatgagcttttttttttttttttttttttttttttgagacagagtcttgctctgttgcccaggctggagtgcagtggcgcaatctcggctcactgcaagctccacctcccaggttccagcgattctcctgcctcagcctctcaagtaactgggattacagacacttgccaccatgcccaaccaatttttgtatttttgtagagacggggttttaccatgttggccaggctggtctcaaactcctgacctcgtgatctgcctgcctcagcctcccaaagtgctgggattacaggcgtgagccaccgtgcccagccttccttatgagactctaactcatgccaaatgatctgaggtggaacaatttcatgctgaaaccatccccctgctcccccatccatggaaaaattgtcttccatgaaactggtccctcccaaaaaggttggggaccactgcattagagggcctgggatgtagtatggggaccgctgcattagagggcctgggatgtagtacagtctccatcagcagtaactgcgatgatgactaggaagacaagaagaaaccgagcaaaaatttaaagtgattccagcgattctgttcttctgcactgtcagactttgccccatgtggacacaggtatgtatgccacatatagttggcagcttttgcgattggatgtttgtgcttatccctgttcctgagaaatgctctcaggaaagatggtgtgtcaccattttacaaatgaagaaattcaggctcaagggtatcaatttgttcaagctcacaagaaaggcagtaacaattctgacctagggttggtctagatgcttctgtcttctccattgcctcccatttgaactgggagtaccttgagtagtccccattggtgaacactggcttgctacctgacatcttctattggtgacttattgtaatggctctgccaatggtttttttgtgttttgatttgcagtagtaattcttgtcagtgctgtcacacagtgtaaaaacaatggcacgccatagtagaaactgtcagaggacgcacaacagaaagatccattatattgcaaaaccccaaagaggtgcacacatttatggatgtatgtgtaatctctgcgaaactccagtgtttcattgtgagttaggatagccttttgtcagagtctcaaacttcaggacacttgcggggacttggatgaagtgcccatcttgaattcatcagaatgaattcaccaaattgctctgccactcttgtgactcagcggtttgctgaatatattcacttacctctcttccctcctaaagtctactgaaatgacatagatcagtgaaatcaactacaaaggtagtcatgcttaataaaaacaaaaacttagttcttggataagtcagtaaagtggataaacctttgtcaagtctgttcaggaaaaaatgggagaaaatgcaaagctttagaaagaagagaagcttcttaactataaatgcagagatctttaaaagtaacgttgatcaaagcacaccggccgggcatggtggttcacgcctgtaatcccagcacttcgggagactgaagtgggaggatcccttgagcccagcagttcaagaccagcctgggcaccatggcgaaaccccatctcaacaaaaaaaatacaaaaactatccgggtgtggtggtgcacgcctgtggtcccaactacttgggaggctgagataggaggattgcttgagcctgggaggtggaggtggcagagagccaggatcacaccactgcactccagcctgggcaacagagatggtacactttaaattggcgaacctgtgaatgtgaattatatctcaaactatttttgttggttttttgttttgttttgttttgttttgtgacagggtctcactctgtcacccaggttggtctgcaactcctaggctcaagccatccttccacatcagcctcccgaagtgctgagattacaggcgtgagctattgcacccagccccaacaaagctattttttaaataagataatgaaaggtcttattcctcttctgctacagaagagcataccattctattcagcctgtttatggatgaattctgtaaaacttttcaggaacagttaatgccttatttaaattattttagaacataggaaaatatggagcacttcccagctccttccgtaaggctagcttgatcttgaaatcaaagccagaggaagatagcacacaaagaagaaaacaagcgatcagtcttacatttaaaatgtggccaaagctcctaaacaaacactagctatgcaggattaaaagccgaatatattgtggtcaagtaaggtttatcttagaaatgcaagtattcttctgttgattaagaaatctaggctgggcaaggtagctcttgccggtaatcccaggcctttgggaggccaaggtgggcggctcaggtaatcccagccctttgggaagtcaagatgggtggatcgggtaatcccaggcctttgggaagccaaggtgggtgaatcacttgagcccaggagttcgagaccaacctgggcaacatgacaaaaccccatctttaatttttttaattaaaaaaaaattttttttaatctattaaggagctggatgtggtggctaacacctgtaatcccaacactttgggaggccaaggtggaaggatcacttgaagccaggagttcaagaccagcctggacaacatagcgagactcccatctctacaaacaataaaaaaaattagccaggtatggtagcggatgcctgtagtcccagccactcaggaggctgagacaggaggattgcttgagcctggccatttgaggttgcagtgagcagtgatcatgccactgcactctagcctgggcaacagagtgagaccttatctcaaaaaaaaaacaaaacaaaaaaacaaagccatctattgagaaatctagtcccagcttcttgggaggccacggtaggaggatctcttgagcccaggagtttgaggccagtctgggcaacataatgtgatcctatctctaaagaaagaaagaaagaatgagagagagaaagaaaaagaagaaattgcctaaggaattaatgttgttgataaaggagagaaactggtagtcatctcagtagatactgaaatagcaattaataaaattcaacatatgttcctttttaaaaatcgttaataaaccagggatatgaggaaacttctttaagtagctaaaagtatacctcatgacagccagcgggggcagcagctgtataattcctggtgcaggttgagtctcccaaatgcgtggaactggaaatgtttaggttttctgatttatttatttatttttatttttatttttattttttatttttgagacggagtctcgctctgtcacccaggctagagtacagtggcgcgatctcggctcactgcaacctctgcctcctggattcaagtgattctcctgcctcagcctcccgagtagctgggattacaggcatgcgccaccatgcccagctaatttttgtatttttagtagagatggggtttcgccatgttggccaggctggtcttgaactcctgacctcaggtgatcctcccacctcggcccctccaaagtgctaggatttcacaggcatgagccaccgcgtctagccggttttctgatttttttcagattttggaatatttgcatatacataatgagatatcttggggatgaggactcaattttaaacacgaaattcatgtttcatatataccttatatacatagtctgaagttattttatacaattttttaataactttgtgcatgaaacaaagtttgtacagattgaaccatcagaaagcaaaggtgccactgtctcagccacccttgtggacagtctggcatcaccatcgttcctgactctgtatttctatgctactgataaatacagtgaaaaaccgatgtgttcagggtaacttatggcattgtgttggcactcggaaagttttgcattttggagcatttgggattttacgtttttggattatggatgctccactgtacctgccaaggtgggtctcactcttctggcctggctggtgcttgctgcttcatccctgtgagctctccttggccatcaccgttctccagcttcatcactgggttttcttccctgagaaaggaatcattggctgtggtagatgctttaattatgtattaatagttcctagaattctatgcaaaaccattttaaaattctgacaggagccacatacaatttcaaggtcattgctttgtccgtgactttccttaggcatcgattgcaactcactttgaactaattgggcaaactctgccttgatcctgcctgtgctttttcttctttcctaataactcttttactgcccccttatttagaagagtgtgtgcattttctcgcccgtgtacacatttgcccccacacacaaaaccaaatgcaaaaagcatggaaaggggaaaaaaagtaacagacttcatttattctgccaccttataattgtaaatcctgtaaaattatgtttaagatttgcctttgtttctgttcatgtttctaggcactttagaaaaacttaggggtttttattttattttattttttgagacggaatctctctctgtcgtccaggctagagtgcaatggtgcgatctcagctcactgcaaaccccgcctcctaggttcaagcaattctcctgcctcagcctcccaagtagctgggattacaggtgcccaccaccatgcctggctgatttttgtatttttagtagagacggggtttcaccatgttgaccaggctggtttcaaactcccgacctcaaatgacccacctgcttcggcctcccaaagtgctgggattacaggcatgagccaccaccacacccggcctattttattttattttattttattttgagacggagtcttgctcttattgcccaggctagagtgcagtggcatgatctcggctgactgcagcctccgcctcctcggttcaagcgattctcctgcctcaggctcctgagtagctgggattacaggcacccaccaccatgcccggctaatttttgtacttttagtagagatggggtttcgccatgttggccaggctgatctcgaactcctgacctcaagtgatctgcctgcctcggcctcccaaagtgttggaattacaggcatgagccaccacgcccgaccttatttttttaaatagagatgaggttttactgtgttgcctaggctggtcttgaactcctgagctcaagcgattctcccatctttgcctctcaaagtactaggattacagccatgagccaccgcacccagccaacttatgagtttaattttttctcttccatatacttttgactgtcacattcctcttctttgcttatttcttactcagatattttttaacagttttctaaaaagagaaaacactatataaatatagtaaacttgtatttctaaatgcagaataaagtataaaagatacattttaacactgataattttttgtggaattataatgaaattcagcatattaagttaaaattgtgaataaggagtcagggtttttttcggtttggggagtttttaagtgaagtttgggacagtgtaaattttgttttaaaatgcatttcattcttatacacttagtctttaagacaagttttgaatctgttactatgacctgtgattaatgaatatggggttttttttctgttaacatgattattttaaaaaaactcaacaatgctattaacaacaataataaaagtattctaatattatgtaacatcaaagaatgtccttgcataagatgatgatattttttgtttcaaaattgtattatgaaaatttccaaacatatgaaatggtagagagaatggttcaatgcattccaaatagccaccatccaccttcaatgcatcaattcctgagacagccttgtttcatcaacaccctcacccacttccccacactcggattatttgcaggtgaatcccgggtctagtgacgccttggtgctacacgaagcaatgtgccctccctctctccctccctccctccccccctccctctttccctccctccctccttccctcgctccttcccttgctcttgttgccagactggagtgcaacagcgtgatcttggctcactgcaacctccgcctccaggttcaagtgattctcctacctcagcctccccaaatagcttggattacaggcacccaccaccaagcccggctaattttgtattcttttagtagagacagggtttctccatgttggtcaggctggtcttgtactcttgacctcaggcgatctgccaacctcggcctcccaaagtgctgggatttgaggcgtgagcccccgcgcccggcctagtagtgtgcgtttctaaaggcccttggcgatctggtcctgagtaactttcctgtcgcatctccagccatatcccatgagtgctagactccagctgtttcaggctaagatacggctacatcatttttcaaacatgccatgttctttgggacctctgtctttgtatatgctattacgtcttcctagaatgtttcttcttctcttctctctcaaacacttcttctttcaggatccagctcacatccccttggccgtgaaggctcctctggctcctcctgtgtatgttcctttagcactttgcagtacttcacccacagtgcttatcacactgcacagtccaaacactcctgcagggcggggaccagcctgccacggggcagtgtttggtgtgtctcctgggtcctgcagaagcaatctgccttcttcaagggtctgtggattctctcagctttcctggcctattcctgcagtagttctggaagacaggttcatgatgcaagttgccacacgctgctctgtccgtctgagtgggagctgcattccagtcctgcttcctatccactattttcccttgaatatgtgttttaaaatataatagtcagtggtcgtgataaaagagagaggggtttaacttggtatcaggtgtatgagtgtgtgtgcatgtgtgtgtgtgcctgtgtgcatatgtgcatgtgtgcatgcatgtgcacctgcttcctcccgccctcgttgcctgcctggccaagcagagcctctctctggtggtagctggacagcagctccaaaagcccaccctgaggagaagccactgcaccctccaaggcacacatgcattccgcctttgcttcacgcccccaccacccacagcactgttaaaatgaaccctctgaccagtggcaaaatttgcttgccaaggaggacgtcagtaattgactaagtcagggccccacaactacaggagctggtgtgggtgagcagttactctcttctgtacacagaggctctaatcatgctttgtgtttatactgccggtgtgcaaatggtagaccagggcatttggcttgcagcaggcagagttcccagtggtgttgaaggtgcagcaacatcattagagaatcaagggttttgatttgcatttctctaatgagcagtagtgttgagctttttttcatattcttgttagccatgtgtatgtcttcttttgaaaaatgtccattcatgtcctttgcccactttttaattgggttgtttgattttttcttgtcaatttgtttaagttccttattgatcctggatattggacctttgttggatgcatcctttgtaaatattttctcccattctgtaggttgtctcttcactctgttgatagtttattttgccgtgcagaagctcttaagtttacttagatcccacttgtcaatttttgcctttgttgcaattgcttttggcatcttcatcacgaaatctgtgcccatttgtatgtccagaatggtatttcctaggtcatcttccaggttattataattttcaattttacatttaagtctttaatcctgccatttgacctagcaatcccattaccgggtggatacccaaaggaatataaattgttctaccataaaggcacatgcatgtgtatgtccattgcagcactattcacaatagcaaagacatggaatcaaactaaatgcccatcagtggtggattggataaagaaaatgtggtacatatacaccatggaatactatataggcataaaaaagaatgagatcatgccctttccaggaacatgggtggagctggaagccattgtctttagcaaactaatgcaggaacaaaaaacagctcctttctcggggttctctctggatctgcacagctcctctctgggggttccctctggatccacacggcttctgtctcgaggttccctctggatccacacggcttctgtctcggggttccctctggatccacacggctcctctctcgaggttccctctggatccatacggctcctctctcgaggttccctctagatccacacggctcctctctcgaggttccctctggatccacatggcccctttgaggctcttttgttccagtgtaaaggtgaggagactggggctgagagcccagtgccaagtgatcagtggtcggcaaggagtttgcagaaaagccattgtgattagtgccaggtggttgctggtgatggggactcagaaggcccaggtggagtcccattccatggtgctgaactggagcggtcctggcaaagtgggcttagggccacagatcatcactgcgagctgtttgctctgaaagaaaggcagtggagtggagtgaaccaccacaaggtcaagtggagatggggagagagagcgggaagcaagctggtgaggggcggaggtgaaggagagcacgcagggatgggacggagagtcacgatggagggagcagggtctcagagacgtccactgactgctctgcctcttttctcctctgactgagcgtccacgcagccctgattttttcagcctcctgtgtgagcccctgtgtggctcctggtcacctccaggataaagtagtacagagcacatgccaagcgcccaacgtaaccgaccccatggcctccctgccaccctgctgctgctcccccatcgccatggggtgccagcccctgccccatgtcccctgcgagctcctgaggataccctcagatctgaggggctcaggcctctgcctggaatcccttttcctgccttcaagacacagctggagacagcgtcacctcccctgacaggccgtgttggagtgctggctggggcgctcagcatagccgtgggaacggggcacctcctggtcggctccagtgagaccagagagttggtcactggagcgggggtgtctgagttggaggtaaggtggatcacctgaggtcagaagttcgagaccagcctgaccaacatagcgaaagcctgtctctaccaaaaatatgaaacttagccaggggtggtggtgtgcgcctgtaatcccagctacttgggaggctgaggcaggagaatcgcttgaacccgggagatagaggttgcagtgagccgagatcgtccactgcactccagcctgggcaacagagcgagactccatctcaaaaaaaaaaaaaaaatgcttgggactgctgccgggcacagtggctcacacctgtaagcactttgggaggccaagctgggcagatcacctgaggtcaggagttcaagaccagcctgaccaacgtggcgaaaccccatcactactaaaaatacaaaaattagccaggcgtggtggtgggtgcctgtaatcccagctgcttgggaggctgagtcaggagaatcacttgaacccagaagccagaggttgcagtgagcctagatcctaccactgcactccagcctgggtgacagaacgagactccatctcaaacatatataaaataaaaaccaaaatgctcgggactgggaatgtttcagatttagtattttttcagatttttgagtatttgcatcatacataccagttgagcattcctaattcaaaaatccaaaatctgaaatgctctgatgagcttttcccttgagtgtagtatggatgctcaaaaaaatttggattttggagcatttcagatttcaggttttcagatttgggatgctcaacctgtgtatatcactgttgttatttttggaaaacatgttcatgccttttattgctattacaaataataatttctgaaaacaaagtttaagttatttcaggcgttattgtagaagatactgcgtcaaccccaactgtctttcttccatctgcccagtcttagagtgccgcaggtagctcctgtttgcccccaggtcccattttcaccctgcctcacctgtctttctcaccagggaggctgagtgtgggacacatcggctgggctcccgtattctggggtcctgttgagcttagccagtgaggagcccccagaggaggcaggtggttactcctgtagctccctcatcctgggaggctgccgctacctggctggactgctcgaatgaaggtcgctgccccacccaaggggactggctctacctgaaactctctccttccaggttttgtaactgttcctcaccccaggtctagggctggtaacagcttcaggttattgcactatttcttggggttccccatgcacctgtgcctttgggaatggtcccatagacggtcactcgctgagcatcatcttagaaatggggctgtgcactatgaaggtgagcaggcagaggtgggtacgctggtcagacccctggactggtgacaaccgccaggcagtgcacagagttggagtgatggggggcagaaccagaccatggcagcagcccctacgcctgctgatgggacagaacaggtggaagcagggggttccccaggttgcttcacagtgagcagcagtggcagtgtcttgcctaggcagggctctgtgcttggggcctccaactctgtcccctacctgtgtgggtcagtaggggagaggcacactgcaggtctctgcagtgtgattttagagttgacaagccttatacctaaaagctctctagcaaggcataaaccttccatttcacaagtacagataaggattaaactaggaacaccctgcaagaagggactgtggtagctgacgctcactctgcagtgcactcagcggctcccaaacctgcgggcaggttcagcagaggatgggcatcctggggagagacaggctgagcatgttactcaactctcctctttctctctgcatgtaagtccaaagtcaaaagcactgcatttaattcagctcctttagtgatgctggtgtcgctgtcctcccacaaaagggagcacagaaagtgctgaagggagtaacacattggtgctgacggagtctcactgtgtcgtccaggctggagtgcggtgacacaatctcagctcactgcatcctccgcctcccaggttcaagacattctcaagcctcagtctctcgagtagctgggaccacaggtgtgcaccaccacgtccagctaatttttgtatcttagctgaggtttcatgttggcctgactggtctcgaactcctgacctcaagtaatctgcccgcctcgtcctcccaaagtgctgggattacaggtatgggccaccgtgcccggcccgagactgcttttttaccatcttaatgttgtctgagatgatgagtgtgagatctggaccaccccacgtaagtgcgccaacgtcttttctaagaaagctgttgtgtttccagctttccctgcggttcctgccacttgtcctggtgggatggggtgggctcggctctgctggatccacgcctcactcatggatcagatcattcctttctcagtctgtgctcactaacctggcctccatctctttaccacttaattgatatttcagtttcctcatcacttactgatttatttcacttgaatcaccaagtccctagaagactgatggttacaaaattaagcatgaagctgaggaacggatcctggaacagggcggcctctggcaagcgctgcaccgccctggatctgagcacctttgaaaccgcagcaagcattgcttagtaaacgaaggtggttctgtggacaaaatcttcgcataatgggtatagaatacagagaggaagatgccgaggggtgtaaccatcgatcagcactccgctgctctctgtgtgtgggttccagatggggaagtcctccttggcattctgaccccagtgtgctctgctcccaccctgcacgcatctcttctctgttccttcttttgacttaaaagcagagaatataaaaaatgacttatttagagctccctgtggccattttctcaactttgaattgaaaatattggctgggtgtggtggctcacgcctgtaatcccagcactttgggaggccaaggtggacggatcacctgcggtcagaggttcaaaaccagcctggccaacatggtgaaaccccatctctaccaaaaaaagtacaaaaattagttaggcatgggggtgggcgcctgaaatcccagctactcaggaagctaaggcaggagaatcacttaaacccaggagatggaggttgcaccactcccaggagaaggcaaaattgcaccactgcactgcagcctgggtgacagagcaagactccatctcaaaaaaaaaaaaaaaaaaaagaaaagaaaaaatatttataatatgctaacacactaaggctttgttttttgttttttgtttttgagatggagtctcgctctgtcccccaggctggagtgcagtggcgcgatatcagttcactgcaacttctgcctcctgggttcaagcaattctcctgcctcagcctccagagtagctgagactacaggtgcgcaccaccacgcccagctaatttttgtattttcagttgacacagggtttcaccatgttggtcaggatggtctcaatcttttgacctcgtgatccgcctgcctcggtctcccaaagtgctgggattacagccgtaagccaccgcgcccagcccacactaaaatgtttgtttgtttgttttgaaatgaagactcgctctgtcgcccaggctggagtgcagtggcgcaatctcggcttgctgcaagctccgcctcccaggttgacgccattctcccgtctcagtctcccaagtagctgggactacaggcacccgccaccatgcccggataattttggttttgtatttttagtagagacggggtttcaccgtgttagccaggatggtctcgatctcctgacctcgtgttccgcccacctcggcctccgaaagtgctgggattacagatgtgagccacactaaggttcttatagtctggaaagtaagcagcagtccctgtgtatgttgacatattaaaatgtggagcatgagataaaggtggtgttggcagcctccggggtagagccagctacacaggtgataggactaggtcagcaagttcgtgctgctcatggcaggagaggtgtgtctgcagtcagtcacccagatcgtgtggtgagggagccccaaatggtgggcacggaaccgctaagcctggactgttttctcagaaggtcttcttttcttctcacgttagaagcttccttttctagttgaggccaaccccttctgaaattggagtaaccattcccaggagtgatgggacaatcctccttctagactaaacaagagttccaggactggaccaaaagaagtgtggaacttgagggtgggaagtgagtcctcacgctctgcttctcggggcgtctattccctcactgtgtgggtgttgccagtatcagtggggagagaacctgggacgggcagattgatggtaactgtctggttagtagtggattattttagcagttgttatttttataaataggacacgttgaaatccattttgagtcactatcctgctcttagtttgattaaggtgtataagtaaaatgaatttcatactggtatgtgtctgttaaattatcctttagtatttttgcctgactaataaatgattagtgatagtctgtcttgttcattttcatagaattgaggccaagaagaccaaagaattacaccgtcttacaacacattttttttatataaattctttctaaattaaaattctgtgtaaatgggtttcagaaaaagtaattgatgactgtagtgcttatctctgaaacatacttgtccagttgtttgctgtatttgcaggtgtttttaaaatgtgtatggtagaatgaacatttgaaggtcttctgcaatcttattcaattcaactgcatttttttgtctaatagaattagaaaatagcttcaatataaaatatacttgtaaacatgttaaagctttatttagatcaatgctgtttcacttaaaaaaacaaaaattgcagtggtgtatgcctatagtcccagctatgtgggaggctgaggtgggagaatcccttgaaccaaggagtttgaggccaggctgggcaacatagtgtgcgaccccatcttgaacaaaaaagaaagaaagaaagagaaaaaaatcacatgaggcactttcataggtgcattatttctcttacaaaaaaaaaaaatccatgtctaatcctttaatcttataaaggaatataaaggtaatcctttaatcttataaaggtatataaaggtttttgttttgttttgtttttttatactggttattaaatctagattcaccagtgttcttttaaacctgcgtgcttcatttgctgacatttcctctctgaggtcaggaacacaatatagtcatctcagatccgtacttgcccctctcaaatttgatctgtgcttcttcagtgacttgcaagataccaggcattaactcatgcctgatatctacaatgaaccttccaggggcctggattatagagaagagcaagggacgtccactgctgccccccggtgcgcatgtctaagggaagaacagacctgtaacttcagtacaaggtgtgtgtgactcacgaagcattaacaggcatgtcaaaactggagcagttaattccgacctgaggggctcaaagggaaggttttatgggaggaagtagcctttgaactgaactttgaaggcctattagtttcccaggatgccacaacttggtggcttagacaacagaagtttatttccttgtagttctggaggccagaagtctggagtaagtcatcagcagggttggttcctaagtcctcagcaggggtggttccttctggaggctgagggagaatccgccccacgctgccctcagctcctgctgttgccggcagtccttggcatccttggcttgtcgctgcgtcgccccagcctccacctgtcttcacgtggccctcccctccgtgccgcgctgcatcttctctctctctcttataaggacacttgtcattggatttagggcccaccctaatccgggataacctcatctccagatcctcaccttagttacatctgcagagacccttattgcaaataaggtctcattctgatgtttccagtggacctgtctttttgcggaggccactgttcagcccactgcagaaaggcaagcaggatgtcaggtgaccataggagaacagggaaggcactgttgaggaagaaagaatagtgtgtgcagaggcacagaacagaagcatgaggaacgcattctcaaaactggatttcccaaagttcaaacccttcctttgaaaaggatatgttgaaatgatcctagagatgagattcctaggggatgtgataggagatgaggctggaaaggtaggttagagttcgagttctagaaccttgaatgatacagggtatattgtgtaggtagggaggacacgagcagccaggcacagtgactcatgcttataaccacagtgctttggaaggctgaggcttgaggccaaaagtgcaagaccagcctggtcaacatagtgagaccccatcactacaaaaaaaaaaatacagaataaaaaagttagccagatgtaatggcaggcatctgtagtctcagctgctaggattgcttgagcctgagagttcaaggctgcagtgagccatgatcgcaccactgcagtccatcctgggtggcagagtgagaccctgtctcaaaaaaacaaacaaaggtaccaaacaagcatattatgtaatcagatttgtttttaataggagaaatacttccaatatttcaatttagtgtttataattgcttgcatttaaacttagatgttgcatttgtaaaagtttgttattaacctttatgaattaaacactttaatataaacttgctacttactcatattcttctttagcaactcccttgcataataatgttgggttggcatctgtttaaagagtagtgagatttaacatcagtctgcaaacaggtttcttccttttgtagagcagtaactcaagtcccagtgtgatactctgtaattatgcttctatcctataacactgaaaatatcaaaagcaagaagggagcattgtgttaatatcttaacctcagttagcttttgaatatggagttggaacttcttgccctctcaggaattttgataatttattttattttatttatttttttgagacggagtcttgctctgttgcacagactggagtgcagtggtaggatctcggctcactgcagcctccacctcccgggttccagccgttcctctacctcagcctcccaggtagctgggattacaggcacatgtcaccacgcccggctgatttttgtatttttcatagagatggggattcaccatgttgcccaggctggtctcgaattcctgacctcaggtgatccacccagctcagcctcccaaaatgctgggattacaggcgtgagccatcgcacgcggccaaggaattttgataatatattttaaacagcctgttgttgaacaatttgggtgggttttgttgttgttgttgtataactccaaattacactcattttcactctgtttcaatttatttcttcctccaagtacaatgtgagacttcaccataatgtaactaacacagatggtgccacctataatcgtaaagtttatactaaaagtagaaaagcgacattaaaaaggaacgttttatattttactgtattttcctagcttaaaaagcttatacttttgttgtgattgatgttgttttattacatcagtaataatctgtccttattcccactcaacagaaattttattataatttgtaggtggctcacgcctgtaatcccagaagtttgggaagccaaggcaggtggatcacttgagcctgggagtttgagaccagcttgggcaacatagtaagacctcatctctatttaaaattaattattatttttctttttttgaggcagagtaccattctgttccccaggctggagtgtagtagcacaatctcagctcactgcaacctccatgtcctgggttgaagcaattcttttttttttttttttttttgagacggagtctcgctctgtcgccaggctggagtgcagtggcacaatctcagttcactgcaacctccgcctccagggttcaagcgattcttctgcctcagcctcctgtgtggctgggattacaggtgcgtgctatcatgccaggctaatttttctatttttagtagagacagggtttcaccatgttggctaggatggtctcgatctcatgaccttgtgatccacccacctcggcctcccaaagtgctgggattacaggtgtgagccactgcacctggcctgaagcaattcttgtgcctcagcctgccaagtagctgggattacaggcatgcaccactatgcacagctaatttttgtatttttagtagagacggggtttcgccatgttgcccaggatagtctcaaactcctggcctctcaagcaatccacccgccttggcctcccaaagtgctgggattacaggcgtgagccactgcacccagccataaaatttaatttaaaaaaattttttaaagaaattttattataaattttatttttgtttttaaaattatttttaactggttttacacattcaaagagggtttattataatttattttaaatatttaaccttttacggctgggtgtgatggctcacacctgtaatcccagcactttgggaggctcaggcaggcagatcacttgaggtcaggagtttgagaccagcctggccaacatggtgaaaccccgtctctactaaaaatacaaggattagccaggcttggtttcccacacctataatccaagctactcaggaggctgaggaacaagaattgcttgaaccctggaggtggaggttgcgatgagttgagattgtgccactgcactccagcctgggtgacagagcgagaccctgtctccaaaataaataaataagtaaatatttaacatgttactttgtttggtcgagtgctttatatttttaaaaaatgtcgtagatcctcccccaaacctggaacccagttacagaggttctaatcttgagaaaagcatgagacctcttccagccaatgggcatcctccaaagtgcctcatcagaacttcaaagcttccaaggccatcacaacaaggagggtctgagaaactgtcgcagccaggaggagcccgaggagatgctcccgaccatcatgtggaatcctggacgggatcgtgagacagacacagggcattaaggaaaaaataaggaaatctgaataatgtggagacttttgttaatacattgttggggtgtgtgtgtatgtgtgtgtgtatgtgtatgtgacagagtcttgctctgtcacccaggctggagggcagtagcacaatcacagctcactgcagcctcaacctcctggctcaagagaccctcccacctcagcctcctgagtaggctggggccataggtgtgcaccaccacacctggctaattttttttatgttttgtagaaacgggatctcactatgttgcccaggctggtctcaaactcctagcctccagggctcctcctgcctcggcctcccaaagtgctggaattacaggtgggagccactgtacctagacacattcattatgattttcttggctgcttaactataaccgctgcaccatgctaatgcaagatgttgatgatggggaaacacatttccagctgccctggaggctgtgtgcatgcaggacagaggcaggagagcccagctctgcacacctccctggatgacggaggaagcccacgcagggagcaccaagccacactcccacagctccccagccaactagggggctgcctgtgtgtgaaggcagtgctggaggacctgccagaaagtctaagccatggcaggcttggaaactgtcttaactaggagagggctccacaagccacccaccagtccatcagccacaggtgggtgcctgactggctggggcacagcctctgaccgctcctaacctaggattggattatacctaggttgaagtaaatatccatgagtctacactgatatgaataaatgatcagataaataaataactctcctgtacataattattttaaacaaggaggtagggcataactccttgccattaagtgaggggtcctagtgaccttcttaaaaagattacagtacataaaggaggagggaaagagtacctctacttggagaaacctgacaaatatgacttcactcaggtgattaaggtgatgagtcacgttgattttaggcaccctggataggatgggatgagaaggcatgtgtaccctcagtatgatgatgaggacggagcgggtccctccgtgtgcggtgaggacggagcgtgtccctccgtgtgcggtgaggacggagcgtgtccctccgtgtgcggtgaggacggagcgggtgcctccgtgtgcggtgaggacggagcgtgtccctccgtgtgcggtgaggacggagcgggtgcctccgtgtgcggtgaggacggagcgtgtccctccgtgtgcggtgaggatggagcgtgtccctccgtgtgcggtgaggacggagcgtgtccctccgtgtgcggtgaggacggagcgggtgcctccgtgtgcggtgaggacggagcgtgtccctccgtgtgcggtgaggacggagcgtgtccctccgtgtgcggtgaggacggagcgtgtccctccgtgtgcggtgaggacggagcgtgtccctccgtgtgcggtgaggacggagcgtgtccctccgtgtgcggtgaggacggagcgtgtccctccgtgtgcggtgaggacggagcgtgtccctccgtgtgcggtgaggacggagcgtgtccctccgtgtgcggtgagtatggagcgtgtgcctccgtgtgtggtgagtatggagcgggtgcctccgtgtgatgatgagaatgaaactgtgtaacccaaagactgagaaaaaccgtgtgttctcacactgctttaaataggctacctgagactgggtgggtaatttataaaggaaagcggtttaattgactcacagttctgcatggctggaggggcctcaggaaacttacaatcatggctgaacgggaagaggcacgtctttcgtggtagcaggcaacagagagagcgagggcagagaaaactgccttataaaactctcagatctcctgaaaactcaggcactatcacaagaacagcatggaggaaactgcccccatgatccaatcacctcccagcaggtcctgcccttggcacgtggggattatgggaactacaattcaagatgagatttgggtggggacacgaagccaaaccatatcaataacgtaagatgataaacttgggggaacctgatatggagtatataggaactgttccagctttgcaacttttttgtaaatctggaacatatatttattcaaaatacaatgttcattgaaataatttagaaatcaacacattaaaatggtatattaaaaatataatctaacaccaaacttacagattttcaaaaattctgtaagtttgaacattcctgccctatattattttcaattatttcacatattcatatagtaatactaacatgtataatatgtctataatatgtgtacctcttttatgaaaattcttgatttaatgaatgaacaaaattatcttctgagatttcctttctgggagatggtttgttacattttactatacttagcctccctcttgatttcttgcttttgaattttaggatgttagatttggcaggcaatttgtaacttaaatactggctgaatgtatgcttgactgccctgatctttggcttttgttttgcgccaattccacactcagtaggcatgaggagactgcgcatgcggctgcgcgaggagcgtcatccttagcagcgatggcggacacggaccagatctctctgtgccgctctcatgagagcttgctgtttcaggcctttcttaagcagggccctcactgtctagtctatcagtgttttgagaaacatgggagcacaccaactgaaacttcatctgtccatccgttccctccctgacagccgctgctattcattcacgaaccccgagcttgtccttggtagtgctggtggcagtgtgatgacagtcactgtcccctccattggtttgcagtgtctgtaaggacaagggttgtgtttgttgtcttccctgcggcatccccgcctctcgcacagtggatgctgcgggtgcctcaccagaatcctgtctcatccaagttctcatatttcaacatctctgccccaggacattctttggcaactgggcttgtgggtagaaatgacgggggtgatgtcccaggaattacctggaacccaggcagggcaggagtggtcctcccacgagacagttctgaggtctgtacagcctcagagcatcctccctcatagcttcactccagggtcacgaaggtataacctgcttactgggcaccctttcttttgaatttttcctcccctaactttccatggtctcaggatcagctttgggaggaatgcacactagacaatatgcaataaatatttatagactgaattaatgtatggattacttgagtaagatactgatcattcaaataaattatcacccaggaaggaaaaaaatattagaaatacacagtcactgttaacgagatagaaggtaataactgatgagacagaagtaaaatgctgttggcgttcaggggaagaagtcattttagatttccttaccctttccaggtcagggttggtgacccacctgtgtgttctcaggtgatccagtgctcaccctgggctgatgcataagctttgaggatggataaccggtcattgtgtccccctgtgggtaaccccaggacagggcccaggacacaggggtcctccccaggtgcgctcagatgagcgcaccgttgagtgagggaagtgagtttaataaggagctactggagcctgggacagagcttcaaatcccgcttgggtcactacttcaccgtctgatttggggcaagtgacgcagcttctcctagcctcggtttcctcagaggtaaaatgaaaaaatgaagctgtattcctcgaggttgtcacatcagttaagtgaggtgatttattgcagtacctggtccgtaatgagcactcagacgttcacttcttttgtgggaaaagatgtccgttgaggttggattgaaattgaacaaggaaaagtcaaggaggaggacgtttaaggcaagtgagtgaacaagggcaagaagggagaggtcaaaggctacaggagactgacagggagaccgtttgcttagacatgaaaccaggagctgggaaataaggctgcggagaagccagatgtggagatgcatgaatgagacaggagacgtctggaatttattccacatcaggagggagacatttgagagagaaatatccaggaggcagttgcagtgacaaaactctgcattataaattgtaatatcccaaagagaggtcagaatgaaaatagacttgagagtggtccacatcatttgtcatgaaattggcaaaccagctgcatggatgtccacagtaggaaatatacaaaattgtggggctcctttccacagccaaagagcttggttagtatcacttgtttaacacttgttttgctaattagcttatacactacatgtttttcttctcagatatttcccaagtagtccagatcttcctaaaatgcacagatcggtgtgggctgaatggagctgtcaaggatgtctcttgcagatggcataatttggactgacccatgaaaatagggaaggatttcggcagaacggggaaagcagttgtggcgggccgagggaaggagggggatcagcttggctgagaacacagctttggaatccagaggcttcaagttcaaattcaggttccatgactcaccagtcatatccttgagccaaggtctaatgaaggagttcactgggccacaaacagacggagaaagtatttcaggcagaggaagcagtagtgtcaggccccatggaagagacagcagagcactgatggaggactggaaaaaaatagggggttggagaaaatacggagcaggagtgtttaatacaagaggcagggaggtaggcgggggccaggcctcccaggtcttataggtcaggggtccccaatcctggggccatgaaccagtacagttccctggcctgttaggaaatgggctgcacagcaggaggcaaggggcgggtgagccagcattatggcctgagctgtgcatcctctcagattagggacagctttagtgtctcataggagtccaaacccgatggtgaactgtgcccacgagggatctaggttgtgtgctcctgatgagaatctggtgcctgatgatctgaggtggaacagtttcatcctgaaaccacccactaccacccccagtggaaaaattgtcttccacaaaaccagtcctagggactgctgttctaggtgacttcaagggttttgcctttattctaaagcatctggattagattatatttgcatctggcaaaatcttcctggatgcagtgtggacagctgtggaagatgcagggggcagaaggattggtgaggaagttaggatatgtagggggtggccatggaggcagagaaatgagtggatttgagggttctggggtgcaaaatcaaggcattgtgataaattggttagggtgacaagaggacattggcaagggtgactcctagatttccatgattggttggacggtgttgccttttccttatcagtgtgctatcaaccccacaatacattgtcattatttttgtttaaattgtcagttagggctgggcacagtggctcacacctgtaatcccagcactttgggaggccgagccatgcaagatcacctgaggtcaggagttcaagaccagcctggccaacatggtgaaaccccgtctctactaaaaatacaaatattagccaggtgtgatggtgtgcacctgtaatcccagctactcgggaggctgaggcaggagaatctcttgaaccttggaggcagaggttgcagtgagccaagatctagccactgcactccagcctgggcaacaagagctaaactctgtctcaaaaaaaaaaaatacataaaaaaataaattgtcaattagcttttagagagatttaaataatttttgaaagcatttgtatatttgtccacattgttaccattttcagtgctctctgttccctgtgtaagtccgtatttccatacagcatttatgtaaatagtacctttaaaatttttttaaatttctgtctgctaacaatgagttagtagatacaaatatagtagccttttttttctatttgcatttgctttattgtacttttttcctttttttaagttttatttttggttgacacataattgtacatatttatgggatacagtttgatgttttagtacatgtatatattgtgtactgataaaatcaggataattagtatatctgtcacctaaaacacgtatcatttctttatggcaggaacattcaaaatcctcccttctagctattttgaactatacaatacgttattgttaactatagtcaccccactgtgcaatagaacaccagaatgcattcctcctgtctgactgtaactgaccaacctctcctcatacccccaccccattccctccccagcctctggtaaccactctctactttctactcctgtgagatcagcttgtttagattccacagatgaatgggatggtatttgtctttccacgcctggcttatttcatgtaacacagtgtcctctaggttcatcctgtgctcacagatgtcaggatttcattcttttttatggttgaatagtactccattgtttataggtaccacgtttctttatccattcatcttttggcgacacttaggtggattccatgtcttggctgttgtgaatagtgctgcactcaacatggcagtgcacatgtgtcatgaacactctgatttcatttcctttgggtatatacccggtagtgggattgctggatcatagggtaattctatttttaattttttgaggaacctctgtactgttttctataatggctctactaatttatatttcattcccaccaatagttcaataaaagagcggggggggggggctcccttttgtccacatcctcagcaacactcatcttttgttttgttttgttttgtttataatagccattctaactggagtgaggtgatatctcattgtggttttgatttgcatttctccagtgactagcgatggtggacattttttcatatacctgttggccatttgtatgtcttctttgagaaatgtgtattcagttcttttgcccattttttaatcagattatttggggtttttttcctgctgttgagttgtttgagttcctaatctgttttggatattaaccctttatcagatgtatagtttgcaaatattttctctcattctgtaggttgtctcttcactctgttgattatttcctttgcaggatagaagctttttagtttgatataatcccatttgtccatttttgcttttgttccatgtgcttttgaggctttatccataaaatatttgcccagaccaaagtcatgaagcatttcccctatgttttcttctagtagtttcgtagtttgggtcgtagattttcagtctctaatctattttccattgatttttgtatctgatgagagataggagtccagcttcatttttctgcatgtggatatctaggttttccagcaccatttatggaagagaccaccctttgcccggtgtgtattcttggaacctttgtcaaaaatcatttggctgtaatgtgtggatttatttctgggctttctaattctctttgtctgtgtgtctgtttttatgccagcttcatgctgttttggttattatagctttgtagtacattttgaagtcaggtagtgtgatatcttcagctttgttctttttgctcaaaattcttttggctatttggggtcctttgtggttctatacaaatgttaggattttttttttcttgtcctgcgaagaattggtattttgataggcattgcattgaatctgtagatcacagtggatagtgtggtcattttaacaatattcttccaatccatgaacacaagatatcttcccttttatttgtatcttcttcaattcttcctctttttttttatttttatttatttttttgacagtctcactttgtaaccaaagctggagtgcagtgccgcaatctcagcccactacaacctccgcctcccaggttcaagcaattctcgtgcctcagcctcctgagaagctgggattacaggcctgtgccaccatgcccagctaatttttgtatttttagtagagacggggtttctccatattggccaggctggtctcaaactcctgacctcaggtgatctgcctgcctcagcctcccaaagtgctaggattacaggcgcgtgctaccacacctggtctgcttcaattctttcatcagtgttttatagttttcactctagaggtctttcacctcctgagttaaattaattcctgagtattttgtttttttgtagctattgtaaatgggattcttttattatttctatttcggatagttgtctattagtgtatagaaatgctactgattttttatgttgagtttatatcttgtaactttactgaatttattagttttgacagtttcttgatggagtcattagggttttccatatataagattatgtcatctgcaaacagggacaatttaacttccttgtttccatatttggatgccttttatttctttgtcttgcctgactgctctgacaaggacttccagtactaccttgaacagagtagcaacagcaggcattcttgtcttgttcctggtcttttttttcccctttatttttatttttattttattttattagttttgtagaaactgggtcttgctatgccacccaggctggtctcgaactcctgggctcaagtgacccttccacctcagcctcccagagttctgggattacaggtgtgagccaatgcacctggccttgttccagatcttgaagggaaagcttccaacttttccccattcgattagctttgtctttgttttattaaccctgatttaattctatgaccctgctaaactcattctttttagatctaggaactttttctagattctttggtatttcctatgtagaaaatcatacagtgtgcacataaagacagttttgctttttccttttcaacatgtatgcctttcatttttttctcttgccttatttcaccatctgggacctccaatatagtgttcatagaattagtgagagtgagcatccttgcctggcccttgatcatactgggaaaacatttcgtattttaccattaagtctgttagtgataggtttacgtatatgctcttcatccgattgagggaattctttattattactgatgttttgcctttttttcttttagcagtagaagactcagaaagtggtgtttacatgcgattcatgaggtcacacaagtgttatgacatcgttccaaccagttcaaagcttgttgtctttgatactacattacaagtaagtgtactccattttcatgaattttttggtatatttttggatggctactactttatacagtaatttaaaaccagcaatgccagcaaacgtttattgagtcctttgcactatcgggcactgtgctgaggttttatctgaattctcaacatcttggcaaccttataagaaatgtgctattactgtcttcttcctaaagacagggaagctcaaattatagagtttaagaacttaagtcagaaagctttggccaggtgcagtggctcacgtctgtaatcccagcactttgggaggccgaggctggcagattacctgaggttgggagttggagaccagcctggccaacgtgatgaaacaccatctgtactaaaaatacaaaattaaccgggtgtggtggtgcatgcctgtagtcccagctactcaggaccctgagacaggagagtcgcttgaacccaggaggcagaggttgcagtgagccgagcttgtgccactgcactccagcttggcaacagagtgagactccatctcaaaaaaaaaagaaaaagaaagcttagtccacaagttgttgtggaatttaaggacctaatccacagagctagtacaagatggggttttgaacacaggcctgtctaatgtgtgttagaacctaagctgttcattattaaactgtatggcctcgctcagtatatcctcatggtctttcttagttatttagtagaacatatgataaatttgaaataatattggtaaaaaagaagaaaatcacaaaaatgggcaatcttttgaaagaagaaccttaccgatctcttttcccagaaaatttgaatcttaacattttggtattaaaattatgcgtattgcaacttactttatatcaatgtaacttataatcacatacaaaaagtcctaaataatatactcaataccgtgatcaaactacattcagtgtaatcaaatgggtgtctacacacatatctgtgcgtatacatttagtgtattgtttctacataaatattttccaagtaggattgtcctcagtcgagttcctcagaagtaaatgctaaaccaagaattcatgggtttatgaaggatgcactcccaggaggaagcatgaagggatcagaggaagagcagggcaggggaagacacccagcaagggccctggaagggctgcctcagcctgagccttcgggagcaccagctgaaaggtgccctggagtgtatccaccccctcccatagccctgccttagatgatccttccaggctcttcctgctccaccaggccctttagacctccccagggacccccaggtgtggcctgcttctgttcccatgccccacacctgccgtgcgtcctcagagggctccccgggctcttggagccccttacctgtattctgtgcctgccacccaggacttacaggatgaccaaaaatgactttgcttttgtttaatttcattttccaattgtttcttgttaacgtatggaaatacaattgatttttgcaaattggctttatgttctttgctgagttcactttggaccaggtaaccttcagagtcacttttaaaaccctaagattcttgattatttgacacaaagaaggaagcatccaaatacaatcttatagtagggaaaacagtaggcagttgttttaagagatgcggtctcgagaactgtgactacatgtttcaataacaaaataatgagaagttctgaattcccaaaataaaggaactactggctcaacctatttcagcctcacgcccatcccccagaaggtttactttttaaaataccagattttctgaccaccggcatttctaccaacttaaaaataagcgacagtaggccgggcacagtggctcaaacctgtaattccagcgctttgggaggccaaggcgggcagatcacttgaggttaggagttcaagaccaccctggccaacatggtgaaaccccgtctctgttaagaatacaaaaattaaaattagccgagtgtggtagaagtcacctgtagtcccagctactcgggaggctgaggcgggagggtcgcttcaacccaggaggcggaggctgcagtgagccgagattgtgccactgcactccagcctggatgacagagcaagactccaacaaagcaagactctcaaaaaataataataacaagtaacagctgatttgacttttacccagctttccatgtattactcattttggctaaaccctagagaaagtcaagtgagtaatacatgaaaaatgcaatgccttatggatgtccaaggtgactgatccagtaaatatcacttccgtaattaagaggagctgtgagcatcatctccgggaagccgtttatcctgtgagcctctaagttgagaggagctgagatgcattaccatggaaatagggggagagagttgtttggcattggttaagtcaaggtaaaaagatgtatttgaaaaggggtgatttgagtattttctagacacaggctgcagtaatagccattgacacaccctcaagagctaagaaagcaaacaaaatagccgcgtacccaaaacaacctaagagaccagttaaataaatcctcgcataggcatataatagaatactgcataatggagaaaatgtttgtcaagagtatattcattgattcattgattaggaaaagaaaaagtaagctgcagaacagtactcaaaatgaccacgttactctgaggatacgacgtcatcagagccgtaactgctctagggaccaaggcgagccacttgcagggaagctgaaagagtgtgcgcagacaggagtagaacagagccaatgagaggagagcagaatgcgagggtgtgccaccagaatgagggggaagagcagtctcgggcttggcttttctgcttccatcttcggtctcttgagaggccgactggactccctgcagttgggttccatgagattcccctcggtttaatactggaatcaccctggggatccatgtagatatgtcctggccatctcagtcctgataaagtggaaatcaaatgtccaactgggaggtctgcctgctgggggatgtaatccccactgtcctcaagagccacactgtgcagtgccagcaggggccagcccagcaggagaagcacctgtaaaccaagcccagctttttctccatcagtcagtggctcataaggagctcccccgagtctgggtgtggatcgaggtaggggaggcaccggtgtcagagcagctgcatcatgtacccatgcagtgtccatgtacttcacaggcctgggcgagccccgtctcggcctggcgagagagggtcgctgtgcatgctcagcattcggcttggggggcctagtagttccctgttcgtgatggggagctcaggttgcatggtctccgcatctcgtggctagcttgtttggtctctataagggcctggtgcagtcggccaggaactgtttcccagcgggagagtcattatctgcaggagaaggcatggttgttttggggttaatcttccctcaaaaccctcaatgtctgctctgtaaatttccttttggtggaggcttcctacagcacccctaatatcaaccttgctgggtcctaaggccacacagaagagcagcctggacttgccacatgcctgatcgtgccctgggcctctctgaaaacagcttttagtgtcactcagtaccggtgtcagagtagcacgtacacatgtggtgcatgttgcctccaaaacacctgcctggtggttgcagtggcaggtggagtgtggagtgacaacttgaagctcccattggaggggtgtctccagtgtttcaggccgttctggggtgtgagacccccggttctgcggggtctgtccctcatgctctgcccggcacatatctcacagaggcacctagagctctgctacttcctgcctgtctagtccagcccacaccgctatcagcgcatgggccagtgtggcagtgtgcagtgtgaagatggccagcttctctgcagaccataataaggtagagagcgggggtgccgcagccttgagacacacgggtgaaagtatcctgttgccaggtaaagcagactccgtctaggggtccttgtagattggtatagagaaaaggagtatgtgtccaggcaggggctgtgggtcccccaagatactacattgggaacagctgctgcagtgacaagttcacttttcctattgaaggggcccctcacctgtacattcctcaggggctccaggagggagtgtcctctgggtatggaatgtgcaggtggcacatgacaaatccgtgccaatgcccctgtctcccgaagcctgtggattcctcctgtatagttcactgtgccacagaagcctggcatctcagcctcattaaacacggactcagcagtgccctgcacttcaggcagtcaaccaagtgagcggttagagccactgccggctgcgtgcacaaaatgttaatgaacaatttctcataagaccactcatagcaatcagtcccaccaaactagtgttaaatttctcgtctttgtcctaacgttactagcacctattcccatacatacttcttcggtttctgcagctgtgaaatggcaagatctcacagtttgttttgcatataagtggtttcctcccctgcagcatgcggaaacctgtccccagttacaggtcaaggggtggcaagggtgggagggtgagaggcccacgctaggcgtctgccctaggaaagcctgtcactgggctttcgagtaaagaaaggtgattctcagacactggggagccagctgttcccactgccatgggaggctcggaggaactcccgaatctggaatctcagcttcatctgagtccagtcagatgtccctctgtccggtgccagggtcccactccttccagatccatgcccagctttcccatcaaacctggtgatgccaccaattccgcctgtgcatccacaccccgcagagttatgctttgtgtttgattttggaaacagccctgtagctacaagaaatagactctctggggactgccatagaggcttgttgggttctctgtctgtgggtgcaggtcccagacctgggcttgaggttttctcagaggccccagcgcactcacagaatgctgtcatactgagtcctttggtcctggcttctgcctcagtggccagtgcagtggccatgtgggccctggcacacaaatgtcatcacaggcacagatgatggcttttttagtcacaatgccatggcctgccctggattacaggaatctgatttcccactgacaaagagctcaacactgtgttaaacccatggatgggaaaccaattccaagtcctctgttcctgggaaccagtcttggcagtttcttttttcttcttcttcttcttttttttaaagacagggtctcattctgtcacccaggctgaagtgcagtggtacgatcttggctcactgcaacctctgcctcccaggttcaagcaattcttgtgcctcacccacctgagtagctgggattacaggcacccactaccacacctggctaattttttgtatttttagtagagatggggtttcactttgttggccaggctggcctgaaactcctggcctcttgacctgcccgcctcagcctcccaaagtgctgggactacaggtgtgagccaccgtgcccggccgtggtgccagtttcttgatcagtcaaggttcagtcaggagacagaagccacaccagttatttgaacagaaaaagaacataagcaaatgttaactggatctaaattaactggtaactgaaaggacaaataaagacctctaaggcagtgttctcaaagtctgattcccagactagcagcttcagcatcagctggaacttttaaaaacgcagctcatcagacccaatctgagacccgaatccaaaacggggggatgaggctcagtgacccatgtttcaccatgatgctgtgtgagtctggtgtactccacagtgtcgtggaggagagggggtcctggcgcgtgccttctagctggtgcttatgtctctgggtgggagttggggcttgaggaagctcattttgcacaaaatgggaaaacaacaaactgtattcagccgctgctacaggaggtgcctcggtgcccaggtaaggcagtgcctgggtggagctcacgggagctgcaggcagacaggagccctgctagccgctgacgggaggagcaagcccttcttcctgctctggctttgagtccctccctagactcctgtattgtcagaacctgaaatagagccagttggcaacaccgaaacagggtctgcaaagtcccagcatcaccaagccaagttagagggatgggcatggagcagagagacagtaacttcatgactggcacagtagagaggggggacatccccttcccttccagataagcccaggaattcagagaaagataggtatcagttagtgtattagcctgttttcatgctgccaataaagacatacctgagactgggtaatttataaaggaaaagagatttaatggactcacagttccacgtgactggggaggcctcacaatcatggtggaaggcaaggagaagcaagtcatgtcttatatggatggcggcaagcagagagagcttgtgcaggggaactcctctttataaaaccatcagatcgctgggtgcggtgtctcacgcctgtaatcccagcactttgggaggccgaggcaggtggatcacttgaggcctggattttgagaccagcctggccaacatggcgaaaccatctctactaaaattacgaaaattagctgggcttggtgttgggtacctgtggtcccagctatttgggaggctgaagcaggagaatcgcttgaacacagaaggcagaggttacagtgagccaagattgcaccacttgcacaccagcctgggcgacagagcaagaatctgtcttaaaaaaaaaaaaaatcagatcttgtgagacttattcactatcatgagaacagcatgggaaagactcccccccatgattcagttacctcccactgggtccctcccatgacacgtgggaattatgggagcttcaattcaagatgagatttgggtggggacacagccaaaccacatcagttagtgattccaaaagatgacacctcgagaattatgagaggcccaaaaataaataaaacttcataatggaatcctcacaccctaggattggtggggggaagcattaggaatgatccaggcttttcctcacagtggcaatgtaacttcttttagcaatactctacaaatgatagcttttttttttaacaagtgttttataagagttttagatgtacagaaacatggcaaagctagtgcagagaatttacatataccccacacccagttgaattttgacatcttgcgttagtgtggtctatatttgtcccagttaatgaaccaatattgatacatggttatttgctaaagtccatgctttcttcagatttccttagtttttgcataatgccgttttctgttggaggatcccatctaggttaccccatcacgtctcgtcatcatgcctccttaggtgggacagcttctcagacaggtactccctgtgtttgacaccttgacggttttgaggagtgttggtcaggtattttccagaatgccctctactgagatttgcatgatgatttatcatgattagactgggcatgtggctttggaggagaaagaccagagagaggtaaagtgcccttttcatcataccgtctccagggtgcttactgcctgtgtgacttaccactctccattacctggctgaggtgtgccaggtttttccaccatgagatgattcttcttcctcctttccatgccatagtcccaagaaggaagtcaccacgtacagcccacacttagccatggggagtgacgcttcacctccgtgagggctgagcagctacgtgagttagttgggatttttctgcaagggagatttgtcccttctccatctgtttgtttattcagtcatctatttcagtatggatttatggatatttatttttgggttataatccagaacaacttcattttgttctttacattattccaggcaatgtgattttgaataatgccaacaaaaaaacaagcaagtatccaaataagtggctgtttgccaagcactattttttcttttgaggcagagtctcgctctgtcgcccaggctggagttcagtggcgcaatctcggctcacttgaagcgattctcccacctcagcctcccgagaagctaggattacaggcgggcaacaacacgcctagctaacttttgtatttttagtaaaggcttggtttcaccgtgttggccaggctggtctcgaactcctgacctcaagtgatccacccaccttgaagaatgagtagagaataccgaatgcagagcacatgatcaaaagtaaagtaaaaggaaagcttgaataggagggagctgcccaggacaatcctagtttagtgttaaaattaagaggcacaaagggaaggggcgcttgattattttaaaagcaggaaggaaagagaagccccggtcctattgttccaggctgatgctgctgatgtcaataaagagaaaacagaactgctcagctcaaactgtactttgttcattatcaaggaaaatgatcttcaaagtggaagaggtaaagtaatagtgattcgaggaaactaaagcccacaatagttgcggagagcacctgtcagcacgaaccacatctcatttctgatccagatgaatcacattctagcattaaagggaacttacaaaggagattcctaacctgttcgtgatattggaggagttgcggagaagaggtctgatttcggaggccagagataaaaggaaagagcagatagatttctcaaaaagcagaggctggggaatgtagtatcaatcccagctgagatttatgaatgaatggaatcggtcatgaattgaccaaaaaaaaaatttacaggagattcacctgcctttcttttgtggctgttgcgtagacggccgtgccatgacaggcacgtctggattccagctagactaggctggcagagcctggcacgaggtcccagaggatgagatgcagagctgcagcttggcagccaagcagatcaattaatatttaaatctcagtcaacacctggagcaaggtttctaattgtgttggatgcctctcgtgggccatttccaaatccattcacatcaactcatagtccagcactcctcactctgtgcaggggcagtgggacggccctcagcccaggaccatcccatgtaccccagcttcctccgccaggggaggatagaagctagcagctacatgcagtcctaggaagatcccactggcatcagcatcagtgggctctgcggcggcagctcaggaacgcgtcctgcgctgactcacccgcccacccgtctccttcctcccttcctgtacttctgctccctggcatcacattcccaaatacactctgccttctggggagccccagctgagaaactgggggtacgccagagcattcttgtgccccacgctcttcagctttggaacaatgacttgaatattgatttcattgatggcatcatctaatttacagatgacttgaaaccaggtgggatagctgataataatcgaaacgcagaaagattcctcagtaggcaaaatttatacataggatcacttgatatggcatcaaggacagaagagatgagagcatgtgaatattctaaaaagatgaaaacgggctgagaacagggagggagaatggcaagccctgccacacatgggctcgtgctcgggaatgtgctggagcagagcagactagtggctaactgagagtttttcaaagcacatattaacaatttctgtcaagtggtaccaaaaaaactgacaataaagacatagtctcttgctcctgtgccttactcttgtcatattccacagaaacaacctgttgagccgttgaaccaaacacactgagtccataaaacctcccaagaaaagatgcgtgggaatgtattacttgaaattttatatatcacttacgttcaacctgtagactgctatgtctagaattctataacagaaatcatttttattaagaattgtgaaggtactaatatcattccatttcttctagctaccagtgctgatcgagagaaatttgatgcttttttaaaatccccagcctttatatatgattttatttttcccctctgaagcttttgtggctctcgctttctacctggtaccctaaaattccatcatcatgtgtcttgtggtcagttcatggtgccgggcaggtgacgtcccgctagaacctgacactcctagtatccagttctctggtccttgcgttgtttcttttttagaatttttatttatttatttattttagagatagggtttcactgtgttacccaggctggagtatggtagtgcagtcacagcccactgcagcccccagttcctgggctcaagcgatcctcctgccacagccttccaagtagctgagactacaggcgtgcaccaccacattcagttaattattttattttttgtagaggcagggttttgctatgttgcccagctgggtcttgaaccccgaggctcaagcgatcctcagcgctgcggcctcccgaagccactgtgcctagccttccttgcattctttcctcaatcattttcttcccagtgcttgcttttctccggaacttcagtgagcagctctgagacccccgagttgatctttaatattcttttcccattgttttttcaatttttcttttcattccactttttggaagattttttttttcctaacccttctagtgagatctgtgtaaaactgggacttgtgtgacttcagcgttcaaggccctgtcagatggctgcccattcattcataattaagagtgactgctaacagttggcatggacataccaagttcacaggtgggcttcttgcttggtgggcttcactgaagagcagtaagccagccatctttttcattggaggccccatgttcctatgtctgttttatttctggagcagtgcatttcctccagaaaacagtccttccatggcaatggtgggcaactgttcttctgaagtcgaaggagtactggggcttggaggggcatggaagatgagttcagggaggagggagtcatgcagctggcaagggaggcctgggcctggacggagaagagtctcgacgaccgtatttcagaagctggacccttcttgacgcagtagatatcagcgttaattttaaaagcttcacagtcaacttaattactgaaaatcagagtgaagctgtgtagaaagcagtgaggcatcagaggaaccagcttcccattctggggaacacagatgttctccttggtatagactgccagagtctcttagagcagctcgggcctgctcactattctaaaaacttacctatgaacattttatttcccatcttttcttatctaattatcacatttgctttgaaatgtgttgaaaatcctattaaaatgtaaactttaaaattaatcatagtttgagcaaattgcgtatcagttaaaaggaaagaaattttcaaaggtactcaagatccctgagcggtttcttcctgcaaattagaactagattgtgttagtcctctttgtatcctgtttattggttaattggaacaccctgtgccgtctataattatggagaattttccaagtatgattttaaattgctttataaacagctccatgcacgtgttcttaagaaagccaagttttagaaggcctcgttattgcaaagaaggtcggcaaaaccacagaagcgtcaggcccctcccgagctcacccaggacactgctctttaatgcattgtacgagtatcatgtccgtttggaatattatatgagatctctgaaggatggaattgagacttcctcagtgacctgcggacaggtcaacagtgtatgtggatgaaattaaaagaataaatctttcatcccagcactttgggaggctgaagcaggaggatcacttgaggcctagagtttgagaccagcccgggcaacatggcaaaaccccatctctacaaaaagatttaaaaattagctgagcatggtggcatatgcctgtgatcccagctactcaggaggctgaggcataaggatcacttgagcctacgaggttgaggctgcagtgagccgtgatcataccactatacttgagcctgggcaacagagtaagaccctgtctccaaagtgaaaaaaagaagaaatttctgttggcttctggtttggtcagtatagactggaaattttaagcatttgttcttcttggctgttagtgctgagcaccatactgaacatcttcaaatactagcctattcaatccacaccctacacctgtgaggaaatatccattagccccattttataacagcatgttgaggctcacagagggttaagtgactgagcagccaccacacagctggcacgggccaaggagcccgcgagaaagccttggtgcttgaggccatcagaaaaacgaagtgagctgctgtgcttatgatttcagtttgagaaatgaagcagtgtccctgttctgtagagatacacattttatgtggaaaacgagaagttgaagtccagtaggtgtagcaccttagctcgttgacaagaagtgggatggcctcttaattcactccacgtgcttccgtgagccttggttgttttatcttctgttgcagaagagataccactttgcacgttaaattcttaacgttctctttgccattgaactgctgcttcactggggcttttctctctataaaccttgccattgggctgggggaggtggcttacccctggaatcccagcactttgggaggcagaggcaggaggatcacttgagttcaggagttcaaaccagcatgggcaacataaccggaccctgtctctacaaaaaataacaaaataaaaagctagctgtggtggtgtgcacctgtggtcccagctactcaggaggctgaggtgggagaatcacttgaacccaggaggttgagactgcagtgagccatgttcctgccactgcactccagcctgggcaacagagcgagaccctgtcattcatacgtacatacatacatcgatccctctgttggaccgatactgtctgaaattaattaattcctccctccatccctccctgccattgaccacgcagcatcagtgtctttcatctcagaattaacttgattcagcacgcgtgatcagtttctaacgtctgtattattaccccgtatactttcccatacatgtatttgccaccttaagaattggtgttaggcagttatttcctgtttgtgttgttcacagtggcctcaccgtaaacagtatctgcagcattttgggggctgaacgcttttgtagcagattagtctgagaatttattatggggaagcaggatgtttttttctgagtctgaagtaataatcatcatatttgagtgttaaacttaaacccctgcttttgttggtatcattcttttaagcctgaggtgtgatgaggctcactgtagtgtaaaaatgtccattaaatctgttggatctatatgtgatcatttgtacaaggtgtaaacattaaatatcaaaatatcaaaatattcacaaactaagctaatagcaatatttattcttgggtttttttaaattattacactatttgaccagagatttttgtgtgtagatgtccactgtgctcagtcatttatgtcttgaagctggatacaatagtctctgccagaagcttctagaaatgtgtccactgaaggaagccctcttgtttggctctcacgtggtctcatctatggtttagatccattggactcattggcccttattagagaaaggcagtccttgataggatcctaggacttaggtcatagacaaggttcgtttactttctgtattgacaattgcaattaaaccatgcaataaatgcctagaatagcatttaattaccgtttagtccattttcatttcatgcagttactgctatagttaggtttgtctaccattttgctatgcgtttttcactttttctattgatttgttcttttattccttcttcactcgatttaacaaactatgtttaacccatttttctcctctgctagctttttagttatacattcttttttcatttttatgggtacatagtatgtgtatatacttatagggtgcatgaaatattttgatacaggcatacattgtataatcacatcaggataaatggggtgtccataacctcaagcatttatgatttctttacattacatacatcccaattattggttatttttaaatgtacaataaattattgttgactgtagtcaccctgctgtgccatcaaatactagaccgtattcattctatctaactacatttttttatccatgaactgcccctacttcctccccgcacccacccccactaccctcccttcccagcctctggtaaccatcattctactctctatttccatgagttcagttgttttcatttttagctcccacaaatggatgagaacatgtgaacttagttatacattcttttgttgatctttcagaggctgtcttacagattacatagcatctttgacttactactttccatcttttaataataattttaccaagtcccaaacaatgcaaaaaatgtatacaaaagttaaaccgtctcctaccctatgtgctattgttatatattttgcttctatataagttatgaatcccacaggatatcattactctggctttatgcagtattgatttatgttcacctacatctctgccctctcctgtgctctttgttccctcctacggttctgtgcaggtctagaatctttccttcagtgcagaggactccttaagtattttttattttttttgagatggagtctcactctgtcacccaggctggagtacagtggcatggtctcagctcattgcaacctccacctcctgggttcaagtgattctcctgcctcagcctcccaagtagctgggatcacaggtgcgcaccaccacacccgactaatttttgtatttttggtagagatggggttttttcatcacgttggccaggctggtcttgaactcctgacctcaagtgatccccccaccttggcctcccaaagtgctgggattacaggcatgagccagtgcacctggcctcccttaagtatttcttaatgctggttggttggtgacaattttctctgcttttttaatccaaaaaaccttactttgccaatcctttttgaaggatatcttcactggatatatgctctaacctagattggcaggttttttattttagcatcttaaagttttctttctcttgtcttctgactttcatagtttctgctggaaagtcagccgtcagcctgcttgttacccttttgaaagccaatgtgtcttttccccctctagctgattttccctttacctttggtttttagcatcttgtctatgacgtgcttaggtgtggttttctttgtgtttatcttacctgggatttgtttgattcttcttgataaatttcagcttcttgttgaaattgacctatgtgcagatgatgtgggaaatgccctcagaaaaattccagaatgaatgtgatgctcaatgcatagccttcttttctttcaagaattgtagctcccagaatccaccccgtgttgatgcactccagggccctcaaatagtgtttcctgtcttttgtacaacttggatagttgttttcaactgtttcattatgccaaactcagaactttctggcataggttttcaatagctatggctacttagggtttcatgaatgatcctcatgaatgtttttaacatttattttctctgctaaatctgtcattttgaagaaaacagtaagcaatttgtgcttttaaaagatgcccctggccaggtgcagtggctcatgcctgtaatcctaacactttgggaggccaagacaggaggatcacttaagcccaggagtttgagaccagtctgggcaacatagcaagatcctgcctctacaagaaaaaaaattatctggacatggtggcatgtgcctgtggtcccagctacttggaaggctgaggtgggagaatcacttgagcccggcaggggcagcggggaggggtgcagtgaggaaacaatgagccaaggtaccactatacttcagcctgggtgaaaaagtgagaccctgtctccaaaaaaaataaataaatacaaataaaacataaaaggtgcccccattcccattctattccaaccagtttagaaaagcaaacttaccagatattcagtgtgttttaaaatctatttacatgcgacttttccactatattcttctataatatattctaggaccacaatcagagatgcccagggtacaaatagcaaaccattcaaatgggcacacctttcctggatgccatttagttacaaaagcagtgtattttggtgcctttttgataaaggtgtgtttcagaaacagttcatgagtttctggatgctgctcagttactgttgctctcccacatcactgggttggctctactcatttcctcatcgtcattctcttgtagtcatttgactaatgtctagaatccctgctatattcaggactcagcgctggacgggttaaaataaatgcgtgaaataattgatgagctccctcaacgcaccagtagtccctatattcttgtgtaggtgaactaggtacatgcatgagcagttccacataaggcaaaatatatcacaataaaggaagaaataggtactaagttattagtcctaaagtcatctgctctaggttcctgcagttgttttcattagtaagttaacaaggattttgtttgttttgtttgttcatttgtttgtttgcttgtttgagacagagtctcactcttcactcaggctggagtacagtggcgtgttctcggctcactacagcctccacttcccaggttcaagcgattcttgtgcctcagcctcctgagtagctgggattacaggtgtgcgccaccatgcccagctaatttttgtatttttagtggagacgaggttttaccatgttagccaggctggtctcgaattcctggcctcaggtgatctgcccatctcggggggcctcccagagtgctaggattacaggcgtgggccactgtgtccagccaacaaggtttttttttgagtagtgagtgagaagagaataatttacttttagttaaaaaaaaaaaaacataaccataccataatgtaacactttttttaaagaaacattttactatcccagcttcttaatgtatcagtttaatctttttttgcttgtttctcattgtttccatttaaacacatatttttctaagtatcataatgtataattttacagttacatttttattgtcatagacctttcttgatatagttatgaaaacatcataattatgttaattattatttgattttttttctcattggtatgctagtatttgataagttttgtttgagaggtggatttttttttcagttttcaagattagaagtaatgtcacatggaacattgttgattcaggaatcccactcctaaaataattcaaagagaaaaagctgttgcacaagcaatatgaatactttgtgattcttgacactagctgtgttagaaaaaatattttctcagtgtttggtgccaccagtggttttataatagcccttgtattaggagctgcaactttaaaatatcggcttatttagcatctacaaatgacactttgttttaatttgcatttcttgggttattaataaggttggacattttccctgtacttatttgctgtctgaatttagaggatcattttcagcactgaacttttggttattaataaatcttcaagtatgataccttatggtatcccaaaagatatttgttatgagtgttaagtgagatatgatatgttagtgcctgacccatttgtgtctggaaggtataaaatgcaaaaatatattgtatctttcatacctttttttttcctcaaccttgggaactgagaaagtatgcttgttttctcattgaaaatactaaaaataaatttttatttcaggtaatttgatacaacttcagtgttttcagatgaattaataaccacatgtaggagatattagaccctgaagtttaattcttttgtatggttttaattacataaagtatgtatgtagacaagagtcttcagatacaataagaaaaaaaaaagaagttaattgcattatttcaatttcaaaaaataatttctaatccctgtatgcctttaggtgtaattcaaaaagatttttgctaatgttaataaattccattatttttagcttatcaaacttacgaaacttattatggaagataactgataagacttggtcaaatatgttaagggtatttttctggccaggtgcggtggctcacgcctgtaatcccaacactttgggaggccgaggtggatggatcacttgaggtcaggagttcgagacgagcttagccaacatggtgaaaccctgtttctaccaaaaatacaaaaattagccgggcatggtggcacatgcctgtcatcccagctactcgggaggctgaggtgagagaatcaattgagcccaggaagcagaggttgctgtgagccaagatggtgccactgcactccagcctgggcaacagagtgaaaccttgtctcaaaaaaaaaaggtatttttcttcctggactttgaaagtatgttttgtttctcctctttttcttcaggttaaaaaggccttctttgctttggtagccaacggtgtccgagcagcgccactgtgggagagtaaaaaacaaagttttgtaggtaagcagtgtgggcctgaggaaaatcgaaaatggaaaccttgaaagcagaaagcctaaagtattttaatagatgccggtttggaattcaacctagtaaacatgtttccaagttaaagaacattcttgctggcagggtgcagtggcccatgcccgtaatctcagcactttgggaggccaaggcagggagatcgcttgagcccagcagttcgaggccagcctgggcaacatagcaagacctcatctctacaaaaacatgcaaaaattagctactcaggaggctgaggtgggaggatcacttgagcccaggaggtcaaggccatgatcgctgcactgtactccagcctgggtgacagagcgagaccctgtcaaaaaaaaaaaaaaaattccttgcttttacatactgggtaagaaggtggacgtgctagtaaggtccaaacactgttgtcctttttttctttttttttttttttttgccgcctcattgagaactctacacactgttgtaacttttatggagcttttgttgttgttgttgttgttgaatttcttttaatttagcaactttttggctctctgaagagcttatgtgtctttaccagcccaatgaacaaaccccacgtaggacaccacagtcagatgtgagccagctgccccactttgggccacacatggcatatggcatccctgggccccgcactcatctcgctagtgcacacctttttgacagggcaaattagatgctgtaaacatgactgatgtctctgccagaccattgttatactgttaaaactgttgtgtaacttacagctatctaaatgccatcgttacttatcttatgaatcacagcagacaatgccattgtctctcttagtattcttcacgttattttgaaatgatcgttatgtctgcttctaggttttaatttcatcagggaagaagttcatgtctttttcatccgtatcatcctggtgtctagcacgtcaaaagcactcaataaatggcaactgttaaaaccattgtgtttagaatgcttcttgggaaacaatccaagtgcccagaattgtcacgtttctaaagcttacggaatactttatcttaaagtacttaaaattatttacctgtaactgcaattcttttttcaaatttgtatcaattaatgagttttctctcattgatttgccaaattctctggttagttccgtagtacttactgtcaggtttaatttcagctaaatttgtatatccagtttggtatacacaattaacacatcaatagttttaaataatatattaaactctgcttgatatcttcgaagtatattttataagctcttctagcatatattctaggctcacttgtcatttgaaatttttaaaaatgttttcatggttttatttgtaacatgtaattctttgttccaggaatgctaacaattacagatttcataaatatactacatagatactataaatcacctatggtaagtggcaccagttcctatgtcagtagttggagctgtacgtatctatgtatgtgtgtaggtatatgtgtgtattttaagatttttaatgttttcagttttttcttttttggtatggtgtgctgatggtgattttccaaatctatataacatgcagggaacttcagtacaaaactctctttactgtaagttatatgtatgaaactcaaagaaggaattctcaggaaaaataaaaggaaatagattctttattcagctttcggaattccttggcttagcagaattctacatatttattagctagacgttctgtaagttttgcttatctctgcgggcctgttgaggtggtagagcttaattcagttaccccagcaattgcagaacaagaattatatgtactttgtgattttaaagcagaaaaaaatgagtcattaaagtgaaataaattccgttttgacatgttcctgctaattaggaagagacagctcctggctgattttagtagcagaactctctggtccctagtacaatggttctggaaagagcgtagcttaaaaaccacttttgtccttcatctaactttgtgatatctgagattcaacctgcttggttttgtgtttttagtttctgtttgtttgttcatgagggtggggggaaggacaggattgcatactcttatttaactagtcctatttggggtacttaaaaggtgtaggttaattcaattaatactgctttatgcgtaatgctcagtattatccaataattcttacatcaaatacaaaaatgagtttcttcataaaacatgctcttgccgggcacagtggctcacgcctgtaatcccagcactttgggaagccgaagtaagtggatcacttgaggtcaggagttggagaccagcctggccaacatagtgaaaccctgtctctactaaaaatacaaaaattagctgggtgtggcagcgggcatctgtaatcccagctactcaggaggctgaggcacaagaatcgcttgaacccaggaggcggaggttgcagtgagccgagatcgcgccattgcactccagcctgggcgacagagggagactctgtctccgaaaaacaaacacaaccatactcttaggaagttttaccaaagattttgtaaatatcctgtatttatttcccatgaagtgtattatttcttcaatattaccaatgcaagtgaacacgggctttccttatagtggtcatatctctgcttttgaactagcaaaatcagcatgagtgtgatttttgaatagatagatttctgtgaaatgcagcaaatcccatataagaaatcttagcagtagaatatgaaatcaaaattgcaaaaaagcagttatgtctaaatatgcagcccaaagtttttcttaatatctgtagatacaggccaggcacagtggctcacgcctgtagtcccagcactttgggaagctgagaagggtggatcacttgagcccaggagtttgagaccagtggggcaacatggtgaaaccccatctctacaaaaaaaaaaaaaaaaaaaaaaaaaaaacccacaaaaattagccaggcatggtggtgtacatctgtagtccaagttactcagaggctgagttgagaggattacttaagcctgggaggttgaggctgcagtgagtcatgatcgcacttgtgcactccagcccggatgacagaatgagaccttgtctcaaaaaaaaaaaaaaacttgagatacatttttttctctatatctcacctcactttcttttttttgagacagagtctcactctgttgcccaggctggaatgcagtggtaccatctcggctcactgcaacctctgcttcctgggttcaagcaattctcctgcctcagcctcctgagtagctgggactacaggcacccaccaatatgcctggctaatttttgtatttttagtacagatgaggtctcaccatgttggccaggctggtctcaaactcctgacctcaggtgatctgcccaccttgatctcccaaagtgctgagattacaggcatgagcaaccgcacctggccgcctcattttctaattgcgaatagaaaatgctattatccaagctatgttttgtttcattttccaaatattttttctatgttgtatatgtatatttataaataagaatttttttatttgcaggtacagatttatgaattagaggaacataaaattgaaacatggaggggtaagcactattggatgtttaaaatcttttagtatcgggaaagctatgtttagtatgaaaagtatgttttcattttgcagatccttttctctctgctccataaaatgttatataaaacattctctttatttctgttaattttgatagtatgctactgtactaaagctgaacaatataagtattgtcccttctgtttatagacatgtataggacaccttcagcaggcaaggccttatcctagggccaggaatgtgaagatgaatgagctaaccaagccccacctcgctgcccacaatggggccaccgctcactactaagtctaagccctcagagatttgccttggtattaagaaatgcatcagaggcatgcctaacttgaaccaaagcaagcatctgttcttatttaaacctagtaattgtttctttacaaattgtggagaaacttaggacaaatgaacctcaaactagatggtttggagcaaatagcatggaagtaatttgaagaccatattctcttcattgtcacattgacattcaccctgtaaaatcatgatactcttttctgccatagaaccatttcttaaattcgcatttcatgattgtaaggtggtggtctcactgacacttgtcatggtgggttggtggagaggaccgggggtgggaatcacggcagacccagtctgtctgcaacagcggagcctttggagggtgctcaaggaaacactggtagaaatggagggaccaactgaaggaaaattttgaattcaaaattgaagagtttggttctgtgtttcccataatatgcttgataggagaagcaacctttgtagctggctgtgaaatcagaatacatcttggagttctcttacacccccaggggccctttcaaatccatacgatttagaagtttcactgagtgatgggtttggtttattacggctttgtcaaaccaagctaaacaaatttggcatgggatctgtacagtctgttgtgcagtgattgtgtaacaccagcttcttgtccagttctactgtacaagtactgatagaccaaggtttaagtatgtttacgttttgacattacatgatattttgtagtaataataatgccaaaatattcttaaacgccttctgtatagaaactttggtaaagcaaggccaggtgcggtggctcacacctgtaatcccagcactttgggaggccaaagcaggtggatcacttgagatcaggagttcaagaccagcctgaccaacatggtgaaaccctctctctactaaaaatacaaaattagagccaggcgcagtagctcacgcctataatcccagcactttgggaagccgaggcgggtggatcacctgaggtcaggagttcgagaccagcctagccaacatggtgaaaccctgtctctactaaaaatacaaaaaagtagccaggcgtggtggtgcgcacctgtactcccagctactcgggaggctgaggcaggagactcgcctgggcctgggaggcagaggttgcagtgagccaagatgatgctgctgtactccagcctgggcaacagagcaaaactccttctcaaaaaaaaaaaaaaaattaggctgggcacaggacctcatgcctgtaatcccagcactttgggaggctgaagtaggtggatcacttgaggtcaggagtgcgagaccagcctggccaacatcatgaaaccccatctctactaaaaatacaaaaaaaattagcagggtgtggtgacgtgcacctttagtcccagctatttgggaggctgaggtgggagaattgcttgtacctgggaggcagagattgcagtgaacccagatcatgccactgcactccagcctgagtgacagagtgagactgtctcagaaaaaaaaagaaaccttggaaaagcaaattaattgcagttgatatcttcagaaaaaaacagtttttatgtgctggaaagatgcccacaatgcagtaggttttgagcatcaatttggtaaaataatacttaaaaatatttaaagaacaaagtttgtcataactgattttatcttataacttatggaaattgattttttaaatttcataattgcttcatttcttgagagtaaggtgaacctggtagcattctagtgacctctgctggtattgctcttttatcagatttctttgtttttcctgattttataaacacttactgtcacattgttttttaatatttaatttttcttcaaatgcaacatcctgaaaacagtttggaagttgtttaaaatagccataactatgattaacacaggagttttaggcaaattaaatttctttttatttgagtttttaatccttctaactattaaccgtaaactgaagggtatttgaatttgtgttataactgcaaacagcaaatgtgttactaactgcatattttctttctataaatacagagctttatttacaagaaacatttaagcctttagtgaatatatctccagatgcaaggtaaacttgttttttttttctttgaaaacattcattcagatgtatgtgttttatcaccatgatagaaagaaagacacaaataaacatgttcttcattccaaacagggcctgcctccttaattccagctacactgtacgcattcagtaaatctaggaacactacaaaaatcacagccgttgctggtgctaaggatggataatggtctagtaatagggtcatactaaaccatcacgaagatctcggccaatctggggggcgtgttgaaattgcagattcctgggcttttacccctgacctgctaaatcaggatagggcccaggaatacacatttaaacaactcccttggcaattctgctccacactagcgtttaaacatcagtgtgtgttagatgtcggttcagatgtggtgagagcatgggctgccttctgtgtagtcgtctggcccgtccttttttatccaagccttctggtttggctgtgatacatttccatattggtgtaaaagcatctttcaaactcaaatccagtacagagaaagattaaaatatttattttcattttatttccaagtcctaacaaaaaggtataacaaccttcttactggcagtcccaggagagggaccaagtagaacagaaatgttggccctgcaatatctcctagccgggccggcccggggtagagccagtttgcccactcaccaatgcagagagcttgctgctacagcctttgctctcttgccaatacgatgtatctgtttgcttttctaaggatttaggtttcatcgtctttcaaataaaatcactaaatacactctttaaaaaaactcctcttcctggctgggcgcaagggctcatgcccgtaatcccagcactatgggaggccatggtgggtggatcgcttaagctcaggagttcgagagcagcctgggcaacgtggcaaaaccccatgtctacaaaaaagaaaggtggcgcatgcctgtagtcccagctactcaaataggctgaggtgggaggatcacctgagcccgggaggtcaaggctgcagtgagccatgacggcaggcaacagagcaagaccctgtctcaaaaaaacaaaccaaaaaaaatctcctcttctagagatttgtagcttgcacttgtatttgagatatgttaacatagattgtgaaaaatgaaaaatttgctgagatctctaatttaaaactcttccaaaacactgttattattgcaataataaaaacactggaagtgctttaaggcaggggtagtccaaagtgttctgatttttctcgaaagcctcctaacaactttaatgacttctcccacagcctcttcgatgctgtatactccttgatcaaaaataaaatccacagattgcccgttattgaccctatcagtgggaatgcactttatatacttacccacaaaagaatcctcaagttcctccagctttttgtaagtagtttttagcgtttctaaagacataattgcatttacttattaaataatgtacttcaagtaaattggctcctgttaccctcagtagaagaaattgttagttttgaggtctccctttctaaacttcagtttctcaacttactactctctgaattgtacattcttaaagttgattccaatttaaaagaatcaccttttagtgcaagtatcaaaacaattttaacaacaaaactcggcattctctctttaaattaaaacatttgtcaccagcatatgaggggaaataaggcaatctgcaagtctaattgaggactgttgtacaagataaactgaactaatatctagagcaaaaattgctttatgttgcttttactggtgtcatggttttagaaacatgttccaaaaaatgctttcctcaagattatcttataaactgcagcagtgatagaaaaacccgaagcaaataaaattttggcaagagaataccatgttggtccaaataaggcctgtattaacctgtaggttttctcagctacttgaaatgacctggctccgtagtcatccagaactttgagcctgtttggttggaaacattaaaagagactcaggaagaacagagagtttataagaggctttttatgtttgtcttttaattacatgcatggaatttgaggttgtaagtaatcagtcaaatagaaccagtagaaggtcttaatcgttctgaagaggtactttgaagagttgtttttccaagactgtaacagatattaaaaatgtacttcaaattagctttcccattttcctccccatggcttcacctaaggacctaacatagcgttccggtgcagtgtgaaggagctgaagctcctgccctggaggcagcttgagggaccccttttgctgacagaagcacagagggcttagtgatggagagaaataccttgtcaatcaacccagtcttgtattttaatcatttacatatataaataacatttatttaaccatgctgtgctaagaaagaaggtagggaagagtaatttacaaaaaaactcaagtctgaagtttaataaaggcgataatctaggaaaaagggattagggatgcatccgcattgtttatcagactggacatctgggaatgcagccgctttagtagttgaagtttaataggaacagagggagcatggggtgggaaggatgtattcagggcccccacgtgccaggcctgcagctcacttaatccttagagtcatcatttttaaataatattaatcatgagagctgattactgtatgtccggcactgttctaagcacttgacataatctcatcctcgctgctaccctatcaggtaggtatttttattaatcctattttatagggatgcagctaagaaaggttaagtagctttgccaaggttgcgtggctgggaagcggtagagccaggatccctttcaagcgttcctcactccccatgcttttctccacgcaggggccttgggagggaggcgtttgcataccttgcatacacaggacacctggctgggaaacgtgcccccagtcatgtggatactaagtggtagattgcaaacccgggagtctctctgactcccaagcccaaactatttctgctagtgtgctgttgcacaagagggagtaaaagcgtgagatcattcttttgcagagctgcttcagatttttatcttctataaaaaggagaggaagttgcctctgcccagtactgcctcatatttgggccaatatggtaattagaatcatgctaccagaatattcagctaactaaaggttttcagttaaaaatatagaacttaaagacatttcagagcctgatttttactgaattatgagatcattttctgagaaaaaaggagcattacccttcaagacgtttgaaaattagcctaagcctatagtgtgcaacagggaattcgctatgttgagatggactagatgacctaatagggctttctttttttttttctctaaatttctaggagtctcatgatttgaatattgatgaactctttgacttgaacattttgtttcttctaattgttcatcttttcctgataattataaggtacaccaggaggatggaatcaactataccctttataaaaggtggatttttgaaaccgtagaccttattttgttatactcaaacatgatcctagacttttctctcctgccatatccctcctcctttaaaacagcccatgaaaagttaatttttaaagattcttttaattctgttcagctggcttctttgttcctagtagacaaaaattggagctctccaaggagaattcaggatgtagaggcgggtggcgtgaggactagcttagcagtggctcagacagctgccgtcaaatgctttgggtttggaaatgtataggttcttaataaatattacttaatcctgacagcaggaccaggaatttaacatgaacaattaagaataaaggattcaattcttcgtggcttacaggtcttaatatcccaaatagacctgttcttccctggttctatacgcgttcttagtgagtgaagaggagatggaaaaagattacagtatcaatgctctgcaatagtttgtgaatagttaaatagaagcatagacctacaaactggttcaaacaaaagatacagtcctttgtaattttctcatgttaattcaggcatccaggtagactgttagaaaaaactaactttaatttgttggacatactttttcattcaaatctggacctttgaacatgacaagagtgtgttctgggtctagaacgtttgcgtttatcttccgtttagatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggtttgtgtgtttggcgctgacaggcagaaataattgtttatctcagggtgcaattattgtaagatgacctggcacaggagatacgtggggaaaatgaaaacttgggtatggtgaataaattcagcaccaaggggcacgcaggatcgtaaaaaaagtttaattggtttattttcatatgtccattaaaatatgatttcatatctaagttttcatttaaaatagacaaggttatttatcagtgtttaacttttagtaattatgtcattaaaactgattttaaatgaatttctttttgtcccttaagacatttttctaacatatatttttcatttttaggaaaagttgtagatatttattccaaatttgatgtaattgtaagtattttaattttgttcaatctgtcacctagaatgcattttaaacattcatgtaatgtgtttttatgtttttatcttgtttcttaatttaataatttctaaccttttggggtgtgaggatattatcagaattttatagaccttctatagtaattgtacttttaatctgcattggtttagcaaccaattatatattagtagcattttataatttttcatctttacaatacatgcatattttatgcactgccacagcatgtgtatatattttaaatgttcttgtttccacgtaggaggcctgatttattcgcctctagacgcgtgcgcagtgcacacgtggactcatggctcctttgtcgggcgcatcccattgcttagtgattgggagccactgttctaaagaagaaaaggggactgacactttatagccccaaatgtgcacgccattttttgccacaatactgaccccacattaaacattcttctgcagctgcctcaaaccctttgcttcacactattatgttaaacataacagtcaccgagaaatatgctgatcggcattttggttgagtgggacccgctaaaatgaatgagagccccatgaagccatttggatccatggggctcctcaagcctgttcttcctctggttgcttgatccccatgggtcccccaaagccttcccagcagaaaccttgttccccagggagcttgttgagaaggtccgttgctgcagcatttctagccctgtggcactcaccaccctttacagatgtcagcccaccttgccagagatttcatccatgcatggtagagagcattagagggtaaaaattggggggcagtctttggcaggatatactgtcaaagtttaacaatgttgcttcgtaaggaaggtagaccttgtaacatggttatctttaattgtgattgatatgttgacaaaataacagtagcaatggcatgtcgtaagccagaaagaacgtctgatgtatgcaggtactaaattcagataagcattaaagtttttagaaatcaggctctcttaagctcactaattttggtcattgaagtgaactgaaatgaaaggatataatttattctcttgcttcattacagaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtgagacggctttcccagtcctgctcccccgacgtccactgcaacaagtccccagtagtgaatgatgcctctggaagcctgaatctcaggaagggcccagcgaggcagcctccaggttcagtcgatgggattccctcctgtcccagaacctggcacactacttggcatataggcgatctctaaaagtttgttgaattgaattgaatggaaaagtcctggtatcataggtgaatccaataaactggtaagatacattcatagtttaaactatatatgtttgacagtgtggacgacataataagaccttgtctctactaaaaataaaaataaattagctgggcatggtggcttggacctgtagtcatagctaatagggaagctgaggaaggaggatcccttgaatccaagagcttgatatttcagtgagctgtggcggtgccactgcactccagtctcgacagcagagcaagaccctgtctctaaatagatcgatgtatctgtatctatggatacattttgttttgagaaaacaaaaatcccagaagctttaagttccatttgaatatttatgaattcaaaatttaaagtgcgtaatatatattttaacaaagtgaatgataagtcagtaaaacttttttctctcttcccaccagtatctctctttcctcaattagataaatagcaaataatctagtaactcccagtttcctgcacctcagcagtccaatttccttagactttactgcttataagattttcaaatgtactttgtgtaacaccctaaataaaagactccgcctaaaaagaaaattccttcacaagatgactcctcacagaaggaccaaaaaaataacagtttttagctttaatgtagctaggagaagggtgtacagtatcagtgatgattccatttgtttatatgacataaatagaacactaacttttaggtacctccaacaaaggacatacataagtttgactcagcagcagatgacaagaaaatacgtggggagtcatttcagtctgagagaactgcttaattctctggatgagatggtttcccttagccttcagagttcaaaagatatctgtttaatatccactattttttttttttttttttgagacggagtcttgctctgtcgccgaggctggagtgcagtggcgtgatctcggctcactgcaagctccgcctcccaggttcaagcgattctcctgcctcagcctcccgagtagctgggactacaggcgcccgcctaattttttgtatttttagtagagacggggtttcaccttgtcagccaggatggtctcgatctcctgacctcgtgatctgcccgcctcggcctcccaaagtgctgggattacaggcatgagccaccgcacccggctaatatccactattgaatgtaaccaataaaatgtcttcagtgtagaagacaaatgtgaactatcattttaatgtgtgattatagttagcaaataattgtgctgtgttatatcacaggattactgatgaacctgaaagcttttttagagaaacatttaaaagaaatttatgttgactgccacgggaaagatgaccaagccattattattattattattattaacctaaagcaacctatgacagaaacatcacccaaacagtattatttgagacaaaatacaaaaactggatttccccctcttcctatctccttcctatgtccctgttttctatcaggggtatcactgttcaatacagagagggtctcccagggcgcagccggcacagagctgccgtggcccaggttctgaagcctttttttttttttttttttttttttttttgagacaaagtctcactctgtcgcccaggctggagtgcagtggcgcaatctcagctcactacaacctccgcctcccaggttcaagcgattctcctgcttcagcctcctgagtagctgggattacaggaatgcaccaccacgcccagctaatttttgtggttttggtagagacggggtttcaccatgttggtcaggctggtctcgagcacttgatcttgtgatccgcccacctcagcctcccaaagtgctgggattacaggcgtgagccaccgcacccggctccaggttccaaagcctttttttttttttttttaagacacagtctcgctctgtcgcccaggctggagtgcagtggcacgatctcagctcactgcaacctccacctcccaggttcaagcaattctcctgtctcagcctcctgagtagctgggactacaggtgcccaccagcacttctggctaatttttgtatttttagtagagacagggtttcaccatattggtcaggctggtcttgaactcctgacctcaggtgatccgcccgcctcggcctcccaaagtgctgggattacaggcgtgagccatcgcgcccggccatcatgaagcttttaagagaatagcaacgccgctcccttcctgcgggtgaaaggcctgttacagaaacacctcaaaacgctctgccgtcactcatcagagatttcagagtagaaaactagagatggacgtagtctatcccacttcattatagctcatttatcctcttggatgcgattcttaatatatgaacttcacagagaaaagacactgcagaaaataaaacccttgtaagagctgcgaccttgtttcttcgtttctgtcatcatctggacttctctcccatgtattaataagacaagtacctgatagttattagaaactgatatacaacttttagaaattaaaacagttatgtttaacaatgtatgatagctacgttgtgtttcgtgtttgagttgtatcttttctatattaatattttgaaaattgaaaactcagcagggcatagctagctcatttttcttaaaagtaagcaagcaaatcagcttgaattagagacaaatcagtatcattagagacaggagatagatagctttcccctctttccttctcatgcctgtgtccctgtttttcaccagggctgtgactttttaatacggagtaggtcttccaggtaatcagacagtaacacattgaacattagagcctaaggtcatcgtatgggtctgtctgtggctactttccctcatttattcatttatgggatgtgtgtgtgtgtgttgcttttttctttttctgagacaggatctcactctgtcacccaagctagagtgcactggtgcgatcttggcccactgcaacctccacttcccaggctcaagcaatcctcccaccaagtaactgggaccacaggtgcacaccagcacacccagccactgtctaatgtttttgtagagatgatgtctcactgctattccccaggctggagggatgtgttgatcatataaaaacatgacaggacattatttctcatgtccattttaaaccttttttaaatgttaattttcacgtgtcctgcttttctctttgcaggtccatcggctggtggtggtaaatgaagcagatagtattgtgggtattatttccctgtcggacattctgcaagccctgatcctcacaccagcaggtaaaatgctggtttctgacctttgccatcggcgtctaggaagggtgggaggtagaacaggaagtgcagcatttaaaccatcatttctccacccacctacagatcaaggctttgagtatattactttgaaaccattttcgttttctcttcagttgggaagtttaagtgttctgcgtgagtgaggaaagtgtatagaacgtattcgaagttaagagcatcctatcaaggtccagtggccccctaaatgacttgggagccattgccatgttcatcataaccttttccactgaaaagacctcttcaattgtgctttgtgagagaactagtgaccagaaacatagagggaacgtcactggcttctatttgataccttcatctttccttaaagagaaaaaaaacttatattttgagtagataaaacagaatacctaaacacaaacttttattcattaatattgtacagaaatcacattcactttcagatagagtgtggttaaactcattttttgacagattcactttgagcaagccttcagagtctcagacagtgaggagcagagagaacgggagagggctttagacaagaggagctggccttcctctcatttcacacactcagtagtaagaggtgggcttgagagttcttaaaactgccagccctcccttccctcctcctcttcccatccctccacctccccagccccagtcaaatatgaacaacccagcctttgtcagggccacatggacccgatgtgggagcaaacagcatgccctttgaactctcagaatccaatattaaacggtgtgtgtgctacagtattgatttctctttagttcagaaatttcagttaagactagtttttacaattaagtctgtaacccaaaaatacctaccctaaaggaatcttcaccacctgcaagaaacatgtcttattcgctaaatgagaacaccaagagaaattccagtacagcagtgatttttccgaggtggtcctcaggccaggcatcatcaccaccacctggaatttactagaaaatgaaatgttcatgttggggccccgtcccatatccactgaatcagaaactctagaaatggggcctggtgcagtcacttgcaaacttcaagtgtttaaaagacctgaatctcacaatagtctctataatcatgaaacattaagaactaaacgaatgttaatgccataaaactgggaataatccaaatatctttgaaaagaagaatggataaattgtgtcacattcattcgatggaatacgatacaggattgaaaacgaacagtacagctgcattcaacagtggaggaatctcacaggcaacattgaacagagggagccaggctcatccagaccatcattaaattcatataaatttccaggcaggcataactgcacagcacatttgtgctaactagaaaaggcctcttctctgggcagatttatccccacaggtatatagcttggcaccttcagaaaaagatgccccgtttccagccctggaccacgggacacagtctgcccagcgggtcaggctgaatgtcagctcttgtctgtctctttgggcattacaaaaagagtaaacaagtcaagcgattcatcctctctgtttcttgatatctcaaaccataagaatgaacggttgtgctggatgagttcaaatttccatccagaattggtatttcaaaaattctaagtcattgcaatgcccctcccatcactgctggtgcagagaggaatctatttccagctggaatttggaatgtatgttaccatagaaattgtgccgtgaagatgggggtagctgggttggaattccttatgatacagtgtatacaacacgatttgttgaggaaaacattccgtgttactaataactggattacaagtgaacttttggagtggaactcagggagcgcctgcatctgatcaacaatcgcaagtgaggaggcccccaccgtgaggccaagtcccagctgtcccacccgagcgctgtctgaatgtaagcaagtcgcttcacctccttcagccccaatttcttcagtagagaaggagccggctgatacaggcccgtctccctcctatgttgctatgaaaagagctgaaagccgtgcacaaaagccatgtgtgtgcaatgaggcgcagtgcccgggacctgcactgttaggtggttgtccatggaatagtcagtaagaggcagtttgatgaagtgtctgctgttactcgattagaaggtactagtggtgattcttttcatcgggcaatggccaccgttccccagaggggtactggttcaacacaataacactttctctttctcaaaaaagtttttagcaacagttcattgtcaaacttagactgtccaaatgaacccatgtgtgcgtgcatccagtgtgtgggcagtctgatgccaggagctacagtgtttcagccacacactctaatagattgccgatctctttcaggggtctagcgtctggtgaaaaattaggagagaagctcctgtgatgagaaaaatagtagctctccctgccaatccactgtggaatgtcctagccagatacttgttaggtgcaattatccttcagaatatttataaaggttttttttttgtttttttgttttttttttttttatttgagacggagtttcactcttgtcaaccaggctggagtgcagtggcatgatctctcggctcactgcaacctccacctcccggattcaagcgattctcctgcctcagtctcccaagtagctgggattacaggcacccgccactacgcccagctaatttttgtatttttagtagagacagggtttcaccatgttggccaggctggtcttgaactcctgatctcaggtgatccgcccgcctcggcctcccaaagtgctgggattacagatgtgagccaccgcgcccggcctaaacctttttttaatacatatttgtaagagtgcacaactgaaatacttcacaccttcactaaaacatacctacatatttcttagtaaaattttttaggagtggaattctttttttttgttttccaagttaaatctgacatatttagaatgacaagatgttacgtggatccaagctgcccgaacgattgggtgggagatgggagcttgggctacctgctccttcccacgtcgccctcctccgaagcctctggatcatcctcctaaggcactgccagacacaggtagaaacccctggggtagagaaccctgctgttaccatgagctttgaaactttcatcttccatccactgacaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacgataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattttaatgacacttttacacgtaagtgttttgttctgggctaccgtgtcaacgaggctgctttacaacagctttatttatttttactttcatgcaatttttttacacatcttttggtggagtaaacttcaccacatccatgaataaactctcagttattttgaaatggcaaatttctcattatttaagtttggatctggaaaggacatgacttctgaaatagccgctgctgggttttaaaagctgaggtctctcaaagtgtggaggagacgttgccgtcaggcgggagccaagtgccgggaagatgtctattttttttcttgtgtattgaaatgtaaaatcatgatgtttgttatgactgctgatgcgattgtttttgtaaattttattgtggcatatacagtattgtcatacagttgaagagaaacaatgtttcctaatgtaagtgctctgaaaatgttgacactgtatatatatatatgaggatagtttgtttttttttgttttgggttttttttttttcagattgaaaaattaaaataaatcctactatctaccattttgttaaagaagttatttaaaatgccttatatttcaacacctatcgattaaaattctacatgcagttttccacttagctatttctccccaaataaagaagtacatgaatttcatctcttttccgttatcaggaaaaaaagtcagggtttaattcataaactctctctctccactattaagtatgaatatatgtatttattatttttattttattttattttatttatttttttgagacagagtcttgctctgtcgcccaggctgaagtgcagtggcgtgatctctgctcactgcaacctccacctcctgggttcaagcgattcttctgcctcagactcccaagcagctgggatcacaggcatgcaccaccacgcccagctaatttttgtgtgtgtgtgtatttttagtagatacggggtttcaccacgttggccaggctgatctcaaatttctgacttcaggcgatccacctgcctcagcctaccagagtgctgggattacaggcgtgagccaccgtgcctggctgagtatgaatatatttaatttaaaattgccacacaggttttttgcatgggtgctaaggtatcaattttttcatttcctagtaggccaaatatgagagggagagcaaatgtgtatgttttccccatagaaacaatagtggttgtgatttaagctaatggtaatatttgggagaaaggaaaaagtcacaaagctgccaaaacaacacaattttgaaactcagagaatttatcaatctgctccttgtttgtgtacccaacacatgagtgtctgcagagtacatatctacatacaggtgacgtggcacatatataggtacagtcgtgggccatgtacagatgcttcagtcaaggacagactgcatatatcacagtggccccatgagagtatcacagcagcattttgctgtaccttttctatgtttacatgcacaaataccattgtgttacagttgtctacagtaacatgctgtacagtttggtagcctaggagccataggccatacctataacccaggcatgtagtgggctgcaccatctaggattgtgtaagtacactctatgatgttcacacaaagatgaaatcacctaggccaggcgcagtggctcacacctgtaatcccagcactttgggaggccgcggcaggtggatcatctgaggt

SEQ ID NO: 14133 - DNA, 98962 bp, Human
  misc_feature (1)...(98962): n = A,T,C or G
attgcttcttctgccctattgtttatgtaaaaatgtagattcactgagctagactaaattgtgtattcagtggaaggttgatcaaggactcaaaagaatgtaacctcttctgtttcttatctacttataacctggaagcaccaccctttctgcagcttggagttgtcttgccttaccggaccggaagcaatgtacatcctacacatattgattgatgtctcatgtctccccaaaatatataaaaggaggctacacccccaccaccctgggcacatgttgggacctcctgaggctgtgtcatgagcacgttcttaagcttggcaaaattaaccttctaaattgactgagacctatctcagatatttcgggttcacagaaagatacgaattttacagcagctggagactaacggagtcccaaacgacattaatggccagaaccacttatttgatttccctcatgggtgcccatgagtagggtttgatagacctacctacccatcatcttcaggagtgcctcgccctctccaacacttagcacttctctagtcaacctgggtttgactaaagaggctcagaaaaaggaacagatggacgaggtttgaggctgggattctacaacgaggctttgctaaaacttgctgagggatcttaggcaagtcatttctctctcattatcagtttctccacctggaaaataaggtgtgttgcatcaggctctggagttatacggatgtgggtttgaatctaggcactgacattagctgtgtaatcttgggcaagtggtttagcctctcaggtttgatttcctcatttctaaaacagggatagtactagtacctaccccatgggattactgggctaatgaaaagagataatgtatgcagagtccctggctcataaaagttattttctccgattaattaaataagtgaatatgtgtaaagtgctgaagacagcgtttgacacttagcgttttatcagtcttagctatcatgattttcttattctagtacatagaaagtcctcaataagtaacagtagttattattatttttggtcacatgtccctgtgtttccctccaaaaccctaaccatccccaattctggttttctccccgcatgcagcccaagggttttcacgtcccagtgcgattgtctgggctgtttcctccgcctgatgttccatttctcctcctcccgatctcagatggcttctcctctgggattcctctggtcttcatcactccctcctcccaggcagaaggaatggctcctggatttgtgtcctgcttaaaaaaaaaaaaaaaaaaaaaaaaaaaaaaaaagaagtccatatagcacttagttctttgtgcctggcggttgggttaactctttctgagcctgtctccgagagtggcggcccccgggggacggcgctgggtgaatcacctctgagtgtcacccaaggcgtctggcacagtgcgggacagtaaacgggccgctgtgcggagaggggtccagtttaactcctagaagcccgagtccccgaccctctacaggccgcgttccaccacaaatccctcctcctggggggctcggattctcccttccccgcggtctccctcacctgagccagcccgctcccccgagtctcgccagctcctccccggcccctccctccagccccctccgggctggagcctcccctcctccatcccctgcggaggcccgggggctggaggcggacgtctcgggagggctgacnnnnnnnnnnnnnnnnnnnncacccgtccgttctccatctttcccgccttcctcaaccctcgggtgaccttccttcttcatcctgcggagccccggggctgagcggagcgtctcgacagaggctggagcgggtggggaggcgcggggcgagccggggggttccagacgcgcctccaccgccgggcagtgggcaggtatggctgagggcgtgtgagcgccgagcgctaagggccgccgccaccatgccagggggcgcaggcgccgccaggctctgcttgctggcgtttgccctgcagcccctccggccgcgggcggcgcgggagcctggatggacaagtaagtggccaggcgcggggggatggaggctgggtggcccggagacctgggagtagccttgcgggtccggagcgctgggaccagcagacccctgcgcctcccgcaactccgcggggcctgcagcaccccgccgtccccagcctgggagcccgggctttgttcccacgttctgcgccctgggaggtggcagaggtcggggaaacccggcgcagccagaaaacagccggtccgctcactggctagccttcccttctcgccttctccttcctctgtttttctgcttttggcttctctttccgccgttctcggggcttatcctcctccgttttctcacggtccctcgtgtccgctccgcctctctctctgtctttctctctaccgcccgctgcactcgccaacgccgagcatcccgagcgccctgcccgtgtggcctgggagcggcttcctgggaccaggctcggtgcctgccacactggtggggtaggacataaaatgcccgcggcagactgtggtagccttggctaggggatggctcgctgggtatctgcagccacacacttcggatccccgagctggcaggagccctactgaaggccaagtcaaacgcacccatttcacagatggggaaaccgaggcccacaaaagggaaaggacttgcccaaggccacgccacgggttgaggtccgcggtggcactggaaaccagggctctctttccacgccaacccgacggccgccttctttggtcctcagtttccccttctgtgaagcgaaggggtctgactcgatgtttccagctaagatgccgggtgatgtccgtgtttctcaggactagtttcccagacaccaatcccctccccggctccatccctcgggggctataagcagatttcgcggaaggcttggtcccggggggcggtgcccgggttctctcattatgaccggagaaggcttagccctggctccaccgctgcagacgggctgggctgactccagactgctgcttgggggaccaacagtcagcgttttcaaatagagcgagcaccggcggagcgagggtgggctggctggacccccgggccgcctcaaacccagaggctgagagctcttccgacagttcggaacttccaggggccgaggtcgggcggtcctcccaaagggctcaaaggaaccgccctttgagctgttgttccgaaggggaaactgaggcacagaggaggttctagggtagcaccaggcctgtgtcagtgcttagtgcaggagaaaagcatgaagaaagacaaggaaagctagttactgctcctagcacaggcgccttctctgagttttgagtccttggagaacacttgctgtagaatatctgggaaataacgaaaagtgtaaaagaaaatgatctgcaacccccaaatccacagttgctgttgatattttgttttttttcccctccacattctttgtgtgttcctatggatatatattgataaaattggaaccatacccataagtacagtttcgtgtcttgcgtttttcacttcacaccatgagcgttttccacatcatcaaattctctgtaaaacatgattttaatgactctatacaaagttttcaaaagttaaaaacacgactcatacaaatgtggccaagatttattcaactcattaatgaggtagcaaacaggagagtaaagctgattcagggagcattagaaaggggtgatacaagcattggagaaagaatgttgaaatcatgtggcccagggcagatgcagaaatggtggatgccccatgaagcaaaccataattcttggttatctttcttttttaatttccttccttcattccttcttttctttctttttttttttttcagagtctctatctgttgcccaggctggcatgcagtggcacgatctgggctcactgcagtctctgcttcctgggttcaagctattctcctgcctcagcctcctgagtagctgggcttattggcatgtgccaccacacccggctagtttttgtatttttagtagagacggggtttcaccatgttggccaggctagtctcaaattcctgacctcaggtgatccgcccgcctcggcctcctaaagtgctaggattacaggcgtgagccattgtgcctggccaggttatctttttactatgctgaaatcacttacatctctgtcagacagaattctatagatatatatagattatataacttcacagagtgtagcttttaatcaatggtaaataaaaagtcaatggtacattcccctagataatgcagtaatccatgggtgagtctgttaaacaatgctctgatacaacattgagaagacatcttgcttgctcttgccttatttccaagttttggagaccttttcttaacatgtactatgttcctcttttggtgagattttagattgctttcactatttttttacaatcgtagatatcatttaattccattaaatgctccattaaatattatagaattcctttttgtttaaaataatatagacttatcagagccaccagggcaagagcgatgcttgtcttttttttatttctgagatggagtcttgctctgtcactcaggctggagtgcactggcgcaatcttggcctcccagattcaagggattctcgtgcctcagcctcctgagtagctgggattacaggcatgcgccaccacacccagctaattttcatatttttagtagagacagggtttcaccttgttggccaggctagtctcaaactcctgacttcaggtgatccgcccacctcggacctccaaagtgctgagattacaggttgtgagccaccgttcctgtcctgcagtatgcttgtcttgttcctccatgaatattaagcacctattcatagcatagtacttggcacatagttaagtactcagaaaatatttgataaatatatgaatgcattgtttctaatatttgcctgtctgatgaattggtgttggtccaataagattatttttaaaatctatgttgactgcaagtgcattatatcggtattctgaagagaatgttaataattactcataatcaccactctaacagaacaactatggccatctttttatcattcatattctgtatgattgatgtagttagtttagacagaatagattttggagtcctcagccccattcccaggaacactacggagaccagtctgtttaggtgtcgggaaattaccattttgttaagatagtctgccgccagtatttgagttctgcagcgccctgaacaaatctctcctatagtttaaattctctttcttgcaaaacaggactcctcccagtctctagtaaaaatacaaaaaaattagccgggtgtggtggcgggtgcctgtagtcccagctactcgggaggctgaggcaggagaatggcatgaacccggaaggcggagcttgcagtgagccgagatcacaccactgcactccagcctgggcgacaaagcgagactccgtctcaaaagaaaaaaaaaacaggactcctacttcctacttcccagggttgccttgagcatgaaggagaactggtttgggagagtgatttgggaagtagaaagtggaatacaaatgtaaacttgccattaggaagctccaattaatgtaacttgatgcagtgatgctctgcggagtaggaggcaatttcatattgactcttcacaataaagctgtgagatgggcaggtagcatctttgtcttcattttacaggcaagaaaactaaagctccatgggagcagtattcatgggcttgacctccagaatatgcccagaatcccaccgcttcattcctctccactgatgtcattctaatctgagccaccatcatctctcaccagggctccagcatatctctagcctggccttcctgcttctgctctcactctcgccgctctgcctcaccccacccccattctccaccacgcaggcagagtgatcttttttaaacttaacacagatcatattgctctgtatttaaaacacccagtgccttccaagtctatttataagaaaatccagacactctccgtggtctctgcattatcagacccatggctgtcttgctgaccacatctcataccaacttcctctttcatttactagctacccctaccttatgcttgttccttcaacaggccaagttcacttctgctcaggcagggccattgcacttgctgtttcctctacctggggcactcttcccccacgtttttgcatggctgccttctggctcctcaggactcaaatgccatctatgctgatcatcctgtttcaaataggcacctcctgatagatgtctctttactccatgaccccaacttattttattcagggtacttagcaccatgtgagaacatttgttcattgtctgtctcccacctttacaagtacagagaccttatatgtcctatttaccacaatatcaccgacacctagagtgcctagttcctaggaagtgccaagagcctgaaatccagcaagtcttctaatgacccagtgcaggggcagctcacagaaagtgcatgtgtggcttagctggggtatagaggtctgggattccaatggttttgcatcttgtattggcaggaggaagtgaggaaggcagccccaagctgcagcatgaacttatcatacctcagtggaagacttcagaaagccccgtgagagaaaaggtaagactcaaaagacctcatttacactggcaggagttgacaactgaggtttgggctacctactcaactttcttagaatcccagtcatcaccattagttctgtttctggcccactctgtcctctgggtgcccattttggagatcacagatgggactttccttccttgtatgacaaacttctagaacacttcccaatgctattagttgaggaaatgaaaattcacattaatgctgacacaagctaagtgcagatgtgttggtgtcacagaaatcacttagtcttgattggaattcattaaatattgtcattgttatttttgctctgcataatacatacttcattttcttgaaggaataatgtacttggagagaaaaaagataataatataaactataaactattttaataagacgcagcgtagagacctagtactggggaatgtatcttaaaatccagtaggctcccctggccagaacaccaggaaaacacataggctttatcaaagagattgggaagaaaacaaaaaacactgtcctgttcttgcagagaggacctgagcatttaggatattctttgtggttctggtttttttttttgtttttttgtttttgtttttttgtttgtttgtttgttttgacagagtctcactctgtcgcacaggctggagtgcagtgacatgatctcggctcactgtgagctccgcctggcaggttcaagcgattctcatgccttagcttccggagtagctgagattacatgtgtgtgctgcgaagccaggctaatttttgtatttttagtagagatgggttttcaccatgttgtccagggtggtctcgaactcctgacctcaagtgatccgcccacgtagtcctctcaaagtgttgggattacaggcgtcagccactgtggcccactgtggttttggtttttccagcaagtgagacgtgaaagagcaagaaaggaagatgcggttgttgtgtgccagtaaccagctatgtgacctgccacttgcgaagtggtagattttcttcatttataaaatagtgcttagagagaataaggagaaaagaaagctggggagaggggttttttctaagatctctttgggttaaaatgatttgtgatttattgggcaacatataggagcaagattatagcaggaaagagatgtgtcaggaaagacttcagacattgtggctgttgaatctggaaagataaatggaaaggagcaatgtccaggatccttgaaactctggccaggataatacagacatgtccaaaaaggctccaacttggatttaccaagggaacctaacagtgtaaattttaggacagaccaagtgcgatggctcaagcctgtaatcccagcactttgggaggctgaggcaggaggatcatttgaggccaggaatttaagaccagcctggggcaccatactgagatcctatctctacaaaaaaaaaaaaaaaaaaaaaagaaaattagctagacctaggggtgtgtgtctgtagtcccagctactctgaaggctgaggtgggacgatcgcctgagcccaggagtttgaggttatagtaagatatagtcgcatcagcatcactgtcctccagtctgagtgacaatgcaagaccttgtctcaaaaaaaaaaaaaaaaaaaaatcaggacaaataaaagcaagtaacattttgtcctaaaggcagtaaacgcatggaattcatttcatcaaaaagtaggagaggctgaaaatagcttcaggaaaagtctcgacaaattaatggatggtcatcctagagcagattacttttaacaattaagatcttgggtattgcaacctattcataccccctgaggaatggacctgctactttttatagaggcttctttgttctctccagatgtggatgccgggcatcctcaggaagggcctgagaacaaagcagaggaccagatcctgtctttgttcccaaccattgtctgcccagcatatgggtcattgtattctgtaggaatagtcagcatagtgcctggcaccgtaactatttgttcaatgaacaaatgaatgaatgttgaagagagagagactagaggctggatttcacttgggcctctcattctcatttatataattaattcactcattaaacatttttttcttctctttttctcatcactgacttaaagctcacattcattaaacattaactgaatacttatactgtatactaaatattatactagatcttagggggaatgcaaatataggacagatttccaataccctatggagctaaagatctatttaatctagactgaaggggaaagaatttttaacccatccctaggagaggtataaatagtgggtcagcttactgtacttcataggagaggagagctgatggtgcctcttcttaatacagagtggagtttcatcagaaaagctcatcagtagagccggacagaaaagcttcatagatccttaaaatgcagtttcattgttttgcttgaaatgccccatagaaaatccttttttaaatatcagtgcctgagcaccttccagaatagagagaattatttttggatcacccacataaaaataaagattactactcctggcggggcatggtggctcacgccctgtaatcccagcaccttgagaggccgagatgggtggatcacctgaggtcaggagttcaagaccagcctggccaacatggagaaaccctgtctactaaaattacaaagattagccaggcgcagtggtgcacacctgtaatcccagctacttgggaggctgagcatgagaatggcttgaaccctggagatggagtttgcagtgagccaagattgggtcactgcactgcagcctgggtgacagagcgagactctgtttaaaaaaaaaaaaaagattactattcctgctgcagcttgtgtctctttgggggaggggaagatagtgctttgatttggggcagtattcattttctgtgggggcagtcacatggttacctacctcttggatgagggaattgctgtagctctgttgctgtgtcgtctttctttctttcttttttattttttttttttgtttagacggagtttcgctcttgttgcctaggctggagtgcaatggcgtgatctcagcttaccgcaacctctgcctcctgggttcaagcgattcttctgcctcagcctcccaagtagctgggattacaggcatgcgccaccatgcctggctaattttgtatttttagtagagatggggtttctccatgttggtcaggctggtctggaactcctgatctccagggatccgcccaccttggcctcccaaagtgttgggattacaggcgtgagccaccgtgcccggtctgtgtggtctttcttaaatgcccacttggagctggggtccctgatgctcagtgtgattgggcagggcactgcctcaaaaactccataaagtggcaaaggatctgcaaccagaataggtgttggcagagctgaatcagggcatgacaaacagagaagtgaatctcttagtgaaagttattggtcaaacatctccccagcttcctacttcggtgggtttgaaatgttccttcttgagatgaagtaatacgattaattaggcaatggccagcgttgcccaagagcctttgatcggaatgttgagatctcatcagagcccttggtgacctcaaagtctcagaaatgcccaaatcctaatgcagagtggggtttgcagcgaggaaggggaatgtgcttagacgaggtaggcttctaaccagaggtggcagaacaggtgacctactttctcagacatgcaagaagtaagctttgaggtcaaccttagaagggctagaagctctactctagcaatgattttgtggattgaaagggacttcaagaatttatctgctggatgaggtggctcacatttgtaataccaacactttgggaggctgagttgggaggatcacatgagcccaggagttcaagatcagctttggaaacatggtaataccccagtatctacaaaaaatttaaaaatactagcccagtgtggtggcatgcacctgtggtcccagctactcagtatgcttgagcctgggaggttgaggctgcagtgagccgtgattgtgccactgcactccagcctgcacaacaaagcaagaccccgtctcaaaaaaagttgtcagttccttagtcccaaaatagagagcttatgtttaaaacactccaaagaatctgttctgttttaaatatgtaaatatccttttttaaaaaaataatttatttcttcgaaaaaagttcagtagccttaagttgaattgttgaagcgtggagatttattatgacttggtttttaaatttctttgaaattctccacaataataaagtaaaaagagattaataaaaagttcttttcttaaactgtgaaagcaattgtaaacatgtggaaagatgtgcaaaagaaaacaaaattaactcatgatcccattaactatggtaatggttaggcttatttctctctacatttttccctttgcgaagtgtatttaaataaaatattcagtattgtattttgagctttatgactaatgattattgtgtacattttgtcagtaatttaacaactacttaaagttgctgcttttaatgatcattcagtgttctgtcatatgaatggatcatcatttatttaaccattctctaacaggttatatttaggacagttaggttacatttcattattcattactttttttttttttttttgagacagagtctcgctctgtcgctcaggctggagtgcagtggcatgctctcggctcactgcaacctccgcctcccaggttcaagcgattctcctgcctcagcctcctgaatagctagaactataggtgtgcaccaccacgcccagctaatttttatatttttagtagagacggggtttcaccatgttggtcaggctggttttgaactcctgacctcaagtggtccacccgtctcggcctcccaaagtgctgggattacaggcatgagccactgcgcctggcccattattcattattataagtaataaatgtccttatgtgcaaacctttgcctgtgcctccatttattcctttcaaacagcctcacattcctgagtctaaacatttttttttttttttgagagagagtgtctcgctctgtcacccaggctggagtgcagtggcgcaatctcagctcactgcaaccttcgcctcccaggttcaagcaattctcctgcctcagcctcccgagtagctaggatcacaggtgcccaccaccatgcctggctaatttttgtatttttggtagagacggggtttcaccgtgttggccaggctggtctcaaactcctgatctgcctgcctcggcctcccaaagtgctgggattacaggcgtgagccactgtgcccggccgagtctaaacatttttaaactctcagtgcatactgtcatgttatctttcagagagttgccgtcagtttaaattctcagtggtagggattgcgagtgcccagtttacagtgggcattgtgcattgtgatttagagttttagataacctctggcactttgatttttttcaaggtatcttattatttttaatttgtttttctggacgtggggaggtggtttattagcgatgtcgaacatagtttttgtgcttatcaaccactggtatatgttaagtgatccgttctggatatgtagcacctgtggccactaccaaactgcttatgtgtaaaatgtatctactttttggcctataaaaccttaatttgaggatctcttagttgcttcctctgagatgattggggttttccaaacggagagccaaaatgaaataagaacccactacgaagaggatcccctagtattttacaagataataggcaatatgtatcatggcttgccgtgtgccaggcactgtgatacattatttatgctcattatctcactcaatccttacaagatccccatcaaattgactattactatctctgtatcatacatgaagaaactgagatgtggggaggctcagcaacatgtccgacttcacacagctgcaggtgtcagagccggtgcttgaatccagatctgactctgcaggacatttactgctggagattgtgttttccagtgtttcccttcaccgcaccacatacatacacttacaccacattgcagcctggagtttcttctctatgcctttcaggagaaagcagatgggggaaggatttgggtcattctgggattgaggtcattttacatgtgggctggaaatgcaattgacctttgctcattcacttcctgtggatcaatgttggagcgctgtgctagatcctgtgcccgacccagggagcctggtgccggcttttaggaactgacattgttttgttgttgcttttagcatccactcaaagctgagctcagggtaatggctgaggggcgagaactgatcctggacctggagaagaatgagtaagtggactcctcctttgtctaaaatgaaacaaataacttctgtgtcaacgccggacgcaggtgtcgctgttctggaaggaagcagtcaatggagtgaccccaagctctcagtccttggtttctttcaggcagcatcttgcaaagccagagcctttccacagcctcttgactcgatgtgagattgctggactgctaaatgtgttgctaaaatttccttaggcagtatttcaggggcccctggagttcactgcgggcacacagaggtctgtgtatgtgtgagattaagggagtggatggaccagaggtctttggcagctgccttactagcgccagcctagtgtgtggcaggaaatgaaggagattagaggaaaacagcagagaggagcgagcaaagcagggtgtgctggggcttggagcctcagactcagattgttccatgtgttctggttcagccgcatctgagattttgtcaacagggcatcgtcaacagtctcctggctacatcgggcccggctcttccatcttcttaacctcattcatcttgggtggtagcctggctcagaggcacttgcacattgatttgccatcagatgcagtcatatctggattcatgtaatggaggaggtgaatgggcacgatgcatggctatgtctgtggctcattctttggccattccccatctacttagccatgaagagctctccttacttggccgggggactctgaaaacatttggtgtttccccactgaccgtcccacttttcgttctgccacacagacgtcgcagataaggctgcgtggcttggagagctgcctgtctcctcttggcagcctccagaaccccctggaagccaatgagtaatcaaatgcatcactgccaagaaaaggatgaagaaggaccttcctgtatacaaaaggatgggaatagcttttaggcttgggtggaaagggagaatataatttattccaaatttgggctttttgggcacttgcaaaggaggatgagtgctgtcccgagtgtggttaaaatacaactcacagcttgtgcagtggtggggcttcatccacatccttcctctgcctccaggacatggtggcctcgggaagccagaaagatggggatcacagtcatttttgttcctctcctcttgagagtaaagccagtttaggctgtgtttcttctctcctgtgtccctggaatagacctggccagctgcgtccctagacagtgcagcgtctattggccctggatttttccttgcattgtcttcctttggtcctacaagaaaaggcccttagagggtttgttcttgaccgtgtctctcgggggcctgcctttgttgctcacggcagctttgttcccattaactctagtctaagtgttccctgttgttgcctgtgtctaatctctcctgttctgcccccagtagagcctgtggcccttcagctccctctggtcagcccaagtgatagtgttggtgttgtgggaaaatgcttaggagttggactggccaagcaggagtcccaggactcaagtctctatccttccctcctattttgaaacatttgctacagaccataggaagctaaagcaggaagatgccttagaaaacactgaatggaatgatcttagaaaactctgaaattatggatgcagaagttttgattcagagagggataggcatttgtctgaggccacccagcaagtaaatgaaagagctgaaactaggatcatgtgtattcttggtgtgagtctggagttacagaatgtgacccagggcaaatggctgaatcttttggaacttcggtgtccttgtttataaaatgagggtaataaggccagcctcgtgggatggttgtgaggataaatgaggtgaagtgcaggaagtgcttgcacagcgcatggtgagtggccagccactgttgggatttttattgtcccacactgaggctccagaggagagcccggggctgtggttctagcatctgcttttccgagagcagctctcgtttcccattgagccgcatggggctggatgtggttcctggcctccttgaattggcagaaggcagcagagttggtaaaaatggaagcagcagagccaagcaatatgacctcaccaggtgtccctgggggacggcttcctgctattttcatccaaattgggctttttgttttgaacatgtgttagtgagcggaactccaactgcacacgacttcctagtgtgtttatttcccaaagccttctcattcatggtgcgtgcgagtccggattcaaaacagctttggagcgggggagatgattttctaatttttcaaatcactgtgttgaagtttctataatctcatgacatttgggggaaactaggccctgggccaagccatttctcagcctctggttcttaacctcctcgatcaacgtattcatttttttttttttttaatctacgtgcctctgtgacatttcaggcaccagtgcaggtactggggataaagctgtgaataaaacagtacagcctttatggagcttctattctagtgggaaacagtaagcagacaagtgagtgcaccgtccgtcaggtgatgggtgctgtgcaggagacagaggagcatagggagtggggccaggggagtgtggaggtagaatgggagctgctgtttctgaatggcagtcagggaaggcctttcaggtgaactgatacttgagtcaagacctgaaggaggtgatggagtgagccatatgggtagctgagagatgacaattccaaggagagggaacagccacgttccaaggccctaatagatgatgaaggtttccactctccctctgtacatttccccatacactggattctcaggtctcccaggagcggtgagcaagggcttctgggactctggggggagggagaggacattttaaatttctttttcatcatcctgccgtgtctggccttctcccatcaaatcaaagcccacgtattaatgcatggcccaaaatagcagtgagcaagcctttaatggaattcacacatggagagatcgccaagaatggtgaggatggaaaggcatggggcatgggccaggagaggagggggaacacagcaaagtgagcttcagctcaggcagcagacacactgaggtgtcctacaatagcgcggcagccggcagcctgtctctgctttgaagcaactcagcaactcacggatgacatccgtgagaagcacacattcttttctctattgagtgcaggtgaaaaacagtgaccctttagggataatctgagcattgcttttgtgtcggttattcctgtgttcagatcctggctctgccacttactaccttgtagcctctttaagcctcagtttgtgcatctggggtgtaattatagtcccatgtcatagagccagagccacagggaggatgaaatgagatggtacaggtgaaggacttagcagagtgccttgtttgtattccaagctcaaggtagctatgattatttcttgctcattgtttttaaattgcaaaagcaaagcatgctcattgtaaaacatgtagcaattccaaataaacaaaagaatgaaagtttccctcccacgaggaaaatccactgctgtttggtgagcaaaccctggaccttttctatgcatacaagaacatgcacatgaatcctcacagacacaatcacatacagacacagtcacacagaagctgctatttttgttggggagggaggagcagaaatgagattatgtcagacatattgctccagcatttccttttttgaactcaactggatgtcatgaagacagtcttctgctctaataaagtatatattacattgtttaatatttatacacacatgtaatcacataatttgcaaagattggtgcatagctgctgttggagaaacttgtgattgaggcagtgtggtacagtggacatagcattgacctcagagacagatgatatgaaattggtcaaaaagccagccagctcccctgagcctctgctttctcatctgtaaaatgcagattttggccccggataggctctgaaggctctttctgcactacctcttttttttttttttttttttttttttttgagacggagtctcgctctgtcgcccaggctggagtgcagtggcgggatctcggctcactgcaagctccgccttccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgcactacctctttaaaggatgctctgtgagtagaaaaatgcaaaagaagtctctgcctcaggaaatttgctctacctgtggagacatcctgggaaatagtgggcagtgggataaaggaaaaaggtgccccaaatcacgggaccttgaagttggggacgaacttctaggtcagaacccgcaggttcaggcaacagaaaatacaagaagggaaactacagagcagaaattatagactgctgtttgcacaacccacagatttgagcattaatccatattttttctctatgttcttttccccatgtcctgagactacctcaccaacccaggaacccatatttgacaaaaacttgtttgctgaaatcaaatggaatcctccttagttagctgcaggcatccagggagatgaacagggttatgtgagccccagcgccatatcctgtcctttcttggctttttcccaaaaggagggcacactgaattgctcaaccagattcctggatgctcactgggccgcattactagtgagcaggatcactctattacaagatcaccttcaaaagcaaatgaatggctcaactagtaggcactttgcccagaggctctttggccatatgcttctgtcttctagtatcttaaacacattctaggactctcatttcttcaatacactgtccttcctcaagtccaaatgatgatggcttgagaaagggagagacgtcctttggtctaaccccatccatttgtgctccagcccagttagctaaagagagatcttatttgctcaagtttagttaataagaacgggcgtttgttttcttttgtgagtatgtctacctccaaaccacctggggaacagcaattgtcaaggcagaatttgggcatttagaggtttactgattttaatacctatcattacttccaactttaatctttcttcctatccctaacttcttatcagtccttcagtgatatcatagggaaggagaaggctttcattgtcctggaaatcaagctacaatctggaaaattaacattcagtgctaatggagtaatctagctccctaacattctcgtttttcctcaagtccattatacaatttggattgcataatactggtggaattgaggaagggcagaattagcaggcaggaaaggaatttttcagcaacacacggggcagattagttgccatctcttattcctgcacttctttttcaaggatacctggtagaaatagtagcagacccaaagcaaaactatgaataccacttaggcagtggagctctccccacctccaccctcccagcttcctcccaggtcaagagtagactttaacatcttacctaggataaaggacagctctctttgaccctctcttgtcaggagcttcatttgttgttggcaaaattcaatttcctggatcaaagagcagcttagaaaggcttagatggtatcccaatgctcttagtaaaccatgcttcactgagttgcatttaaatgagtcatagacatatggattacattgcacttaaaatacacatggctcaagaaattaaaggatatcattctttaaccaagtatttggcagatctaaagtattcaaaatgtttttccaaactctactcgcagctgggctccccattccccatggctaaggttgtataacccggggagacaggtgctgaggaaacagttggatgaatgggtggggacaccagaatttgatgagagctgcctgtggtgtctgaaattttcttcacatgttctttggaagtatgaagaactggtttaaccctgctgtgttgacgctgaaggcagtgaatgcatgagtggatttaaattccaagtgctttgctaggcacgtcattccagagagacctggtagtcctgtttgagatgtagtttctaattgtagctttgtagactgagaatgatttcatttgcatttcccatgttgtcccaaatgcctggagttgcagaacaaatggattgccagccagtctgatgtgattttttataagccaaactctcaaccccaccccagcataagcagggtctccatttgcaatgtactgaatgtttatgtctcccttcaaattcttatgttgaagtcctagtccccaaggtgatggtattaggaggtggggccttttggatatgattcgtttatgagggctctgctctcatgaataggattagtgccctgatagaagagacccgagagaattagctcaccttttccaccaggtgaagacacagctagcagctaccatctatgaaccggagagagggccctcactagacacgaaatctgctgatcccttgatcttggacttctcagactctagaaccgtgagaagtaaatttgttgcttatttgctacccaggttatgctgttttgttatagcagccagaatggactaagatgccattatttctaaaatattggacacatgatatcactttcttagggtccattgcttaagctcagactcagtaataagcctggtgatctgaagggatgcagcttcatgatacgcttgtctaaggtatcagagagcatccaaaattgaaatagcctagatgtgttgattctgaaagccttgtgcacacaagccttaaacatcctaatccatagagtagaacagatttggactttggtcccagagaccctgattcaattccagatactgacacttccggttgggtggtctttggtaagtcacttgccttctaagttttacttcttcatctgtattcatagtaatactacttggccaggtgcagtggcgcatgcctgtaatcctagcactttgggaggctgagccgggtggatcacgcgagcccaggagttcgagaccagcctgggcaatgtggcaaaaccctgtctctaccaaaaccaaccaaccaaacaaacaaaaaacccccacaaaaattagccaggcatggtggcacatgcctgtagtcccagctactcaggaagctttagtgggaggatcttttgagcccaggaggtgaaggttgcaatgagctgagatcataccaccgcactctagcctggttgacagagccagatgctgtctcaaataatagtaataatactcactgctttgtgagcatttgctgagaatggatacttcggaaaaggcacttcacacaatgtcttattgaatcctcatggcaaccctttgaatgagatattgttgtctgcattttataatgaaactcaagcatgaggagtttaaataatttacccagtattgggcatagccaggagtcaaactctggcctgcctgcctcttactacattatagcacttgcatagaaaatagagacattgataccttcattgcagggtgtggaaggctgaaaaatgcaccctctcccctccaatgataaccacattcgaatccctggaacatgtggcagaatctttgcagatgtgattaagttaaagatcttgaggccgggcatggtggctcacgcctgtaatcccagcactttgggaggccaaggcaggtgaatcacctgaggtcaggagttcgagaccagcctgactaacatggtgaaacctggtctctactaaaaatacaaaaattagctgggcatggtggtgcgcccctgtagtcccagctactcgggaggttgaggcagaagaattgcttgaacccgggaggcagaggttgcagtgagccgagattgtgccactgcactccagcctgggcaatagagtgagaccccatctcaaaaaaaaaaaaaaaaaaaaaaaaagaaaaagaaaaaaaaacaggttataaaaaccttgctgataaaacaggttgcagtaaagaagagtcacttgagcctgggaggcagaggttgcagtgagctgaggtcacaccactgcactccagcctcagcgacagagcgagactccgtctcaaacaacagcaacaacaacaacaacaaaatcaaagatcttgagatgagaagattatcttggattacctggatgggccctaaatacaatggcaaatatatttataagagggaggcagaaggagatttgactatagacagaacaggagacagtgatgtgatcacagaggcagagattagagtggtgcagccatgagccaaggagaagctggaagaggcaaggaacagattctcccagagggcacgcagccctgctgaccccttgattttggcccaataataccgatttcattcttctgacctctcaagctgtgtgaaaacaactttctgttgtttgaagccaccaattttgtgacaatttattacacactagccccaggaaacacacacacagggtttgtgaggttaggagataatgtatgacaatgcacttagtacaacgtctggcacatagcaagcaggttttcaatacatgctaatttgtactaatgcaacgtccagaacaaatgttttcaggtgttttggggatgcaagctgtgacatgtggcccttgcagctttcttcaagcatgaaaatgacaagagaaaaaaacatattgagcaataatctgtgtggttattgcttatctacattacccaagttccgggtcatgttctctgatgctctgtctgcccttagggaacttctggctgaggataactaggaatgattgtcacatattaacaaatggtgatagctaaaaagtaggagatgcctgtataacaggcatcgtactgtggtatttatatgggtcatctacttcacttgtcacaaccaaccaatgaagagtagattcctatattagccctatttggcagatggggaccctgaggtgtggagcagtgtgacttgctaaaagtcatgtgggtgggaagagcagggccaggatgtgaaactagatctgtttgactcccaagtccaggcttttaactggggcagtatattgcctctcagatgcatagtcctggctcattatgctttgggctcttttttggttagcactggcatttcttcttcattgttctactctcccccttccctttcctcctacctttcccaggccctggttagaatttgcatgtcagtgtaatgtgatagtgtaatccaggcaggtgtgcatcccaagcttggctccttgcactacctggaggtgtaagctttggcaagtcgctcaacctttgagagtctcagttttctcatctacgtgatggggataataacctcataggatgtgtgtggaattcaataacgtaatgctcttaaaggatttacagggtgcctggtgcactatgagagcacaataaatagacactgttatttgtgttttgcagggtcagaaaagcatttaagaatgaagtcagagggaattcccctgagttggtttccaaatgtaattaagaagagttgaccttaaaacccattgcccctgggaggaaattacttctgctctccagcgatgcccagtttgacctaattgtatctcgaaaacactgctttgcagtgttctccagtgggccaaactgtacctcttttctgtgcctgcagaatcagatgaggccctgaactgtccaatatgaggttgggatttgttcactggttccggctctccttccagggatccgcagccagggctgcctgtgcagccaggaaggatgtccacggttttcttttgtctcaagcttatttctcctggctgctcttcagcaggagcacggggtaaaatgaatgggaggaagctgtcaactgccctgttggccttagatggacccttatccgaactaagggaagctgtggacttggaagaagtcaggatgcttgggtttggggacccctttatcatcaggctgcttaccttcagataacaacaatagctggcattgagggagtgagcatttaccatgaacttaatattttatgtagattttaaaaatccctatgtatatttatatacaaatgaggtcatagtgtattcttggttttgtaacctattttttttcacttggaaatatagcatgggcatttaaaaacatttaaaagattttacatggaactttttggaatgtttgacatttttcataataaaacttcagagaaaaattaaacaagttatagagtttttaaatgcatggtatcgtactttatatactattttataattggcttttttattttttgtcttcagtgtctttccacatgagcacatttatagacctgtttcattctttttaatggtgacataggattccactgaatggatgaatcaaaatttattaatttccttattaactgacagttaggtttctgatttcttgttattacaaataatcctagcaataggattgtacataatctttaagcacatttgcaagtatttctgtagcactgatacctagatgtagagttacaggatcctatggagtacacaattaaaacgcttttaaattttgacaagttgtacctctcactccacaaatacctccccaaaggctgaatgtaccattttgcatttatacaacaacagatacctccccaaaggttgaatgtaccatttcacattatgagcatattataaatatgtctccatgtacctttatcatatttaaaaaaattaattagaagttctatttttacttactttttagcccatgaaacaaatctcagtaattttatcttttccttttttaatttttaatttttgtgagtacatacatagtaagtgtatatatttacggggtacaagagatattttgatacaaacatgcaatgtgaaataagcacatcatgaagaaaagggtatccattccatcaggcatttatccgttgcattgcaaacagtccaattatactctttattttaaaatgtatagttaaattattatagactgtagtcaccttgttgtgctatcaaataataggtcttattcattttttctattcttttttgtacccattaactatctgcatctccccactacacccttcccagcctctggtaaccatccttctactctttctgcccaggagttcaattattttgatttttagatcctacaaataagtgagaacatgggatgttgatctttctgtctgtacctggtttatttcacttaacataatgatctccagttccatccatgttgttgcaaatgactggagctcattcttttttatggcagaatagtactccattgtgtatatgtaccacattttctttatccattcatcccagatagagacttaggttgcttccaaatcttggctattgtaaactctgctgcaacaaacacaggagcacaggtatgtcttcagtatactgatttccttttttttttttttttttttttttgagtagagtcccgctctgtcacccaggctggaatgcaatggcacaatctcggctcactgcaacctccacctcccaggttcaagcaattctcctgtctcagcctcccgagtagctgggactacaggcacacaccaccatgcccggctaactttttgtatttttagtagagacggggtttcaccttgttgccctggctggtctcaaactcctgttgcccaggctgggcttgaactcctaagctcaggcaatccacccacctcagcctcccaaagtgctaggattacaggcatgagccaccgtgcctggcccactgatttcctttcttttgggtctatactcagcagtgggattgctggatcatatggtagcatgacatagtggttgtactaatttatgttcccaccagcaacgtacacaagggttcccttttccccacatcctcaccagcatttattattgcctatctttcaactgggtgagatgatatctcattgcggttttttttgttttgctttgttttgttttttgagacagagtcttgatctgtcccccaggctggagtgcagtggtgcgatcttggctcactgcaacctccgccttctgggttcaagcgattcttgagcctcagtctcttgagtatctgggactacaggtgcacgccaccacacctggttaatttttttgcattttgtatttttagtagagatgaagttttgccatgttgaccaggctagtctcaaactcctggtctcaagtgatccatcccaaagtgctgggattacaggcatgagtcaaggcacccagcttgttgtggtattgatttgcatttctctgaagatcagtgatgttgagcaccttttcatatgcttgtttgccatttttatgccttcttttgagaaatgtctattcaaagcttttgcccaacttttgattggattattagtttttttttttcttatagagttgtttgagctccttatatagtcttgttattaagcccttgtcagatgggtagtttacaaatattttctcccattgtttgggttgtctcttcactttgttgattgtatcctttgctgttcagaagctttttaacttgttgtgatcccatttgtccattttttctttggttgcctgtgcttgtggggtattgctcaagaaattttgcccagaccaatgtcctggagattttccccaatgttttcttgttgcagttaaatggtttgaggtcttagtttttttggtcttttttttttttttttttttggggttggggggacagaatcatgctctgttgcttaggctggagtgcaatggcgcaatctcagctcattgcagccactgccttcttggttcaattgattctcctgtttcagcctcccgagtagctgagattacaggcgtgcaccaccacgccagctaattattttctttttagtagagacaggatttcaccatgttggccaggctggtctgcaactcctgacctcaggtgattcgcctgcctcggcttcccaaagtgctgggattacaggcatgaaccactgtgcctggcctgaggtcttagatttaagtctttaatccgttttgatttgatttttgtatacaatgagagataggggcctagttttattcttctgcatatggttttcccaccatttattgaagagactatcatatcattttcgtggctgtgtgatattatagtctatgtgtatgcatgattaactcttacagcttcttatagtgaaaaattatcaaacgtgcagagtagagagaatgatggtatgaatcactgtatacccaactgagtcaaagcgaatttacatgtaacgtggatatataaaggcaagttgcccttggctcctctgcaagtttatatctcactgcccttgttgagagatcctgttttcccaaacacaccattgagttgattattgagcttgggcagactctttaaacccaagctctcttgtctttttttttttttttccaaacagctttactgagatacaactcacataccatatagttcactcatttaaagtatacaatttcatctgttttagtatatttacaaagtcatgcagccatcgccataatctgattttagaacattttcaccactccaaaaggaaaaaacatcagcagtgttatgagttgaatggtgtccccccaaactcatatgttgaagtccttatccccagtacctcaaagtgaccttatttggaaattgagttgtggatgtatttagttaagatgagatcatactggagtatggcaggtctctaatccagcatgagtggtgtccttttagaagggggaggtttggaaacagacacacactctgggagaatgccatgtgaagattagagttatgccaccacaggcgaaggaactcagaagccaggagagaggcctgggataagccctttccttgcacctgcagagagaggatgatagcttgatcttggacttttagcctcaagaactgtgtgacataaacttccgatttttaagccacttggtttgtgatactttgttacggtagtcctagaaaaggagcacagtcattcttcattctcccccaccccacgtcagtcctatgaagctggcaatctgatgtctccagatttacttattctggatgtttcatgtaaatgggattatacaatatgtggtctttttgactggctactttcacttcgggtaaagtttttgaggtttattcgtgttgtagtatgtatcagtattcttattgctatatggtattacattatatagatataccacattttgttaacccattcattagttgatagatctgccttttaagctcgagctaatttttctccattctacaagtttgatttcaggggatactgattgagcacctctatgtagaatcctgtgctaggtgctgtagagactaggcatgaaaacaggatattcttaccttctggcagtttagactctgtgggagagaaaacagcatgcaaacagcataatccaaaacagattacaaatttacatggtagaattgaaagtaaagaactgcgaaggcaagaggaacgggaatttgtgactggggaagaggggagccttccctaatgagggttacttgaaatattgtcttgcagaatgatgggaggcttttgatgagggagggagatgagatgaatggagaatgagaaaggaattcagactgagaaaacaatgtgtaaatgtttggtctggatcaaagggaacctaaaactgtagtgctactaatcttttaggaatttagtatccctaactagccaaatatttgaattcagaagagtgatatgttgaggttggggaacgggttgctttttcttccactggtgggctaccagaggatttgagtggcatagagctcaatattttaattctcccatttttgactttgagttgcattctcttgcctcaggcagacccatgtggtcagggaagtaggtgagctacttctaggaaacatacttgaagtgcacttaaaagctaggctgtatttctacaccttggaagagaagtagctttcctcccacccctccccactgaagaacaatttgggctgagccaagaggatggaggtgtacttggtggatggagcccatggattggaaggggctgagcacaaggcattgatggcttcttcacaacttctgtagatggggaagcctcctgagatgcaaggctggtgggcgggatgcagacggatttatggatatacatttggatttgggagaggctctttcggccttctcttttctcccagctccgaggatgtgattaaactcttcatctaggctctctggaaattggagggtgtttcctactctttaccctttgtggttgggcaatggagcatgactatcctggagaaaaatgagaggaggctgacaatgtggcccctggacagattctgtcctgaaaatgaaactacatttacatttcacccaggagatgtttttgattttgagcaattaagatttgctttttctttatttagaactcagtgacatacacagacctttggctgaccccttgaataaactaagtgaatagtcttctgggtactatggggcaagttgctaggtcttgcacaaactcaactggggcaggtattgagtcagagaatccctggcttttctggcaagtctcttcccagtgtactgggcttgagttctggactactcattgagaattcctaatttatgttattcctttcttctcttccttcattaaacaaatattgtgagtgccaactatgtggcaggcactgggataggtcctggttattcccgggagaatcaatggtgatcagaatagtctctgccatcatggggcttagaacgtagtagaggggacagataattaaacagttacagaacaatgtgggacctgctaggagggaggaagtagagggtactgtaggaacatggggaaggggaacttcctctggattgggggcacgggaagtctgataggaggaagtaaagaaaagggggagtgtgatggtggtggagagtgtggcagagttggctcatacaatagggagtatgtgccaggcagcacagatcacaggatcaaaggcccaaaggcaagaatgacattgaaaatgaaaagttctctatagttagaacagagagcaggaggaaggaaatgatgagagaagaaattggtgaggcaggcagaggtgagtccttaaagggccttgtaggcaccttaaagagtttgggcttttatctctagggcaatgggaagcggatgaagaatattttaaaagtcacatagtgacagcatccaaaacgcatttgagaaggactaatttagggaagaggtagctgatataaagagaagaggatagattccagagatatttatagggtggaatcatggaaactgggaaatgggttgcatgtgggctgagggagagggtggtttcaagggacagtccaaagtttctagcttgaataagtagcaggatagttgtcttaattcattttgcattggcaaaacagaatcctagagactgggtcacttataaagaaaagaaatctgtttctcacagttctgctggctggcaagtccaacatcaaggtatcagcgtctcatgagggccttcttgctatgctaccccatggtgaaagggagaagggcaagatagcacatgaaaaaaagagcaagagagcaaacttgcagcctcaagcccttttataacagcattaatccactcattatggtggagccctcatggcctaatcactcctcatgaggcctaccttccaacactgttgcattggggattaagtttccaacacaggcttttgcggggatacattcaaaccacagcaatggtggtgtctgtccctggagttttccttagcttgtggtgggaccttggacaagccacctctttccttggatctttaggtttctcattagataggtaattagactcaatggactaattagactaggtaataattcctagtcaccaccttggcaggatcatcatggggatgcaataataaaacctgtgtgaaaagcagtgtcctgtactctttccataacgctgacaggcccagcagaagcaaaatctgtgcctcccctggttttctctgttttctcctccttatctaaaattctaagcacttggtctcttaggaactggtgagacctctgcccattccagcagctgaggcttcattggggacctctctagggattctgaaaccggcttttgttgaaaacaatgatatcattgagtaggtggagctgggccggactttcctcagccggttgaaggagaaatggggtctttatgacttctgtacttgtggctcttttccagcctcttccatggctcccatgtgtctcacttcccccctttcctccttgcagaaaactggcagtctccacgttttctcctcttgcatcagtctccccggggagagggccagaagggccaaggagctataatggctgcattatatcaagcatggtttctttttccaaggccccccttctggagaagggaagggcaagtcatggaaagggactcctttggagggagactggagtgctggggaaaagagtgatctaagtgttggaaggaatgtcaggctctttgtattctagaagctctttatctcttgactcactgatgctagatttggggcttgggtaagaatgcaaaggtcaaactggcctctcagggatatggtgataggaatatgggtttggagaaggagggcagccatgttgagtgagtatccttaattcctgatccctagactggccttgctctctgctctcaacacgcacacatgcatgcacacacgtgtgcgtgcacatatacatcccttctccataactgtgtagacagctttttaggagaaactagaaattggttaccacactggtttgcagctgttccaggaaggaagatgagctgtgaaacagtgccttctggggaccagacagtgacacctgccctctgcatggtgtcagcatttgccaagcacttgggagctgcaggtgccaagccaggagaggggcaggaaacctaggcctgcctcactggctgctgaagccccatcccctagcatagtgcctgcacatcacggacctccatacatgtttgtggagggtgcaagtggacttgcaggtgcagggcctgcaaggcctgatgctcagaaaggtgctgcgtcttgatcaaggacccccagcaaatagtgacgaaatcaagctgtgagaaactctggcctcctgatgccaggtggcctgcagtttgtaccacattacactgcttaatatgcagttattcatgagattgcatgaagagcctttctctctgcctactgggtgtgtctggatggcccaactcttggcttgtctaccactgacatttagcttactctagtttattgaaatgatgggtttagaaacaaaaactgtgtgatgctgggcaagttgcttttgctttttttcagattcttcatctgtaaaagtggaggtcagggttgggcagagagggtggtatataaataatgtttcattgcggtagactctgtaacttacacactaaccctcgcttctcctaaacaatctttttggaaaggatatggggcaacgcatagaatgagggaaaagttgaaaaactaaggtttggaaaggttgagatcctagaatgaatagacggtcccttcatgtactatcatcttgaaattctgagatgagatctgactgtccaggcatatcatgaagcattcatttggccaggcaagggcagggatcttgaccaactccaggtgccctagtcagcaatgcaacgagaggggagtatttctttaaatgcaagttgggccactgtttatctcaagaaggtggcatggatgctgggcaggctctgacaataggtatccactatgatctatgagggctttccaagttctgacatccttgacttatgctttgggtgcggtctgtgtcttagtatgctaagaaacattgggcaagtttatgaaagttactgggatatttaatcagagcttaaaaagggctaagcacctacatttagcaggctggtttgtggtcctcacctacctgttttatgtttgtttgttagtttcagggagtggtccgcttattcccttttttctaagcatattctcacagctccagtgatctcagagggtccttctcttcatttcccctgtgtcttatccacaccgtttttctttatgatatggcagtttcctcataccctcttacattcgtctttcccttcaggttttctgtggtatcggctaatctgatcaacactgtggttatttaccaaaaactggttgctagagaagttgttcctactcaccattttcgcttttagatttttctcagaaattctaaaggtagcacctcatttccccgaactgttcttatctaattccaacaaatacacataatgggctattcgggacactggaaaacaaatttgtgaactcttcttgggtgagccattttgagggccccgcaggtccctgccagttaagttgtctgatctcaagaagtcagctctatttgtgcagagaggttacccatcttcacagaggcagccacgagggaggcctgaagaggattaagtaaagaccctgctggccaaaggagtcagtggtgctcatccaaacatcctttggtatataatgtaaaagcaaaacacaggaccagaaactggtcggaagggtgccaggtcttgtgcggactgggagaagatgtcgtgggaagtggttggtgaaagggagtgttgacttaacgcattgtttggaaacttccttaataggaagttaaagaaaacatactgagtagcattggccttttgccaggcttctggatggcgccatttttgccttcggagtgttgcttccaaagctggtcctctggcaacgatggtgcttattcaagggagtccctgggataggaggaggtcccaattttttactctaggagcaacctccaaagttcccccttccttcgcctttctgttccctcataaaggaatgtgtctgcttgcagccccctggactcatcagtcccttatttggctttagggccatgcctttggcacgttggtttgtttccattcctttggagtcagaggtggaatgagtactgatgtagaaatcttggttctgaagcagctctggctgtctcttccctgcttttctttcagcatcttagaaaacaaaacaatactcactgaatttattttgtcccaaatctagactagtgcaggccatgacattagaatagcactctgcttttcagagacactttccagtacctgtctgtcctgggcattgccatttctgcttgatagaaagggaaactgaggctgagtagtttgtgacttgcaccgtatcacctagccagttaaaaaatattgtcaaaatttacaaacccagaaggagagagactagtattataaacctcagatgcccattacctagatttaacaatgatcaagattttgccacgtgtatatatagctagtgctggagaaaatgatagcaatatttgtaaagcacaaatactttctactttacaaataattctttcacatttgttcatatgatcttcctatatgccaggcactattctaacatcttacaggggcactgtgaagtagattttgtcattctcctcattttatgatgagaaaccataggcacggagaagttactgaccagtctgaattcacacgacttataagagctaggatttgaatgtattttctcatttgatcctcagcatcgctgtgatactgatggtgattattagtctgttcattttgcagtctagaaaatggagggggtttatgtggctcacgtgaaaacaatttttatacaaatacatagtgagcacttctcgaagttttatttatctaattaatgggctaaccagcaagatgataaaactggtttaaaattggataagggaaactaagacgtatttgtgtgggggtgtgtgtgtatttaatagtgaaaaaaggaatgctgagataagattgctaaattagacacaaaactagttaatatcctaggggctgtaaaatcataacctttggggttatcttttctactagatggaaatatttgcatttctgttgtatcttattaagtttttacaagttaacatctgattttacagagtggaacaagggctgtcctaattaattgtaaatagtacatctttcaaagccacactcttcccataaagtccagagaaccgtagacaggcctctgagagtctaaggcttggctgtgctcccttagtgttttttaatttaatgttttgagacagaatctggctctgtcactcaggctggagtgcagtggtgcaatgtcagcttactgcagcttccgcctcccgagttcaagcgattctcctgcctcagcctcctgagtagctgggattacaggtgcgcgccaccacacctggctatttttttttgtagagacgggctttcgccctgttgtccaggctggtctggaactcctggcctcgtgtgatccacctgcctcggcctcccaaagtcctgggattagaggcgtgagccattgcacccagccctggctgtacgcttgtgtgacattgagaggaaccatagtcatcttttgcttcatttccaggctttggaagggcagttgcctagtgcagctgctgcttaaaccaaagcattccgactttccctctatgctgggttagcaccatctttagacttttggaaggtgattaggaggctagaaataaaaaaaagaattaaaaatgttaaaattgctcaaatggagtagaataattcccagaacccgaaaacataaatcacctgaaaaaaaaaaaactattaaaaatacagatttcttaatccttccctagaaaagggaggggattgtgtatttttgaacagtctttccaggtgttgtgcagttgttgggctaagtcgcatggtgagaacattattactaacataggcaggatgaagaccctccaggtgaaataagagagaccagaaaagtggacctcccaaggcatcatcagggtataaatgcctggagactcttggaagaattagatagagaaaggcccagagaaaggaggtgtcagcaaaacttgctactgagatgagcagagtgatgctcgcctatgctgagctcgtctgcagagggtgtttttcaaggtaaatgggaaattgttatcactttatcttcactggtttgcttatctgaagcaggaggaagaaggtttgagctcccagaagatgttttgcaaattcattttagtgtcactgctccttcctctctagagggtggtttagcctagagaggcatttgaaatttgtctgacgataaatagaacttaaaggaattgtcctgagtttgaagcttctgagccttaggaaagacgggtctgagctgttttcaggctgcagtgtactttcagggcctggctgcttgtacaggttccagttcttcttccctagagagtgacctaatgttttatgtccggtatttgggggtagcttattttcctaggtgggagtctgaagatgcaggttttgctcagggactttggaatctaaatgacccagattttgctcaactctagtgctggctattattatgatggtgccgagacatggcagagtgtcctactgatttctgcctgtccgtgggctcctgagcacagagcagacagagcagggggcagcagggtagaacagaaattgcttttcttttaaagctagaaaaaaggagtgggcggaatgggaaatcttgcacagtcctttctcttcctggatgcacatcactcacaagtcgtttcctgaaaatcctaatgcaatccaatggtgagagacggcttcctgccggtctgctgagccagcccctcgtcagggaggagatgagaacaagatgtggtcagagaatggggcagctgggctgggccgggctgctcagtgaccatgtgccctcctctctgtgggacagcagcgtcctttggttctgagagcagcacctggacacatgggcgtatgtggacctagcttgggggagctgcagagttgttcaaacagatggctggccctaaccctagagtttctgtctgattcatgagtctgggtggagcctggcaatttgcatttttaactagtttctagatgatgctgatattgctgcttcagaaagggtgattaggtggaaaatgaaagcggattgttttatgtagattcagaggccagaatgaaggcctgtgggtgccagtgacagaggtgtagtttttaatccggagtaaaacattaaactactgtatgtggtcagaaatggagtgggtagtctcaggagtagcctctccctggaggtgtccagtggtgaatagccatttggcagattcctacacgagataaaaggttcattcattcgtttgcgagtttattcactcattcacagaatgcacatgtactgcctgcttgctaggtgctgggggccggggagaagacttcaaagacacaaggtccctgtttttggggagctcacagtgtaattggggtttgactacatgatttctagggttcctttcagtgctgagggtcagagaggcctgtgatgatggggtaatgtcactgggtgaatgatttctccccccttgctaagtctcagaagaggctgagaatatttttaccaggagtgcattttctgtgggaaaattcacacttccccactggcacctggaatgaactattaaactctgaactcctgaccagctgtacatggcgcagtctgtgaaagcaaacccaggaaatgggctgcaggaatgagcacattgcgttttaccacctctcttaagtgatgtactggagagttcatggctggggaaagttagagagagaaactttctgggttcttctgtcataatccctgttgaaagcaataatgattatcactaacttttacccagctccactttgtgccaggcatggcattaagtctgctacatttattatgttgtttgatcctcatcacagccctatcaaatgagtatatcatcctcttttttgtgtaagaggaaacaaaggttcagagacatacatgtacttgttcacggccgtagaggcagtgaatgtcagagctggaatcaaaacttcagttttccagtctccagaccatgctctaagctgctagtacactgaactactcatccatccattcattcggtaactagttaagtggttttctcattgaacaaatgttaagcactgacataaaccagtgagcaaaactgcttggcctctgccctcatgaggcttacagcttttctccctcaggcaaatgggtgactcctccctcaaatcttggactagttagatgctaaggagaaagagaaaggactgggagacagattctggcaggttagccactgacccaaagtttccatgtgaatgagaatttctcttcacaaagctggggtttgtgctttgctttatttttacattttcctgttgggcttcttttcttcttgtccaaggcgagaagttgaaggccttgacatagtacaggagacaattcttgtggcatttgccttctgaccacacactggggatggagggaaatctgagcgatcccagaacttagagctggaagtgactctagaggaattctagagaccctctgcgatgaccctctcttgctgggaaatgtcacctctttcaaaacctgggttatccctgcagattcctttggctttctgtgctggcctcagcctacattttcttctttttaagagcagttttaaattaaaatttcagttttcaaaacacctctctgacagttaatttaaaagtcaaccaacttcagaaatatgcaacttatattgtaaacatcttctgcaacccctgagataatcaccatcaacaaagggcatttgtttctctctctctttttttttttttttttgagacagagtctcgctcttgtcacctaggctggagtgcaatgacgtgatctcggctcgctgcaacctccaccccccaggttcaagcagttctcctgcctcagcctcccagctaggcacctgctaccacacctggctaatttttgtaattttagtagagatggggtttcaccatgttaaccaggctggtcttgaactcctgacctcaggtgatctgcccacctcagtctcccaaagtgctgggattacaggtgtgagccaccacacctggctgaccttgactttctgtagatcaattctgcctttaatgtggctgaactattaatagttgaaacatccatttgactcttatatttttcttttaatttttagagaaaattctaagaacatttcttgaagttgcctggcctttggtgaggggattcttaacctgtacttcaaggggtctgtggtgagagaaaccaatgtccaagtttagaaaagaaaaaaaggaatttattggaagagtaacatagaattaccaggtctcaggaaatcggaaccactaagtgtccgaaagggcaggcaacggaagcttagggaacccttgtagcaggaacagaagaacagatgcattgcttccatctgttcagacctggcagtatctctccactggcttcgcttgaaatacaggtcaccccttggccagggccaagtaggacaccttgattgacaatctcaccaaaatatgcatcagggaagagttattcccttaaagaaaaattggtctgctgatactaaaaattggtagatccagtgctggaaaaatcaaccacggtacacaacagggttcataggccccgggaaattttgcatgtgtttgcatgtctgttttcccaggacccagacaaatattaagatcattgctttagttctgtcaattccatctagttggagtgatgttcccatagtgatgataaattatatttaatttacattaaatataaaattaataacaaacttatggttttcctttttgttccttagccccttgtggctgcctagtttcttttgtatggagatgcttgggatagtcctgcctggttcagttaaaatcactcgttgttgctaggagggtggagttcatccacttatgatataaatgtctctttttattttttgcaggcaactttttgctccttcctacacagaaacccattatacttcaagtggtaaccctcaaaccaccacacggaaattggaggtgagttcaggtcaacaaatgtctatccagcagctgtcctctcccagccctactcctaggacctcaggagatgcctgatggagttggtctctcctctgaagggagtgtttcccccaagcgaagaccaagggagcaaacgagaagcaaaacatgtatttgatgttcataggtgctcctcctcctttgctgactacaatggctaaagaaacatagactattttagggtaattgcatctaattacaattgatgcaaattactgtgaaatatacatgttctttgctttatgttaattacccacatgttaacaaaagttttagtaaaaggagtgacttactcataatcctgtcgtctcatccaattagatgtttgattagtcctttttaaatggatgtataacatttacagagttgtaatcactgtgcatatacattttgtagtctgctattttaatgtgatttttaagttatgaatattttattttgcttctatattcatattggacattttttccctcaaagttgtttttgagtagggatgtttacgcaatgtcaaagatctttcatttagaaaatggtctttcagatggttacatgtcagtttgctttgccacactccactggtagacatttaaagtagtgaatgatacacatttcatggtggctagctcttcttacagggatgcctattggaatttgtaggctcagaacgttgattctcaaccaggagaaccaatggcgttgccccgaccccgagggacacctggcaatgtttgcaggcaatttttattgccgtgactggcagggaggatctactggcatctacattctataatgcataggacagacccaccactcccccacaacagaattatccagctccaaatatccatagtgcccaagttgagaaaccctggattcgaatgaccattctcaaagtctgggctggtgagatgggggtgaagaagggaagacgcacactggcaggagcagcagtggcctttgcctttggggcaggacataatggactactgaggcacacagactgggagttgtggtgtggagaacagcaggagaggtccctctgcatcaggactccttcagcagcttctcatggaacctgagtgttctaccaggcccattctttaaaatatccctgctggagtgcaagtgtccagcaagataacactggccactatcagtcattaacagctcagattagttcgccagattacccctggatggggaaagggacacaggacaggtaattttgtgtgtgtgtgtgtgtgtgacagagtttcactctgtaacctaggctggagtgcagtggtgcgatcttggctcactgcaacctccgcctcttgggttcaggcaattctcctgtctcagcctccccagtaggtgggattacaggcatgcatcaccacacttggctaatttttgtatttttagtagagacagggtttcaccatgttggccaagctattctcgaactcctgacctcaggtgatctgcccaccttggcctcccaaagtgctgggattataggcatgatccactgcgcccggctaattttgtatttttagtagagatggggtttcaccatgttggccaagctggtctcgaacttctgacctaaggtgatccacccacctcagcctcccaaagcgctgagattacaggccactgtgcccggccacagtttttgatagatccaagagacgtggcgcatagtaactgggtagctcaggggctgtgttttgtggctgaatgtgaagaccagtgctgccttcttaaccaagactttcttggatggggaaggagttggtagtgtggccggtgcctgcagcaaagttggactgtgtcttctcatccccagggaggctgtccagttgtgacttcatattcttcaatgccccttggtcaaaacttttcctctcttcttgagacctctgttctctgcctccaggggcaggggtgggatgggggaacaggcatgcctagaaagctgttagccatgacagcctccttcaaacactctcctctgagtttggatcctgccacttctgtacccacagctcaagaatgggtctcagtccacgaatttgccatgagctcacgcttcctgctatgaaagcccccttggggtggccccatcaggctgagaagctgaggaatgcaatgacttcatgactgatccttgacttgttctttgtgctctctgcttgtgcattaggcagagatgttgtaagggcctttcagaaagagaggattggaaaagaactccccctctcccagaatcccctccttccagaaggtcttgttgactgaagcacatcctagctgaaccttgggatggacaactcattgtttgcttacatcccctgctactagactcttgcaaagctcccacccaggcccatggggttctcagtcagacttcccatttgggagctgagagctcaatgaaaaatgggaatggaataaactactcagctgcccttgacccgaatgttggagactgcactctactaccaaacttggcctggggtagctggagttctgggaaccttatcaagactcatcagtcaggcctttaggcgacagcctgcatctaggtcaggcggttgggggaatgggtctgtgaatgtgttccaacagaaaggatgacagggtttgcaatctgcagccagggttgttatcttggctttaactagttatatgaccttaaacaacccccttgaccacactagtgttgagttttctcatttgcaaattgcatatgctgatatctgactcgcagggctgtggaagggtaagatgaatcactaatttttatgggaattcataagcaactcttccaaccccacattttacagatgaggaaactgagaggagaaggggaaaagtaacttgcccaagttcagttaaccagtaagtggcaaggcttaggctagaacttgtctcctttgttgctagagaaggtggggataaaagagctctgacaagccaagttcctcctttgctactgctgggagaggcagaggatggagcttggggccaggctgctggggttccagtatccactttgctgtgtcaccttgtgaatgacttaaaacctctctttcaatttccccctttaaaacatggcaataataatatctgcctcataagattgtggtcagaatcacaaggaaaaatctgctaagttgttcagcaagcagtaagagctgggtagatgttagctcttttattttagacatagggcctcgctctgtcccccaggctggagtgcagtgacatgatcatagctcactgcagcctcaaactcctagcttcaagtgatcctcttgccttggcctcccaaagcattggtattataggcatgagccgccatgcctggttagatgttagctcttattgttttgtttgtttgtttgtttgttttgagacacagtctcactctgttgcccacactggagtgcagtagcgtaatcttgactcaatgcaacctctgcctcccggattcaagcagttctcatgcctcagccttccgagtatctgggattacaagtgcccgccatcacgcctggctaatttttgtatttttagtagaaatggagtttcaccatgttggctaaggtggtctcaaactcctggcctcaagtgatttgcctgcctcggcctcccaaagtgctggggttacaggtgtgagccaccccacccgacctcttactgttaataatagtaagttgtaggtgtcatcatcacaagagatagtgtatgtgaaagctctgtaaattataaagcatgctacagaagccaggtgctctattttcgagagaactagggctgtgaacactcttagcatccattcaaagataggaagaggtgcagggattcttcacagccatccctgggtttcagttctttcttttttctttttttggagacagagtctcgctcggtcaccaggctggagtgcagtggtgccatctcggctcactgcaacctccgcctcctgggttcaagcaattctcctccctcagtctccgagtagctgggacgacaggagtgcaccaccatgcccagctaattttttgtatatttagtaaagacagggtttcaccgtgttgttggccaggatggtctagatctcttgacctcatgattcgcccaccttgacctcccaaagtgctgggattacgggcatgagccaccgcgcctggcctcagttctttctgttaaccagcgttttgaaactgtagctgatacacgtttctgaactccttgattctctgtcattccaacttctctgagccccatttactccacacaggcccggcccctcttctccccatgagtaatcctgtgctacggggtttgtggctcccctgttgagttctaaggaccaggttcaggacttgagtgcttcatgaggggcctccaaatcccagatcccacgggtaggttgagaagccacatgacaggctggcatttgaaagcagttggaatcctggccaggaggagggttttgcctgccacgccttctttcataatcacagcacactggctttcctttgtgctcctctcaagggtggcatctgacttgtttaaagtccagaagagtttgatgcaaagacaggggttggctctgtccctcctcctgactatgagcttgaatgggcagaggagccacatcgctggccgatggatcatatgcagatgaaagggcacctgtggtctggagaacgaggccgtgttgagtgtcagcttggcctgtatcctttgatctggctgcatggctggctggatatgctggagcattggcacagctagggctttggattcagcctcttggtgggcttccaggcgccttgaggccatattctttgataaaggagaatttcatgattatttggttgccgatgtttatcgcctgccactctcggccaagtactctactagctcctttatgtacgatattctcaccaccactctggggtacagaggctaaagacactgaaggtcagagagagttgtggaactgcgtatgcttggatttaaatatgcctggctatgccaaaatgtttgaatttaattatttgtctatactcaggattagagctgggagggaggtggagccagagaatacagacacacggggtagctgattattgggtcacatccctgtctggtggggacaaagaagcaactgcaagcagcatggtcctagagatgggggaaaagagaaagcttccatgtctgcaactgtgtggtttgcatccatcccttttgagatctttccagaacttggctctaccctgtgggttttatcttctctctgttctgaccagtgcatctctcttgacttatttgggaggaagcctctaggaatgtgtctcttgttgttacccctgattcgttggacaccgtcctgatttcacccccttctgtctggtttagcactttagcatgcccaacagtgcgtatttgcttcctaaattctatggttacctgacttataaaatgctcggccagcacttgaaatggttatttcaagccccttcttttggtttgtaattatatctgtttggatttctcattaatgactgcctctcacaagaccataagccccacgaaggctgaagctgtgactccgtttgctggctatggtgtctccaggggctggcccctggcctggcacagagcggtggtcacagctgtttgtagtgatggagaaattctgacagccatgagacacagtggctggagagcagcagcagacctcacgggcacaggtaccaaatcaagtacaatccagatgtggagggatttgtgtgaaagagcatcttgagctgtggaagagtagggagtgtttgtttcctagggctactgtaacaaagcaccataaacttaaaggtttaaaacagtagaattttactttctcacagtcctggagtctagaagtccaaactcaagatgttgtcggggccatactccctccaagcctctggagagaatccttccaggctcttctagcttctggtggcttctggccatccttggtgttccttggcttgcaacttcatcactccagtctctgcccccatcttcaaatggccttcttctctttctgtgtgtgtgtctgtgtgtccttccctcttgttagaaggacacaaatcattggatttaggaccttctctaattcagcatgacaccatcttttttttttttttccttttccttgagacagaatctcactctgtcgcccaggctggagtgcaatggtgcgatcttggctcaccgcagcctccatctcctggactcaagcaattctcctgcctcggcctcccgagtagctgggattataggtgtgcaccaccacatccggctgatttttgtatttttagtagagacagggtttcaccatgttggccagggcggtctggaactcctgacctcaagtgatccatctgcctcagcctcccaaagtgctgggattacaggtgtgagccaccacgcctggcccagcatgacatcaccttaatttaactacatctgcaagaccctatttccaaataaatcacattctgaggtggacatgaattttagggggattctattcaactcattgcagggggttgcaaagataacattggtggggaggcaagttctttccatggcatgcttttggccacagaaaacactgattcctgaaagagccctgaactaggaaaattctggattttccaatcagcagggagaccttgggcaaatctctttgctcctttgagcctcagcttttcatctgcttcatggagataatgacatcttccctgccccgtctcctaggattattatgggaatcagatgaaatggtggcttggaaagctctttgcaggttgtaaggtgctataaggttgggtaggtatataataagccatgagtcatccatgaccatcctgagatattaacattgccatgcttatcagtgttctttagcctgaccacctcctttctccttgctaggatcactgcttttaccacggcacggtgagggagacagaactgtccagcgtcacgctcagcacttgccgaggaattaggtaagagaccctgaggctgcaggtggcaccgggcactctccccaggaatggaagtttcaagatagacaaggctaaggcaaggaccttgggaaggagtccattgagaatgtgtgcaagccagcccagagaggggctgagcctgggaggatgggcaagggaaagcctaggtaatccagaaatccattgggatttaactttcctgatgaacttgatgttttaaaatataggttttgttattatttaggtatggtaaggccaaaaaatcaggagatgactgccattgaaaagatggtcatactcacagaaaagggaggggcccggctgtgccatggggggcggcacggggaggcactggggttggtcagcgggcagagggagtctggagaaatgtcagcagacgcccttcttgtggtttctgcgggaaggaatgggcgaggcagagaaagcaggtttaggattggctagtttgcatcatttcagcaggctctggggtttatgggctctctgtccttagttgtcctatacctggttctggggtgattagggaagggggatagtggcccagagggtgagagtgcccataaaataaatggctagggtatggactctggattggttggcttgcatttgaaaggcaaggtagctgggaaattgttgaccatctctaggaattggctaatcctggaaggggcagtccctctatggtcagtaagacccagatgtcaaagaaacagaagataaaaaagaagacacatggttaatatgctcgggatggatgagtttgggcatttggttccacacctcctcagttcttctctgggagatgtacttggaggtggtgaaataggaaatggacggttaatgaacagagagtaggaagtgaaaggaaaggcaaggataattttcaagacagaaaatcaactgaaaagttctgaccagaatgtgcttttgagagtgacccttccttctctgagtgagactacctggctttgagctggtagcagtttaccagctgggtgaccttgggtcccagtggtctcatttgtaaaatgtggataaaaagaatatatgcctgcagttgtgaggattcagcttgtgaatagctatcttacctaggaacttgcagtggcacactgtcagcatgcagtgaactcctaggactttgcttctctaggtgtgttccatggatgggcagcatcaactttacctgggagcttgttcgaaatgcagcatctcaggttccacgcagacctactggattttaatctgcattttaccaagactcccaagtgatttgtgtgcccattacagtctgtacctgagaatgtgtgttccttgagaatatggagtatatctcaaatatctatttctctccaccagcctgccttaatgccttgcttgcagtaggatctacacatgtatgttgacataataagtcttatttatgtagaccactttcaatctccctcctctttttttttttttgaagaaggatgatgatctaaaaaacctggtatctcattgcatatactaattgcctgggttttgattgtctgtactatgtggtgcctctgtgcagtgatagacagtgagctacagtttcccagaatacacaggctcagtgagagacacttcagcccagtgtaaactggctctatgacaaaaaggaaaaagccctgatttgtagcatctgccaatatgctgacaaagataatcccaccatgatcaatttcaggctaccgatgtgatgttattgaaggcagaattgggaagatatgcctttgattggctctggtgagctgataggaggtggctccattgtgtgttcttcctctcttgactgattgcttcattcattcaatgattgcatttttcattcacaaatagaaattgggtgtcttcctaatgcccataccctacacaggtggagggaaaaccagcactgtaattttggagccctcagtttccttgtcaataaagtgaacatcagtattaagcatggtagagattattgctgtaattatagtacttttaaacataagggtttttcctcctcttacgtcggtgaaaccatgctaagacttatgcaggctcctatacaaatggaaggtttctcacactgcaggtcccaagtgtctgtttataaattgggccatgactttgtttgaatgctgcatggtgagttggctggaggaaatcaggcaggaaatgggctttggatgggaagcaataacagagtggccccaaatcccctctgcttaagtgacctgattgagccaagctaactggcctcgcagtggtatttacaagcccagccaccgccacctgcagtctgcaagtaaacaaagtttgtcccaagaaggaggaaaaagaacatgcaggtgtgacctgcttctgtctgcctcttcctccatcccctcagtctggagcagtgggaacttggcttggcgtcttgtaaatcattccagcagcagtgctgaaagggagggggataccgggtgagctgtccgtgtgtttctgttttgcatgcttccgtctggtgaggtccacctgccttactttcccagccttctcactacacacgccttaagaaaccaaggctgtgggtggactgatttaagagctggagactcatgccagatggttccatttgaaccctggagaaggagcagctgcaacagcagcaacattcaaacccatgtcgtcaaaacactaggcgcctcccaaagctcataaagcactgctgcagtgaaaaatctccatagtgattgttcttctttcctggaaacatgctcccatgattggagaaataggtaggatttctatcaagtgagatcttcaagctgatgataccaagaggaattcagctgagcttctaggtggttgctaggccccctcttctcttcaaagcagttctttaggttactttaattgaagaagtcatgtattatcttagtaaaaataaattcaaaaagtacaaaagagtgtacaatgaaagataacatctctttctcaccccagatttccagattttcccccttcctagagacagccgttgttactagtttcttgtatatccttttaggaatattccttgtgaaaaaagaacgtagatatgtaattgatatggtttggctctgtgtccccacccaaatctgatctcgaattgcaatccccatgttttgagggagggtcctggtgggaggtgattgaatcatgggagcagtctccccatgctgttctggtgatagtgagggagttcttacaagatctgatggtttaaaagtgtcagtttctggccgggtgcggtggcttacgcctgtaatcccagcactttgggaggccgaggcaggcagatcacaagatcaggagatcgagaccatcctggctaacacggtgaaaccccatctctactagaaatacaaaaaattagtcaggcgtggtggtgggcacctgtagtcccagctattcgggaggctgaggcaggagaatggcgtgaacccgggaggcggagcttgcagtgagctgaaatcgcatcactgcactccagcctgggtgacagagtgagagtctgtctcaaaaaacaaacaaacaaaaaaaagtgtcagtttcccttgtgctccctctctcctgccatcttgtgaagaaggtgcttgctttccctttgccatccaccatgactgtaagtttcctgaggcctcccagccatgcagaactgtgagtcaattaaacctctttcctttataaattacccagtctcaagtagttctttatagcagtgtgaaaacggactaatataggaatataatgtctgtaatcttatttgggcccctggaccctttgagaattgattggaagctatgggtacttataaatgacaccaataggccaggcgcggtggctcacgcctgtaattccagcactttgggaggccgaggcaggcagatcacttgaggtcaggagttcgagaccaacctggccgacatggcaaaactccatttccactaaaaatttaaaaattagccatgtgtggtgttgcatgcctgtagtcccagctatttgggaggctgaggcaggagaaccgtttgaacccgggaggcagaggttgcagtgagctgagatcccaccactgcactccagcttgggcgacaaagcaagaccccatctcaaaaaaaaaaaaaatgacaccaataaaaagatgtggcatcccatctcactggggatgtcaagtttcattctcccaagcctgtctcagattaagacattctctaaatatctatactgggttaaggtgtctctgactgagcctgtgtgttctgggaaactctgtgtgtgagtctgtagctcactgtctatcagcaggaagtgtatctggttggtaagttgtttacttttttaaaaatttttttttgttaaaaattatcattatataactatacaggtttagtgttaaatgttcaaatcatgcaggaatgtgtaagctttaaaaagtgaaagttgtttatcttgtcctacccttccaaccaatcccattctccatctgttattactgttggaggtatccttaattactgttggaggtatcctttattgaaatacataattgtgtgtgtgtgtgtgtgtgtgtgtgtgtatatatatatatatgtatatatgaacatatttaatccaaatgagatcaccctatgcatacagttttgtattttttttccaacttaagcattatgttttaggtatacatagatctatctcattcttttaatggttgcataatatcgtttgtactaatgtctggcacgtttcattatatagaaagtctttcagaggtatgcaataaatcatccatagtggtctatttgatggatcacccttatattacagcagccctgccttcgaaaacatagggctcactctcactgtaattacaccttaaccgtggtccctggactcagattctgtgagagagggagagagggagaacatgagattgaaaatgaatgcaggagaatgtgtaggaaagtgtgcatgatggcctggaataagctcaaaatgtaaagtcaagggatccacgtttaagatctagctacatacttcctggctgtgtggatctctgtgttttcctctccccattaaattttttccttgtctttgctgtggccaggctggtccctccacaggcccctactctatccaaaaggtggctaagtcctgggagtggggtgggtggtcagtgggggtgaggtcaggggcataccccagagtcatgaacctgaacattaggagagctgggattagccccggctctcacattaactggctaggtgagcttgggcaagttcttttttgggtgggctttcctcttttctgtaaaacaagagtagaccagaccattaaaagcttccttctgtgttggaagtcctgggatgcagagaggttgggcagagtctcagggaggtgggagcctggggcagaaggaggtggctcatatacacacagccagccctggagaagaagtggcaagtcctttccacctttgaattccttgccttccttctgcagaatggatcataaatgctacctccgtgtcaggcattgcacagattaagccctcagaggacagtgttattaagttgtgatgaatttagattctggagccagacacttcctggtttaaaccctgccaagctacttaagttctcaagtctcagttgtctcatccataaaatgggaataacaatattgacatcactggtggatttacaataggtgaggagtgcaaactccttgacagcagggactttgctttgatcatgctatttcccgagctgagaacagttcctgtcacacactgggttctcagtacagatgtgtagaatggctatcgaataaaacactttgcgctttgcttgatgtataatacacaatcaatgaccgttagctgttcttttaaaatgctgctttggttattagtaaatattgcctattcagtccattatcacagcaactctgtgagatgggcagtgttattacatcacttaccacacagctaggagacagcacagccagagtttgaatccaggtgctatatgggggcaccctgtccttgagaaagtacatgacctacaagccttctcttctcttttttgcaggctttggagttccctgtaactccttttggatggatataatttgcagagaaggggagaggaaagaagggtagcagggtagttactttttagggcacctctgggtatagggatgtagaatgtgtcccctttggtttagctctgaatggacaagtccccaggaagcagttgttggcctagttccttgaagaatgcatttggtgaatccttcagttatgcaggggttaggcatgaattgcttggtgcctgcctggcctggcctgcccgggttttcctatacaatttcatttgtatccatctcttaacgatgagcaataggatggagaacagaatggagaatggcatgtgaggctggccacccagcctcctgggccccagctcatgccttctggctgagttctgcctttgccagggctaacattcagcaaattagatcaaccaaggctcctagaaggataaacaactggtggtgcttggaagagggcagctaaaggaattagggttgagggcggggacagcccctggaaccacattctcagacattcccccagcaacaaagctgcagtccactgacagtgctggggcttgtgccagcctctcctccatccccaggccgtctgagaggattgcagtcgtgacatgggcaaataaccaggaacagcagttggaggaagggagggaagtggccacagaatcctattgctggaacgaccttcagggtccttctgagcctctgtttctctcaaattgtaatctgcccactccctgaatcagaattactatgggcctggtgaaaagcaggtgcctgctacagagggtggtctgtaggccaaagttcctgagtgtggctaggcagggaattactcaggcctgcagctctgcgttttttaggttgggccctgtattagtccatttgtgttgctataaaggaatacgtaaggctgggtaatttataaagaaaagaggtttattttggcttacagttctgcgagccatacaagaagcatgacaccagcatctgcttctggtgagggcctcaggctgcttccactcatggcagaaggtgaaggggagcctgtgtgtgcagagatcaagtggtgagagagaaagtgagagagaaagggaggaggtgccaggctctttttaataaccagctcttgaggaaactctcatgggaatttgctgagtaaaaactctctcattaccaccaggatgcaccaagccattcatgagggatccaccccatgaccctaacacctcctaccaggcccacctccaacaatgggaccacattctaccgtgagacttggtggggacaaataaaccatatccacagcagacctggatacctatgttttcaatacactgtagaatattctaatagatatccctgagacctctgctcctagagatctctgacacttaggcttggaactcactgatggaggcagaaagcacagaggctaaggggatggggtccagagtctgtggaccttaaatctttgacttcagattacctagtccccatgcctggagcccacactgcccttaaccatgagagcttgttatttaatgtctctgagccacagtttcttcatctataaagtgggactcatgagggtgcctccttataatgatgatgtgggaatgaaataagaataacatttgtaaacacagtgcctggcatccagttagctcaatcaatggcatctgaaggtgaaaagtaggctgcatacctccttcatcttttctcttaggaaactgaggtgaggccaatcacccctaagaagagagctgctggcaccatcactggagccatctgtagactggtggtatctttctaattcactctacagggtatttttttttcttttggagatggagtcttgctctgtcgcccaggctggagtgcagtggtgcgatctcagctcactgcaacctccgcctcccaggttcaagcaattctcctgcctcagcctcctgagtagctgggattacaggcacccgccagtacgcctggctaatttttgtatttttagtagagacaggattttaccatattgcccaggctggtctccaactcctaagctcaggaaatccacccgccttggcctcccaaagtgctgggattacaggtgtgagccacagcgcccagcctctacaggactatcatgattgaggcagtggaaggtcagggtaaggttgtgggacttggaactagaatgcttccattcaaatcccgactcctttaatacctaggtgataggctgatctgtgcagcaaatcaccatggcacatgtttacctgtgtaacaaacctgcccatcctgcacatgtaccctggaacttaaaataaaagttgatgaaacaaaaacaaaaaacaaatccctactcttactcttactgtttgtgtgactttgggttaattaaccttgctgagcctttgttttcccatttgtacgttggggacaatatttgtaaggatcctaggaaggtggtgggaagaataaaatgctcacttagcacagtgccaagtccatagcaaaggctctataatctgcagccactatgaggattcttatttattgtgcaccacactatggcttggtctctgtcctgtttagctcacaggcttgttcaagtgatgccagatcagttgcgccttgtgaacctccattggaactttccctgattcctctatggaactttccactcactgggtgtaatcttggcaaccacaacctggtgcacacagaaccatcagctggttggtggtcaagccctctgtgttcccaaagtgtgtagccgttaggggaaactgaggtgatgggagaggccttggttggctgagatgaaaagataacttgggaacaggatgcgtgcagcagctctctcctctgccctttcctggctggattagggagtggatgcgacccttgctccttgccacgctcccacccccagatgttcagggagtaccttagatgtccgtcagagggggtgattgggtactgctgcgtcagactgggtgaggcaaccaggaagtcatcaggcttcctggatctggaatgaggtcagccagggatgggatccgggaaaggctgctgcccatcagagcctggcgctgattttccagagagcatcacaggctcttcccaaagggcaaaatctgggcaggaatcccaagtggcggttgtggtggaggtggaagctgagataagctaagagagaggtcctgccaatttacagtggcaaagactgggttggagatgctgtaggttctgagctctctgcatggatgagagcctgcctgaggttttagagcatacaaaatgctgctagagtccatggggcttactcctgggcttcctcctcccactgagccttgattacatacctttacaatcatgtttatctcattgtatcaaggttggcagatatctgctgcctgggccttcactgatcattagcaatagcaattgataataagtcatggtcctctttcttgctgaggctagaaaagccctcagaagccttggtgatgtaacagttgaagcagctgcctccagtccaaggggtgatgaaactttttgctctctctgttatacattagagtgacttattccaatgtttacactcaacgcttcacaagggtaggcacttggtgtgtcttgttcgctattccgtcctcagcaactggcatgatacctggcccgtagcaggagcccagtaaatgtttgtgactgtcttccagaggactgtgagtttctcaaggacaaggattatgtctagattatgtctaggacacatgagtttattctgagttcagtgctagtatctataatcaagggaggaaaaaaagtagtccctcatgcttggtggtggatgtcacttcaccaaataactaccgtgctgacgtggggcaggtgggacaagtaggcgtgtcatcactgatgcatctagctctggtttccaagcacaaagacccttgtctttccacttaatcatccagtagtcttgataagttatcattgccgtgttagggatgaggaaactgacgcttggagagatttaagatgcttgttgaagagcatgtgacaattgaatgttggagctaaatccagaacctcggtcacctcacttgcaggccactgttctttctctggccactgtactgcttttcctgagtctctaaagttttgacccatgatttgtcatatgccatgttttggtttgggaggctttttggaatcctggacctaccatccttcataagttttaagtgtcacaggtacagccttcttagaactttttgagatttcccagtccagagacttttaacctggagtctcacgatgagcttggtggtggtggttgggtggggtgggggttggggtggaggtccaagtgccctgagctcatgcaccactttttatgtataagtgcattcctctagagaggaagtgtgagcttgcatcagagtctcacgaaggggtacatggccccataattaggttaagaaccaatgatcaaaacccactatgtcattttgcatatggagaaactaagacctacacaagggactttttcagaaccataatctttgaccagagattctatttctcctctcaacagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcagggtgagttttgaggctctcagtgcagaaatcaacctggggacaggcttgtcccctctgaggttgcttactttgaatccaggagtatttctaaattgaaggtgatgcctaagaaaaaggaaatagtgtttttcttttattctgtcattgttgagtgtgaaataccctcatcatagaataactgcttttgggggaaaacactactacctttaaaacactcagatgctgacttcagaaagcttaaaaagtgaaaagaaggctgggcgccatggctcatgcctataatcccagcactttgggaggctaaagcaggcagattgcttgaggccaggagtttgagtccagcctgggcaacatggcgaaaccccatctctactaaaagtacaaaaattagctgggcatgatggctgggtgcctgtagtcccaactactttgggaggctggggcacgggaatcacttgaacccggaagcctgggtgacagagcgagaccctgcctcagaaaaataaataaaaattaaaaagtggggaaaaaaagtatgctttccctattggagtagacactacaccatatgcacacagtcctcatattgattcatactgaaaatggcatggtgtttcgaggtttcgaggttctgtgggaacgtggtggttagcacactccctctcatatgctggcctctgtcctgcctgtgctcatcagctcatctcagtattttctgagaataaaggactgaatccagggtcccagagcagcctccagcaataaccaaatggcagtggaaggtgttatatgagtgatggccaccacagccaagaacatctctagtgccgaatgacaaaatcattacggaggtagctgctgcttatccagcagctctgtttcttagcagttttttaaaaatgaggccaagtccactatttctacagcgctgatctgtttctctttcttagatgaaaagggaagatttaaactccatgaagtatgtggagctttacctcgtggctgattatttagaggtaagggggaggcaatgggtcttgcagaaaaactgctctcttgatagcttccattccaggctccagactgctttggggaaatgttgcccattcatctttctccagttcatctatgattttgaccttaaatctcaccaaaggctgggcgcggcggctcacgcctgtaatcccagcactttgggtgggcaaggcgggtggatcacctgaggtcaggagtttgagaccagcctggccaacatggtgaaaccccatctctactaaaaatacaaaattagctgggcatggtggcacatgcctgtaatcccagctacttgggaggctgtggcagtagcatttcctgaacctgggaggcggaggttgcagtgagctgagatcatgccactgcactccagcctgagcaacaagagcgaaactccgtctcaaagaaaaaaaatctgaccaaaggctcattttgccattttaaacatagttggggggaacttctccaactacagtattgctttacttcactagtaaagacacagtgaaatctccactggatcgggacatataccacgctatacattaagacagctgtacgattaacatttattgtgctgtgactgtataccattagatactggtgcttagactgaggaacccgtgatagtctatagaaaatgtcaaactttctatggggaaaagatgaaaaatatatttgcgagggctccacacgaatactgaattcttgccgatgtgtcggacctattatataatctttgtgcagacacacaactaccctaatggctggggcccaaaacggggtttctggatcaccataatcctaaaatccctagtgttaaaacaaatactcagaccgtgcaccgatctccttaaactagaatgtacggtggggtcaaaaatgcttgcttaacataaacatggaaaactggttcgacaagtatgttattacccccgacggagggcctaggcttagcgttaactcttctcctaagtcaaaccgttataaaattggtgaaccctcccagataatgtggctctggttataaaagaatnnnnnnnnnnnnnnnnnnnntggcttgttacatcagtcacatagaaaatcaagacagttgtctgattaacatttcttgtactgggtctgaagacctttagattgctggtgtttattctgaggaacccggaattgtctatggaaattctaaaacttttttttttgcaaagatgataaatatattcccagtcatccgactgaaaactgtattcttgcccatgtgtgggtccatttttataatcatgttgatgccaaatgatgacctaaagccatggtccccaaaatgtggtccccagagcaccagcatcagcagcacccttgtgtaagatgcaaattctcgggccctgcccccgacctcctgaatcccagactgtcagggtggggtccagaaatccatgttttaacaagacctctgggcgattgggttgcacagtcaagtttgagaaccactgacctaaaggcatagcagttcagcctttaactccatgttcctcaaatcagacaggttctaagaatttgaggaaccctcacctggctcatcatgtatttcatttattcatcagtgatctcttgattttctattatgtgccaagcacctggatatatagatctcaagaagacagaccctccccaggcatcgcagaatttgcagtaacagcacacaaacctgtaggtccaaagtgtgataagcactaagatggaccattaggagggatgaaagtgcagataatgggggattcaacatggttttgggaattagggaaagcttccctgacattgaagcagacacctaaagagtgagtttaggccccagagcccatatttgcctaaattagccagatgttacctccaattctcactttgtttagtgactccatcatataagtactaagtgcatcttctgtgcattggatgtcattatgagctgagcgctcgctgtgttcgagcagggcagacactggccttggtctctcctgaggatagagcccatcacaactccagtctgtctgtatcccatccacatagtttagctaccatcttcccaaagagctcattctaaggcagctgtacctagtcacatttccaaagcatgtgtcctggcagcagggcctggtgttggggagagcactaggctgcaggccagaaggtctttgagtgttagtcactggatgttagcagcagaaggaggtggcccttgaagctgtcttaaaagacaaggaggagttaactgggcagaggagtggaggtgaagggcattccgggccgagggaacattgtgctctgctttgaaaagcgtttagatttattttaactgatgttgatattggtttttccaacagctgtttgtgtgtgtgtgtgtgtgtgtgtgctctatgttttctgtttcctctccaaagactagtgtgtctataggatgggggaatagtgtggggagcaaaatccaaagctggtttaaaagccagctgaggctccatagtcgtgggaggagataactgactctggcctgccctgcctgactgcccgtagtgggaggactggtggaagaaaactgagctcctctgactctgggacatttttccacttaagttctgcatctgtgatcatctgatacaatggtcttgagtcatttttttcagctacagaatcctttggttacatggaagttcctgggaaccccagtagttaagcatatagagcccagctgctctgtttaaaggtggggtgtttctcccctttggccttgcattgttctcagaggaatctctgtgcaggctttcaaacccactgggtgtgaatctccagcagctggagaagtgggaagcatggtgggaggcagggattaggcatcttctatctcctgacctccagagtcacagcacacctccagagaaaaagtgtccactcaaggtgcctccaggactctggtgtcagctagagccatctttctcttacaaaggagagtgtctcagcaacagccctgggttcccaacagggctgtgattcatgcagctgtggtggataagggaacgtgctcatttctcagtcctggacacccctccgctgaaggctttgaatgattcatttgagggactggggtgggggtgtgtaacaggccaggctgggttcacaggctcacgaatcatcccctctccacctgtctccatcctctgcagacagaaatatattcttgacaattaattaattaatctgagaggatgggaaggcaggaaaggggagggctgctttaccatgatttataacctgctgcagagacagagccttggggctctgaatgcagagcagaaagtggagacacagatagggagagcaagaccctgctgctgcctagagagagagttgtcagcagtaaaaatgagcaggcagctcctcgctccctgggcctaggtgggagcttctagggtggttctcagtttattcattccccaggtggaacggaatccaggtggggataaagagtaaggtgggctgttgtaggagtagacaggataactgtaaacacaggcctgtaaaggacttccatgatgctggcacagtgcagagtggctgggaaaggatggtgctgcatgtggtactcactgtgtcaccctagaaaatgtaagtttgagacagtcctttctttacatcaggggtctgcaaactataccccatggtcacatccagcctatcctgtgtttttgcaaacaaaattttactggaacacagccaggcccattggtttctgtattatccaggcttctgtattatatatacaggtgtctgtattattctgagccaccactgcacagttgaagagttgtagcagagactatggggccgcaaagcctaatccggcctttgcagaaaagatttgctgactcctgcttcagaatactctggacaacagaattcgctccttaaattatggtggtctcattgggcagttctttgaagagaagattaatatttttttgaaagacaatgaaatctggccctgatgttctaataaatattactaaatgaatggaaatgctgcaacgctgtctgtgccgagagaccaatttagaaacaggaggcctctataatgagaaactcctggattaacaccttggaaaggtctaagttacagtgtcacactgaatctaactctagaaagcagtggtaacagattctcttctggtgagtggcagttttaaggaagcctaagaatgtccacaagctgtggtgaaagggaaatggtggatttcttccctgtatcagggctggtacacacctctggccaaacaaataccccaggttgttttacttggctgttcttgttctttcttgcttagatattctcatgggatggggtggaggaaggacgtgaagattttgaatcaaaataacatgtatagtgggtacctaagataaattagagaggacccagattctgtgtaacaatggcagtgtacaggacatgcccatcatttttaaatgtaatttgcagttgtagcaggttttctctttacactgtgaagctttccttcatcattgcagctcagagagatctatctttttgaggcaggaatggtaaataggaggtattcatactaaaatgtcctctttctggtacccatggcagatatttctaatggaacacagctttctttcctgtgcttggttagaaatgtctgattacggccaggcgcagtggctcacgcctgtaatcccagcactttgggaggccaaggcagatggatcacttgaggtcaggagtttgagacaagcctgaccaacatggtgaaaccccatcattactaaaaatacaaaaattagctggccatggtggcgagcacctgtaatcccagctactcaggaggctgaggcaggagaatcgcttgaacccgggaggcggaggttgtaagccgagatcacgccactgcactccagcctgggcaacaagagcgagactctgtctcaaaaaaaaaaaaaaaagaaagaaatgtgattgaatcgatgcagtctcataattcttctcattcttctcactgtagaaggcactgccagtggatctgagtggtgtgcaagatgaagcctatttgccagtgtcttatggtcctcctcgttggcactcatgtcattcacatgacctcccactgtggttatttctgtgcacgttttcccggcaggttttctcaaccatttcagttctatactccttaagtacagggtctgtcactcagcatctgccacagttatttctggccctctctgttttaattgaagctcctctaggctagaaccaagatctcacacttctttgtgtcctacatagtgctaagcacaatgccttgcccatagcaggcattcagcagcaattcgatgattgttgattgaccacatgtagggaagcctcgtgagatctgtgtaatggtggcttcatgttggggtgatgaccacggtgaggattggatcagtcctcctaagccccagtgggagtttgccagaggccatgtaattcgaaggacaggagaataagatgtgcttcaagggttagaggaaggcaattctactccgtgcataattattgcatgcctactgtgtgtgctgcgctgagctagtagctgtggatatgaagatggatgttgacaggtcctaccctccaaagctcttactgtggtggggaagacaattgcataaaaatgatggctcatagaagacagaagaaaataagagcaaattcaaagacaagtaatggggcgcaggaagcatcctgtgagaggttctgggatctcacatggttctgcttgtcccatttagtttcagaagaatcgacgagaccaggacgccaccaaacacaagctcatagagatcgccaactatgttgataaggtgagaccaggtgtgtactttgtgggaaaggtgccaggtgccagcacttccaagggcactggagctgccttctgctggattggctgccccagccatcttctgaaagggaatgagcagtgccatagaggcccagggcggtcatgacagagccctgaactacgtacccttaggcaagtaactcattttctttgtgttgcatttttttttcttttgttctgttttcagcttataaatagaaaggctgtcgtaaatcaatgtgtggtttttttttgttatttttattttcctggtggaattttaaaaaatgaaatcttatgccaatatctactataaaagttagatgaaaacagactgctctaagtgggagctggggtgaggacccagaacactgtccttctgaccccttcctcttacccctgcagtggctcccgagcagcttggggcatggaagagcccagtttaagaatcctttaaggttctttaaggttccttccagatacaaagcccagggattctctgacttaggagggaattgaggtaggtcagggtgggaaagacacacagccttaaaagttgagaagtgggctgtttgagaagtgggttgcttgagaagcggattgtctgagaagtgggttgcttggggctaatctataaagtctccatctgtaaagttatcctaaaattatgtcttgtctcttaggaaggatgtgcagtggttaactttcctaggtcaggaccttttacaagatgctcttcggaaatacctacatttttgaattttactagaacgggctggtctgggacttggaagtacattgtgtatatgaaagaagatatttgttatagtacaaaatgcagaataggtaacctagaatgacagtagcctcttggtaggctagtagtatatagtttttaaaagtagtttttcatgtgtttgggatcaaaagtctctttgagaatctggtaacgtttattgcacaattttagaatactcataacattgatgaagcttaactttgggcctgctagggattcatgaattccaggtctaaagggaaaatcattttttcctaaacactagagaatataggagatcacttaaaatatgttttagggattaataggcaaatgtattagttctgaagtcatcagatggcagtttccatgcccatggtttttttctgccctagatggctctggaaacaaaggtcagtggtcagtgacaggtgaaagtcaaacactggcatttcctggaaggacagactctagggacacagtccagtcctccctctagctcctgactcactcaagaataacatttaaataatcctacaacccaaacatttgacatctgggaaaacaagggaagcttgtttccctggggagaatatgggaggctgactctgctttcccccatgtgacatctattgtttggagacctggcaggttcggacttggctgggtatcccctctgtggggtatgtgatggaaccaagggcgctggtgacaagtgaagggagaagagaggcaccagcaagccccagtccttactgaaagccctaagcctgggtggcccatgcatcctgtgcagccgtcttggctctctcctcgcggctggtgttagtcactcctggcgggtaagggaagccacgcccacttctctggagcttgctgacctagctacttgaactgaactattgttgaactaaaactggaatgaattggactcgtgctgagtcatgaacccaatccaaaatgtttttctgtaactgtgaaaaaaagccaagtttacttccttcaaaagctccctagtaaagcaaattcaaattggaatctgaaccttttattttctgtaacgattgaactggcacaaaacagaaaaatcaaaatttctgttgaaataaactgatatttcactgaatctggagcccatcttgaccagcgtttcttggagcgagtggattatctggatgtgtaggtactgcagcactgaagtagtaaagggtcacaaataggctctgaggttgtaatttgggccttcatcctggctccaccatcttcttgctgagactttgggcaagttccttaacttctctaagcctcagtgcctagtacgtaaaaagtggtggaaaaatgttggtgctatgattattcttttcagctggggcagtacctaccaattttggataaagatggtatctcctgctcattatgtcctctccatacatggggctttttattaagtcactggctcagtatttgtagggtggacccatcaaagaacccgttgtatccacaccttccagtggtttagctttaaagaaaaccctcctcctgcttatatttgtatgaggtgaaaaatgccagatcataaagattagatgtagctctagcctcgaggaggtcgagtcagatcttgggtatagaatttcaggatctctggtttggacaaaaccctgaagattaccaagaacgtctgtagtctattgcttgcaacctgcttattccatccttgacaaaacctgagactatccagggatggggaagaaaatttgaagagtaagcatatctgtgcacttttatgtcatttatactcatttacttccaaaatgagtgggagacattttataataaaatatccatgtattaatataatttggtatatccatacgaaagaatattattcagcaataaagagaaatcataaacgaatacactctaacacatggatacatctcaaaaacattatggtaagtgagagaagccagacacacaaaaccacatattgtaaaacaaatgtccagaaaaggcagaatagaaacaaagtagatgcacggttgcctgggctgagggtgagaatgggaaatgactatcaatagacatgagggatctcaccgatgtgatgaaaatattctaacactggatgatggcgatggctttattttatttttatttttttttgagacggagtttcgcccgtggcccaggctggagtgcaatggcacaatcttggctcaccgcaacccctgcctcccgggttcaagtgattctcctgcctcagcctcctgagtagctgggattacaggcatgcgccaccacgcccagctaattttgtatttttagtagagatggggtttctccatgttggtcaggctggtctcgaactcccgacctcatgtgatccatccaccttagcctcccagagtgctgggattacaggtgtgagccaccacgcttggctggtgatggctttaaaacttggtaaatttaccaaaaagcattgagctgtacacttaaaatagatgggtattatggtatgcaaattatacctcaatgaagtggctttaaaaaatctatatacaagagaactttttagatacccataagaaagataaggctcacataaggaattgggagaaaaaaattgtaccagacagcctggccaagggcactgattacagaagacagcaaagctcagctctgagctatctcatgaccagctttgtttgaaagccttcttcctattttaaaatgaaatttatgttcctgtctgttttacctattgacctaagccctacttgaacatcatgcagaacaactttttccacatgatagacctattcatatctgaaagcaattttatgtcctatctcagtcatctctaaacaaagtcactgcagttctgccaccagaatgtcctgctctctctcaggatctcattttccctttctaaaaaatgtcagtaacaccagttgcctccttctgttggagccatgggcagaagagaaatctggtatctgtgctctgagttcttaggctaggaaggagctttttttttaaatttatttttattttttagttttagtttttttctttttaatctcaagctccaccagaatgaaaggaaggggcttttaaatcccaggtggtattgacagatactgtggtttttctgtgtcctttcagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgtaaatagcctttttccatatgttgtgttgtccttggctgcaaagcctctgcccacccagcacatgctcagagtttgccccatggcgagtgttggttgtacaaggccattctgactccctggtccagagaatcaggcatttcctaaacatgcgctctgtacccagcataccccagaaaatgtttaaaagcctgagtcacattattcctaagaaatgtttacagtctaatgggaaaattagacttacacatattccattgagcatctgaaataattgtgtatgtatttgggaagggactgactgttggtcaggtcttagactttctaagagactcatctcaatcttcctggcgctttgttctaatacatgagctgatctcccaacacaggcacaggagagcgggctccttgtgttgtccttcacttggttcccaaggggcacaaggctgagtgcttgagagagtccaagtgttagacagtgcaggaactgagggtttggttggagggagacattgaggagggattgtgctagattttcatcagcctgggagagacagtgatgggggtcacatgtgacagtgccccagggtgattatttggtatttattagtgttgacttctgaaggtattttgaggcagttacaacaaaaggcatatagataataaaaccatttgtcttcttttcttttttttttttcttttttgagacagtttccgtctgtcacctaggctggagtgcagtagcgtgatctcggctcactgcaacctctgcctcctgggctcaagcaattctagtgcctcagcctcccaagtagcaggcatgcaccaccatgcccggccaatttttgtatttttaatagagacaggattttgccatgttggccaagctggtcttgaactcctggcctcaagtgatccgcccgcctcggcctcccaaaatgctgggattataggcgtgagccacacatgcctggccttcaaaccatttttcttctgttccctaaatatagctgagttaataatcatttaaactttggcttatccttttaaagaaactgggaaaaataactgtccccaaaacctgggctgtaaatagttactacatttgcctaggaagagtctttggctattagaacttttggcctgaactttggaacatgtagaaaataactagtaggacttcatatcaatttgcatagattttgcatatttctttgcagattgtttctctgaagataagtctgcctgtaattcagcaaacatttattgtatacccactatgtgtgagattctgtgctaggttctacgatcccaaaatagttaagatagtcttgctgtcaaagatatcatggtctagatgagaagacaaacgtggagataagtaccacataatgaatttccatataggttctttaaatacattacatgtttgtggcatgcacagaaacactggtagttttttttttcttctcctctaccctggatgtatataactgaaagagggatgtattcaactggggaaaatgaagcttgctgctggcagattaggatcccattgcaaaacaaaggcagaaacagctcattcttgcatccaactgcactttgtgaggctcctgatggggcacagctgtttccttggcccctgagtatgtgggaatgaagcatcatcggccccacagctgctgccccgatgcccccacccctaccctgtgggactcacaccacagagccaggggtaaggtattggatcccggcagctggtggaagtgggcatgattcacttcagcatcagaatctgtgccacccttccatcaacctctccttctgaccttttcctgtgcagcaggaatgcaatgcagctttgcaaaccctgcccatttccttccaaggaatcagctatgggtatattgtgggagataaacgacctttctctctctctttgtgttcctctggagtcatgagggagtaggtgagaggaagtgagaggtgtggtgagctggaagttgtccagttggcctggttacaagggcctctccccttgggaatgacctgggaaagtcagcgggtccagggaaccccgtgatggccacttactcccaggcacattggaacagccctcttagtctcgtccccggtcaccgtctctccttgcctcctgcaggggcatgtccttccacggcaccaccatcggcctggcccccctcatggccatgtgctctgtgtaccagtctggaggagtcaacatggtgagtctcagcccgtgtgtgtgcgctgcagaaggcgctgagctgcctttcaagaccagaggtcatcttttgaataataagttgatatttattattgtagcagaaaaagctttgacatcaggaagggcaattgtttaaaatgaagtcattaagttctaagagatggaggtactgaagggtgaattttcatttattatagttcattccgtatcttcaagctcaggaaccctgaagagattacatgcatacatcactagatctcatatgttccaaaccaggggctggaaaatagtaagagagtagaggttaaaagtatttttatttcaggtcgtgtgctgttatatatgtcattaagaaacaagaacctgtctcaaagtcatggttaggaaattactgccttcttttgaaattcactctgacttcatgagactatttgttttgactcttcatttctaacctgtgaagtgcatatcaaggaagacttgtcttcatctatttgtctgtccctctatccattctgtatttatcgacaaagtagcataatggccaaaaccacaggctctagggtctgagcctgttgggttcaaagaacagctgtgtgattttgggtgagttaatgagtgttctcagctgtaaaaaacgcatagttttacagttgataatcataggataggaatgggaattaaatgaaataatgcaggaaacacacttccatgtttagtaaatctctttctgctgcttctttcctgctgggtttttttcctcttgatttctttagcttttgcatcatcagacagtacaccaagtgctgtgcctggagtgtatctgtcttgtgtggttttctcaggaaacactaagccaagtacaccctatgtttgaatcaaggtcgtgttttctatgttgatttccttatgtctggagaaatatatatgttcagaagaagaatggggaaaaatcttcctcttttatttattctgaaagcatttattggtctggaagttcatccataggtcagttgtggtctgcaacctttgagaactcaggaaacatggacttttaaacatttgatttcctcctagtgacagcagattcagccttgctgtcagaggcacatatggagagtctgtatgctcagtgacagtggaattggtggagacctgcaagacttggctaaggataaggcagggatggggggcagaggcagatctgtccccttgaccttgacctcaactctgtcttctgagcaggaccactccgagaatgccattggcgtggctgccaccatggcccacgagatgggccacaactttggcatgacccatgattctgcagattgctgctcggccagtgcggctgatggtgggtgcatcatggcagctgccactgggtgagtcaaacagcaagagggaggatggggaggagggcgggcacacctggacagtgtgacccaggggttcctcccagctggccccactgagactcccttaaacttctgatggggccaaaaaatgtagtttttacaacaaagaaattgagagaagaccaaggcaaatgtgcagcaagaacttaactttccagcaggaggtttggtgctggtgtaaccctagatttatttaatttctgttttaaggtgttgagttataaaattggcttggccatatgtgtcttttttatttcatgaattttttatgaggacacattttgatcatagccacagcccttaattcttctatcccaagagagttggatcagtgctgtttcaattccaggcttcactgaaagctccgatgtaacagaacaagttgaagaagagggccatccacacaccccacagtgacttctcagggagtttgcaggccacattacccatgaggaacagggtgaggcagctgcatctccctgtggtcatgaggaaatttttttttttttttttttttgagacagagtcttgctctgtcgcccaggctggagtgcagtggtgtgatctccgctcactgcaagctctgcctcccaggttcacaccattcttctgccttagcctcccgagtagctgggaatacaggcgcctgccaccatgcccggctaattttttgtatttttagtagagacagggtttcaccatgttagccaggatggtctcgatctcctgacctcgtgatccacccgcctcggcctcccaaagtgctgggattacaggtgtgagccaccgcgctggacatgagggatttttaaaaccagagtctctgaagagaattagggagtttcttcaaaggacttgtcttctagcatctgaactcaggcagcacaaagcattgggttcttccaggctctttggaaggcatcacgttgggaccttgtgttccttcaccccacaccattagggcctgtttatgattcttagagaatggtgtttcaatgtctccaagaaacagtgcagctttcttagagctctggtgtcaattttttaaaattatttctcagctgcttagagcacatcaannnnnnnnnnnnnnnnnnnnnnnnnnnnnnnnnnnnnnnnnnnnnnnnnnnnnnnnncctggccaacatggtgaaaccccgtctctgctaaaaatacaaaaattagctgggcgtggtggtgcacgcctgtggtcccagctactagggaggctgaggcgggaaaatcacttgaactcgagaggcaaaggttgcagtgagccaagattgtgccactgcactccagccttcagcctgggcaacggagcaagactccgtctcaaaaccacaacaacaaaaaaagaatgaggcaggatacagcttcacagtcatgcctggatccctataagctcatggttaagctcacccctttctctctcaatctaaaaagcgtatctgaagacaaatgattgagagttatattgattactactctctttcatttttaaattattcacaaatatggatagtttaacaattattagtaacaaattccttggagcataccttcccactgaaggaaaagctccagtttcttggagggtttaacctttaattggtttagagaattgggagcaggataactctccttttgtagacccagatggctgtactatttgtccttttcaccaatggtgggacccaggaccttccatactcctgtgataaagagcatgcgtttatgagttggctggttgagtttggaatgccctctgcatccttagaacagcaatgagatcactggcccaaaatgaaataaaacttatgatcttggcctttttttggcctggtcctctgtcacaagagaatattcacctgatatcagcttcaggaaaagtttaggttggctggtgttttcttcagtgctaagtctcaggagacctcttgtaacacactcacaaccctttacttatcgcagccccctcatgcaatgggcagaaattgctactcctgattctcaaatgctttctgcatgccgactaagaaaaatagaatgttatggggtggttaatatctcatcactaaggatgaaagaattcttttttttttttttatactttaagttctaggatacatgtgcacaacgtgcaggtttgttacatatgtatacatgtgccatgttggtgtgctgcacccattaactcgtcatttacattaggtatatctcctaatgctatccctccccgcctcttgctaccctacaacaggccccggtgtgttatgttccccttcctgtgtccaagtgttctcattgttcagttcccacctatgagtgagaacatccggtgtttggttttctgtccttgcaatagtttgctgagaatgatggtttccagcttcatccatgtccctactaaggacacgaactcaagggatgaaaaaattctaaattaatgtattggtaaatgttctaaggggccagaatgtatgtgtgtgagacaatgggggtctgaacccaggtggagtcagccccacgggtagcaggagtgacagcacgagtgacacctgcctgactgctagatgctcaaactccccactaattccagccttgtcctctgccaggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggtgaggggtcacaatggtgctagtgggaggggaagaatttgcattggtttcaaaactcaaggtcaaagagaacacaattgaaaatttcttagtcacaggtgtttcctacatataactgtccaataccccatgaaaaatcagatatgaagaagccttccagttggagtgtttgtgccgcctctgctagtttgtggccagcatcgctagtgtccaggatcagttcttcttatgagtgtctggtctaaccagaaaccacgatcacgtggcatgttgactctgtcttcctcagtggagctgcacatgcctgcttgccctccagctgcacggaatttattctggaggccacacagccagatatatgggcttgaacaggggccttatgaggatgcttaaaataacaagctcatgctgtttaggctggaggagagatgatggaaaggggatgtaggaagtgctgtcaagtcccaaaagggctgctaggaggaactgtttatgtgtaaactctctccttccttctgatcttcacagtgagtgtggagggtacacggcagagcccggtcatttttaacaaatgcatgtggtttctgcagaaagcagaactggattgtttcgtctctattttttgaaggctgaaaatatgtatgtttatacatgcataacaatttggggtagataacaagtaacagtaaattatgggggtgagactgaggttctgtataaatggaaaaaaaaatctgattttatggccttctctctctcactctgttgcccaggctggagtgcagtgacaagatctccactcactgcaacctccacctccagggttcaagcgattctcctgcctcagcctcctgagtagctgggaatacaggtgtgtgccaccacacctggttaatttttttttttttgtacttttagcagagacagagttttgctacattgaccaggctgttctcaaactcctgacctcagatgatccacccacctcggcctcccaaagcactaggattgcaggcgtgagccaccgcaccctgcctgtgacctctgtgatgtgatttttctttttttaatgccagtatgtcactttcagaataaaacaagaactagtcaaggatgccacccccaccaccatgagcccagagagatcaacacagacccatcagaaaggagggagtggtatgaacatggagggccactggggttgaggaatggcctgagagtgggcatggccagttggcttaggttctgagcagttgctcattcaacaggcacactgagtgtgggctactgtgtctggtcctagggttaggatgagtggcaaaaatgacatagttcctgtccttggggagctgatagtctagtgggagaaacacatattgaaataattgcaaaagaatatatgtacagtccatggcaagtgctaggaagacaaatgacacagtgctctgaacatatataatgtgagggggaacctccttgcttgtgtgggaggtgacctggagcccatatctgaaggctgcattaggagttagtgaggcacgcaggagggaaggcacatttcaggtggaaggggagcctgtgccttcgtgggaagaaatatggtacattaggaaggcaggaatacaggtcttcctggagcccaacatggtgggagaataatgggaggaaagtgttctattccttctcttaggggagacaggtggacaggtgtctgtggtcaggggatgggatgtggctctccaatatgctagagccctggacagttaggggtataaggttgataaacatgaggtaggcctcaggcagacctgacttgaattcagcaggtgtgtccctcggccagctactggacttgcctgagccacagcatccctgtctgtggaatggggtcaaggctgcctcataaggctgtggtggagagatctgtggagccccgtacacttttcatcaatggctgatggattggcctgttaatactgtaagagtgtgatgaggacgctcagggtcactggaacgcctcataatcttttaaaaatctcaggctgggggagagcaaggaacccatggagatcttctgttccagaaaggtccaggccaggaagggcttaggaagagaagcagatggagaaaaaaatctaaggaaacagacccaggagttgacataaactgtttggagaggttgttccagcagactcttgcaccggcagccccttttcatgagataagaaagcctaggagggttgggggcaggagggcacccatgaaagacagggtgtctggatgttctactggggattagaaaaacaaaacataaaatttccatatactctgctaaaaagtccattttagaagactacatggttacagggagaaatacgcatgttatattaagtaaaaaaacactgtggatactatgattttgtaaagtaagtataaatatatatgtatgtgtgtagaaaatgccttgaaaaatattcatactcaaaatgtagctgtgtcctagcggggcatggtggtgtgtgcctgtggtcccagctacttgggaggctgtggcatgagaattgcttgaacctaggaggagaaggttgcagactgtctcaaaaaaagatgtagctgtgtccaagtcatgttactaatgattgtgcatatatatggttcttgtgacaagtacacattagcttagtgacgaagctgtcacatgatttttgaggtcaaaagtttccaggccaggtgcggtggttcatgcctataatcccagcactttgggaggccgaggcaggtggatcacttgaggtcagaagtttgaaaccagcctggccaacatgacgaaacccaatcgctattaaaaatacaaaaattagccaggtgtggtggggtgtgcctgtggtctgagttacttcggaggctgaggcgggagaatcgcttgaaaccaggaagcagaggttgcagtgacccgagatattgcatcactgcactccagcctgggtgacagatcgagactccctctcaaaaaaaaaaaaaaaaaaaaagagatagttgctagagagctggggttccaggggtgtgtgggcaagggtggggaaaatgttgggggtggtgaaggccctcccccactcacacccaccccactgcctccccaggaatgtaacaacccctgctgcaatgcctctaattgtaccctgaggccgggggcggagtgtgctcacggctcctgctgccaccagtgtaaggtaagtggcccttttctccacgccttgggccctggcctgacagtgggaccacaggactgctctgctggggtggatggctggggatttgcctccatcctggggctgtgatggcaacagagtttcagaaacacagagcggaaaaggtgccttgaataaaatttactattcctatactgggcctcactgaattcagatcatcccagaggagggtggcgcttctttggaaatggtacttttttttttcttttttaaagaagtatccagagagagtgggcttgattttattgagctcataaacaataataattatcatcatttgtattgacattaatggacctcttagtagatgccaggcactgtgctgggaattttatgtacgttatctcattctctcctcacaaaaaccccataaaatatatgtgactatccttattttaagatgtggaaactagagcttataggggataagaggtttatctggaatcaggcagtcaggaagggactgaatccagctttccctgactctggtgcccacattcctaatattgatgtgagagataaattgtctgttgctgctagtgttaccgtagaaccacaatctctcttccacaattctgaaattaagggagttctaaaagctgaaaaaaaatgtaaacacatttggtggcaaaacttgacctgaattgacatgagatgaattatagtctttttaaaaaaaaatcactcctaaagtgaatatttatattgcattacagaaatattaatatgtttgatcagaaggtgttatccccagccttgctggggggttatgtaatatacatatgtagttatatatgcggacatatgtaattatccatatccatatatatatatatatatatatacatacacacatgtgtaattatatatgtacacacatgtacatatggacctatgtattacaatatctgctttctaaatctgaaaagcctgaaccccatctggccccatcattttaggcaggaactgtgggcctgggcttctgcctagcacttgctgagtgctcgttaggggccagataccattcacatacttagttctaactcacgtttaatcacccattagtgggttattatcctgagttgtgggtgagtgagcacacacaggttacacagcaggtgcccaaggccccgctgccggttaaggagctgggatgtgtgcccaggcaggctggctgtggggcaggtcctctttgcctccacctgcctctggatggcagaggtgtgtcctgcagcctcctcctgcatacaccacccatgcccacacttgcgactgggcatccactctcagcaagctgctcagctggcccagtcttggcctgagagtggccggtggagaagcctgtctgccttctcctggaaggaccctgtgggtgggaggagtggcccaggagcaggggagggggtctgttctcagtcactggtttccttgcctggctctcggaatgtgcacggcatctggtttggctgtgcgtccccctgggaggctgtgctgggtcaagttcttccagtcttggcccaaggcctaagcataagcatggagtggaccccttcactccacacaagaatttccgtttgagcctcagaaaggattccctggtgtccaagactgacttcaaaccctggttgtgtgatttggggcaacctattaactctctgagcctaggttctttatctgtaaaatggaaagagtattagtaacaccgactacccagggaggctgtaagactcttcgccctttgccccaggtgtgctgttgatcaacttattgatctgcaaagtgggacaaatagcagtatctatcccatggaagctgtgaggatcccacgagatacgtgtatgtcacacactcagcccagtgcctggccccatagtggggatatattattgctgaggtgctttgtaaactcacagatgttatgtgaatgctagttttgtgtgtgtgtgtgtgtgtgtgtgtgtgtattagtgggcctggctcctctgccacttactatgagtctttggatgcatcgtctaacctctttaagcctacagattttatcatctgcagaagggataattatatcacacaggactgtcatgaaaactaagtgaagtcatatttgtactggacacttaagtgggagctgcataaaagtagctgctattactaaagcatgtaggaaactgtaaattgttgtataggtattatttcttgcctctttcttaagacttctatgaagagaaagtgagttagcatttgtgaaaacagcttgaaattctgtcagtattcacatgagaaggctgaaggtggtttgggctaatgaggtcatgtaaaaagtgctgtgaaatcatggtaatggaaaattctgttctatgagagtgatccttatgagcccttgggcaacagggttgagggtggggaggagattgactgtgttttcctctcattccttggctcagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggtaaggctctcctggggagcacggctctccccagcccaccacttcccagccagcctcccctggccctcagggtagtttggaatcttggcttcaaatggcacctctagatactacctctttcatccccttgactcagggtagatgttcagggagaaccagaggacagtgttccttcccagtcccttgatgcttttatttctcagagtggacaattgaataagagtaatccaaaagaaaaatgagcagaggatggagacagagaagcaaatgcaaatggcccttaagctatgaaaagacgtttaatctcagtcatattaagggaaagcaaagtataattatgatgaggtgagatttttcatatatcagattgcaaagactgaaagttaagataataataatataacaacaataataatgatatagtgttgtggagggtgtgaagaaacaggtagatataaccactatggaaagcaatttggagatatacttagaaatgcagctaacacttgcacatgtatgtgaggatatatttactatgatgtttactgcaccattgttagccatagcaacaacaacctatgtgtccttcagtagggaccaattaaattaattctggtacattcatataatgcaatgctttatggctaaataaggaggcagccctatatttactgaataaaatcatcttccacaaaaaattaagtgaaaaatgcaaggtgtagaacagcaaataaaatatgctttcaagccagatttggtggcttgcacctgtaatcctagctactcaggtggctgatatggtggcttgcacctgtaatcctagctactcaggaggctgaggtggggggatggcttgagcccaggagtttgaggctgcagtgagccactccactctaggactccagcccaagcgacagagggatgtaccatctcaaaaaaaaaaaaaaaaaaaaaaaaaaagactgggcacagtggctcacgcctgtaatcccagtactttgggaggccaaggcaggtggatcacctgaggtcaggagttcaagaccagcctggccaacatggtgaaaccctgtaactgctaaaaatacaaaaattagccaggcgtggtggtggacgcctgtaattccagctactcgagaggctaagacaggagaatctcttgaaactgggaggcagaggttgcagtgagctgagattgtgccactgcattccagcctgggtgacagagcaagactctgtctcaaaaaaaataaaaaaagaatatgcttccattctttattagatagattatctctagaagatacacacagaattatacctaggagatacagaaattagagatttaagtatctttagaaaatatactgttaataagtgctattcctccaggatgtagagaagtaggaactggatgactacaagaaaaattttccaagacatacttatatctttaaaatattatgcatgtatgacctattttttaaaatcttgaatcggaacatggcttcttcattagagagcaggcttagcatgcaaccctccccacacacaaatataaatcctcaataaggtaggaagaatttacataaaacaggccaggtgtggtggctcacgcctgtaatcccagcactttgggaggccgaggcggggggatcatgaggtcaggacttcaagaccagcctggccaagatggtgaaaccccatttctacaaaaaaaataaataaataaatacaaaaattagccagtcatggtggtgggtgcttgtcatcccagctactcgggaggctgaggtagagaattgcttgaacccaagaggcggaggatgcaatgagccgtgattgtgccactgtattacagcttgggtgacagagcgagaatccatctgaaagaaaaaaaaaaggatttatataaaacattattctctgagtagatcttgttgagaatatggggatggagtaacctggagggaacaggaagaagaggctgagtattccctcccagaaaatattcttaccttcatgactttaccaaagatacctttgcccttgggggcttctgacagatgagtatactgatagatgttgcttgcccacccaggagcccgacctgcccctgacctctgcttcgagaaggtgaatgtggcaggagacacctttggaaactgtggaaaggacatgaatggtgaacacaggaagtgcaacatgaggtgatgaccaaagggcaggcctcatgaaatgaggatgaacaagcagtttctgctctgtcctcactgttgcccaactcagcagtgtgactggccccagagctgcacctttacgtcaatcagttgaagtcagtcatctattctcggccccctgtttgacaatgcacttttcagctctgaggaagtcagaggagggtgtgggtggcagtgcttcctagaaagctgatcgggcttcctttggggaccatcttacagtagggcagggaatcagcccttttgggtcatttctgccaaattctaatcatgccctaatttgaatagctcctcattcattaattcactcattcattcatttattcatcattcattccaaccaaccatccactcatctgtctacccatccatccatccatccatccatccatctatccatccatctaccacccactcacccactgatccatccatctatccatcctccaccacccactcacccactcatccatccatccatccatccatctgtccgtccatctatccatctactatctattgaagatttactgtctatctactatctattgaagatttaccatgtgcaagatattgtgctgagtgcatggaacttctaattaacaatatagtatgacaatggcaatgtggagagagccatccaacccatcttagtgtgtcagagtggtttcccaaaggaagttatacctacactgagatctggagcagttacctcggtgaacagggtggaaggtggtgctggtgcataggagaataatccaggaagagagatgaatagagaaaaactggtggttgaaagaactgagaacagtttgatacagttaaagtataatgttggggtgcaaaggagaaggtctgctgagaaattagcctggatagtttagcatggaccagatcatgaaaagcctcaaatgcatggctaggggagtttagattttagcttgagagcagtgtgaaaattagactcctatgaggcagactggaggcagggaaatcaatcttctgcagaccaggtaaggggggtggggcagtgtgaattaaggtagatagataataagatagataattaaggagggaagattgatagggtttgaaaatggcttgagcccaggagtgagggagaatggggagttggagatgaccccagatttctagctggaactcctgggtggacagcggtataaggggcaaaaagggaaagattgctcagctcaggtggctattcttggagttaaggacttttcgaggccagttctctggtctagatttgctcagggtcaaggagcctgttctcttcccttggtgtcagtccacatggaatctctcctggtgggttccaaagcacatgactgccctaaacctttgccccaccccacgcaagcctgctgtcttgatcaagaaagactgaagctctctggtgccccagctcttcctctgcctctgattccgcttccttccctctctgtctcttgtgcccagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatgtgagtcccctcccctgctcacctaggagccagctgcagagcagagtgattgagaagtgaggtctgagggaaggatgcctgggctcagatgccacctcgccaacctctgagccttggtggctcccttcatgaagcgtgtatagtgacagcaggcacccaccccagagaactgtcggaaggattaaagaaaatcatcccagtaaagcacttaggtggcctagctagtgccactttcatcctcatcgctaattatcataggaattaaaaatggactaggagttagggaagcctgagcaaaataatagcacagactctatcctccagagtcgattctgataatgaaactatggaaaacatgaagcatttagcatagcacctggcacagagtactgtcaccatcattatttttaaatataatgttaaaattgatacatattaatgacaagtaattaacataatcaacataatagtcctttaatgtgataacacataaataatattgtattgttaaatatgatactttaacaatatatttgtcgttttctccctaatcacaaaagtaatagcagaatttagttggctgttgtcctgtccttagcgttgtgggctgttttccatttttcactttgatagtaacctgaagtgtgctgcctatttgggccctcatactttttttcttttaagatggagtcttgctctgtcacccaggctggaatgcagtggtacaatctcggctcactgcaacctctgtctcccaggctcaagcaattctcctgcctcagcttcccgagtagctgggattacagacacaggccaccaggcccagctaatttttgtatttttcgtagagatggagtttcaccatgttggccaggctggtcttgaactcctgacctctggtgatccgcccacctcagcctcccaaagtgctgggattacaggcgtgagccaccaggccgggccatgggtcctcatatgttccaagtgcaaaatcttgcctcctaactcccaaccagcatccctcccattgcactgatcgttctgttttctctccgtgcagatttgctttgaggggcagtgcaggaacacctccttctttgaaactgaaggctgtgggaagaagtgcaatggccatggggtgcgtgctgggttctggcttctctgtgtcatggggacgtcatgagggcaggccctgtgggtggctgatgctctctggggtgctgatgcctctgccctttctttgctccaggtctgtaacaacaaccagaactgccactgcctgccgggctgggccccgcccttctgcaacacaccgggccacgggggcagtatcgacagtgggcctatgccccctgagagtgagtgccagcctgctggggccactgcccgcttttgtgagaagagcgggcatcaggggcaggtggcatgttgcagagcatccacattgaatcagcttcattgtcctgattttgtagagaggaaatcaggataaagacagaccaagagagaggagcgactgctcatagtgtggtgtggggacacggttcagtctctcttctcccatcctttctactgaggagggggagcccgcttagtagagtgagagtaagagagactgtaggtcattgaatgttcccattctttttaggggacacggtgactatttctctttgggcacttaaaaataatcatgaacctgggacacattatggtggtttagatttcctctgatggacacaagttaaaatggagaaccagacactcagaaaattttatagtattttagtggatctctcaaggattctagcactatgatttctaaagttttttttttaaaaaaaatagcaaataactttaaaaaaaaagcaccaaaatctttcaaggaagaaaccccaatatgtaaaactgataaaaagtagtgttttgttagtacaaatacgttctctatatttacattaaccacttgagagaatattggggtagttttgatgaaaccaaatgttaagttatggattatgggtgagatgtctagtcttaaatctgtctgagtctttttgtttctttgtttttttttttttttttgagacggagtcttgctctgtcacccaggctggagtgcagtggtgtgatctcgacttactgcaacctccgcctcccgggttcaagtgattctcctgcctcagcctcctgagtagctgagactacaggcatgtgccaccacacctagctaatttttgtgtttttagtagagacgaggtttcaccatgttggtcaggatggtcttgatctctttaccttgtgatctgctgaccgcggcctcccaaagtgctgggattacaggcatgagccactgtgcccggcccataatgtgtgtttttaattataatttgtaagttaaaataagtaatacaaattaaatgcaaatcaaatgcctgaagaagaagcacgaatacctattttgaaatctgctgtagccgagacagcttctaaatctcccacttgggttctgtttctggaaggtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcaggtatgacagggttcaatggaggactcagggtcaatttatgggtcacaaaggtctccataaatggtacttagcaaaagtgttggtgatagtgggtctaattcagggaagacaagtgcaagatacatgctgccctctcccctgctatgactgtgacaggcattactagttgatcttattgtaagtactctactgattctggtcatcactcctgagttcttctcagcagaatatccccaaccaaatcaagttgaaatataaaataaaatctatttgccatcctttgtctagttgatttattccccattttattttatttatttttgagatggagtttcactcttgttgcccaggctggaatgcagtggtgcaatcttggctcactgcagcctccgcctcctgagttcaagcgattctcctgcctcagcgtcctgagtagctggggctacaggtgcatgccaccatacccagctaattttttgtatttttagtagagacggggtttcaccatgttgaccaggctggtctcgaactcttgacctcaggtgatctgcccgctttggcctcccaaaatgctgggattacaagcatgagccaccatgcccagccccctctttgtctttttaaccactgttgctttaaagtttgtttcatctggtataagaatagctactcctgctcgcttttggtgtcccatttgaaaagtgatgtattattttggatatggaagatgtacagtctctgagtcacctattaaataacacttgttctggaggggattttaagtcccaggtctttctggatctatgcctgatggggattggttgatggctcgtgacacccttgtgtctcctcacaggggaagggtcttaaaagggtgaagagaaggtgctgagagagctctgctttgtataaggccaactctgtttccttgagagttctccattggccacacgtttttctacttaggaagatgtggttcgagaagaccaatcccactccctccagagcagacttgggaaagatttagctgcttgctggccgtgcttgggtcaaagggaactcaggcactgtcccctgctgaacatcgtcccctttcttttcctcccccatttcttgtttctagttgtcccttcagggtttctcagaacagcgggactggtcatgccaacccaactttcaagctgcagacgccccagggcaagcgaaaggtaagagctttgcaccactgaactttgctacttttcctttatccctcagggccatgctgtatttttctttttgagatggagtcttgccctgtcgcccaggctggagtacagtggcgccatctcagctcactgcaagctccgcctccagggttcacgccattctcctgcctcagcctcccaattagctgggactacaggtgcccaccaccatgcctggctaatttttgtatttttaatagagacggggtttcaccgtgttagccaggatggtctccatctcctgacctcgtgatccacccgcctcggcctcccaaaatgctgggattacaggcatgagccaccatgcccggccgccatgctgtgtttttctaagagcctctgtgggcccatgggattggtaataaaagcccttttattggctggagagacatgttatttggttctgacatcccctaatgactttaaaggttgcatctgacttctgggatcctcaggggtttaatagattggtgtgtctgttctccctttgggctctggtttatctcaaagagacacacaaggccagccctgagtgatttcttgtctcaggtgttccttgacttgtgcgtacaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggtaagtggataatcagcaaccttgggctgggaacattgcttttaaggccactttcaatgggtaatggcaaaggtggggaaggtgaaacttgtggggtcatgagctgactgccttttctgcaattcagtcaatacgggggcgcacagcaggttagagcaacgaacgtggggaaatagactctctaagaagctcctaaaccatgtggcattttctcccgggttggcctattttatgacaagccactacccaccttccaccccatattaacttctgtcagttcccccatgctcgtctgcctgctaggtctttgtaaatgctgcttgttctgcctgatacgctccttctctccttggtggggccacctcctgctcatcctcagatctgctcctagatgccgcttctcccaggaagtctatcctgattcctcaattctgaggttgatgggactgtacttctctcatcatagtactcttcctaccaaattgtacctattggtaccttctactgattggaaagtcttagggatgtatcctgatgccttgcccatcccaaggggcaggtgcctctgggaggtgagagtggggtctagactctcccccaccagccctggtgctcttggaggcatagcctgcccagcagcctgttcccactgcgtgtgtgtgctctgatggctctgaccacaccttctgcaggagatcccccagtgcagacacaggtgtttcctgggtggcggccgggtggggtgccttctggaactggcctgtgtgttttgggtgtgacccctcaactgagactgctttctctgggtgtaatccagagggctccatggaacccaagctgtctctgaccctaaggactctggggttggctgcaggctttggagggtccttgggatgtgtggcagtggtacagtttgggaaggctgagggcatccattctgtttctctgctgtgaaactgctgctctccccttccttttatgtggggcagaggtaggatggaaaaatccatgcagaaagagaggaaagattgacagggagagagaaggaaagaggaaaggaaaaaagcaagagaggggaggagtggagagagagaggtggagagtgtactcgtgtgctgagggtgctatagcagagtactgcacactgggtggcttcaaaacagacacttattttctcacagttctagaggctaagagtccaaggtcaaggtgctggaagggttgatttctgaagcctctctctgtggcttgcaggtggccgccctcttgctgtgttctcacgaggcctttcctatgcacttctgcctccctggtgtctgcctgtccaactctcctcttcttatgaggacaccagattggattaggtggcctcattctatcctaatcacctctttaaagaccttatctctaaatatggtcacattctgaggtactcagggttagggcttcagcatatgattttttttttttaaatgatgagtgcacagttcagtccctaacagagagatgaaagaaagggagaaagcaggcgtgtagagacttggggttacaggagaacaggggtgccagcagagggaggagggagtgggtcgggcgagcagtccactcagactgttgttctgaaaaacccacactagaggcatgttcagagaacacggggccagcctcacccctgtcacccctaggtgctgagccgtaggtcaggaagtgtcagggacagcggggacccagctgtctgttaagtggtggaggctgtgcataccctgcacctgcacccctgggactgctggcaggagtcccgggtgcaggaagctgcccagccagtggcaggcaccccaaaacacagcccccaagcacagcttctcctgggccccgggtcccaggtgggtgtctctctacaagcgaacagtgggaggcagctgctctgagtgggggctgctgtgatgacattgggctgccacctgcctcctcacagccattccaagaagggagttgctgcagccctcatttctcttggaggttgccaggcctcataggattgaagggacttgcccgacattgcacagttgtgagtggaggagctaggacttgaacccaggtctcatccagctgagtgagacagcctcctgccctggggccactcacagtctccagtctgccatcaaagattccccacctcctagctgggggacatggaccccctggagaagtgatagatgaaacctcatcacttcttcagttctgctattctaaaccggcttatgcacctgcactctgggccaggcaatgacgaggaaggcagatggcagctttgcctccaggagctcacattctgctggggcagtgactctgggatatgtgtcactgcaacagtgatatgtgctgtgaaggagaggctcagggtgctcagaagagagtaacgaggatttgacctaatctgggaaatccaggaaggtttccctgaggtggtgacatttgagctgagacatgaaggaggaacaggacttaaccaggctgtgagggcaagtgatgaaggagctttcctggtcccaggacccactagtagggaggctctgtcatgggagagggccctgtggattgaaggaacttaaaggtttgtgtgcttgggtcccaaggagctatgagatgaggctggaaagccaggaggagcccgtctatgcccaggccacatagccttggtcaggactttggtctgtattccataggaagaggacagtggtgacatgatgcaattttctgttgacaaggattgatcactctttgggatatctttaggcaggagagaggtgtagttcctgcaaggggcccatagatgcttctgaagctgttaatctactgtttgacctgcatggggattacttagtgtattcacgttgtgataattcatctagttgtatatttatgatttgttcgcctttttctgtgtgtattatatttgaatttttaaaatagttttaaaaaatgaaagtcactctagaagcaaatgggtgtcctagttagaagatttaaaggttgtcctgaagaaagatggtaaaagcttggagcagggagtaggcagggctgatgaagtgaagctgatgagaaatgtgcagaagagaaaatagataacgagttgaagatccattgcttggcaggggatgacgccccgtgtcaggcttgtgcaatctgattgagtaagatgccatcccttgtggaagggagcatgggccagagtagctgagggactgtttctgctctagaaaaaggaaaacagtgctgggcgagggccctggtagggctgagttggatcatcgcagatgtggcctgtggctggttgccctgggaggcccagtgctgacatgctgatgaggctcctgcccaaactccagcccctcagtggctcatttgcacagctcccttgggagcacagcctttcccagttgcaacctgacatctgcacccagctgtcacctgccccagaaggtctctatcctggcttccagcaaccattgcaacttggcagctattctgagctggggaaggtggtggtgaagggggcgggttgtattgtccttctagatagagctgaagaacatggctttttggccttaagaatttgctttagtttctgattccatgaagcttcttggggaaaatctcggctctttgtgttattcctgccctctctatgtgcttgccttttgtccactttaatacgtggtagtgaccctctcgagaagggaaggaagtcaaggggagcaggcactggaactcccttctatgcagttggcttccccttaaaccccaacagcttgggggcctgcgggtgggacagtcattctttgccccttaaaaaacaatggatcaactaatacgtgttgagcacctactgtatactaggcactgttctggaagccaaagatgtatcagtgaaccaaacagatacggaccccacactgcttccactctagaggggaatggagagacacaaagtaaaaatcaactggataagtaaataaattatatatgttgtaaggcagtaagtgatatgaaaagaaaagaagaggtatattaggataaaaaggtcagggaatgtcagggtgggggctgttgtaattttaaataaggtagtcagggcaaagccttgtggagatggtgagaacatgaaggtaatagtaacacaggaaggacagaatccatgaaatgtgccacacacatggacaaccaacatgaacaaaatatagctgctgctttgtttaaattttgttttaatcttaacaggcaatacacgtacatgctcttgttaaaaaaaaaaaaaaaggaatgttcaagggctgggcgtggtggctcacacgtgtaatcccagcactttgggaggccaaggcaggcagatcacctgaggtcagagttcgagattggcctgaccaacatggcgaaaccccgtctctactaaaaatacaaaaattagctgggcatggtggtgggtgcctgtaatcccaactactcaggaggctgaggcaagagaatcgtttgaactccggaggcagaggttgcagtaagccgagatcatgccattacactccagcctgggggacagagcaagactccatctcaaaaaaaaaaaaaaatggaatgttcacctggaacacacccctccccttttgcaccccatcccagtgtaatctctttggtctgtatccttccttttttctgttacagacatttctattaggcggtgagcgtgctgacttattttatgtcaactatcctctacagcttgtttgttccacctaacaactcttgaacatctccccacgccagcccctatcaacctacttcattctttttaagtgctatatcatctgtcactttataattttagttatttttctgctgatgaaattttgcttatttatagtttctttgctgttacaaacagtgctgcaaggaacaaccttgcagtttcatttttgtgcacgtgtgcaaatagttctctaacataggtcagaagaagtagaattactagatcagagaacagttatttgtaattttttttattatactttaagttctggggtacatgtgcagaatgtgcagatttgttacataggtatacacatgccatggtggtttactgcacccatcaacccgtcatctacattaggcatttctcctaatgctatccctcccctagccccccaccacccaacaggccccagtatgtaatgttcccctccctgtgtccatgtgttctcatttcatgttcatctcccacttatgagtgagaacatgtggtgtttggttttctgttcttgtgttattttgctgagaatgatagtttccagcatcatccatgtccctgcaaaggacatgaactcatccttttttatggctgcatagtattccatggtgtatatgtgccacattttcttgattcagtctatcattgatgggcatttgggttggttccaagtctttgctgttgtgaatagtgccacaataaacatacgtgtacatgtgtctttatagtagaatgatttataatcctttgggtatatatccagtagtgggattgctgggtcaaatggtatttctagttctagatcctccctatttaataatggtgctgggaaaactgtctagccatatgcagaaagctgaaactggatcccttccttacaccttatacaaaaattaactcaagatggattaaagacttaaactaagacctaaaaccataaaaaccctagaagaaaacctaggcaataccattcaggacataggcatgggcaaagacttcatgactaaaacaccaaaagcaatggcaacaaaagccaaaattgacaaatgggatctgattgaactaaagagcttctgcacagcaaaagaaactatcatcagagtgaacaggcaacctacagaatgggagaagatttttgcaatctatccatctgacagagggctaatatccccaatctacaaagaacttaaacagatttacaagaaaaaatcaaacaaccctatcaaaaagtgggtgaaagatatgaacagacacttctcaaaagaagacatttatgcagccaacaaacatatgaaaaaaagatcatcttcactggttatttgtaattttaatagatactgccagcttgctctcctgacttcctcttgagaatataaacacattatacatacagtttctttctaaatgggaccatacagtatataacttttatctatctgattttaacctgtaagatatcagggatattttctttcaaacaggcctctggccttcaagtgaggcttattgctttctctccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaaggtgagtccacgggaagccctcaaggtgaaagctggtaccagagggctccaggggggcaggtgtagagttgagaaaacaaagcaattcatgcttcttgtggtctggactgaacttccagaacaaaagccaagggcaaaacattcatgtttcttggtgcccgcttgactgtggagttttggcttcatgtgaaaggtgattcttagaatcctgagctgtggtggcttcagtcctgcccctgcacctgacctggggagggaccctgagcaagtccctcttgagtctgtttcctcatttgtacagaggctatgatgagcagtagtaccagccccatcaggttgttgtgaagagcaaggaagtgcattagtagaagccacctggcctgcgggaggctgtgtacacttggcccctcctcgtacttcttctgtgtggctgacagtctcagtttgccagtcttggcagtcaggtcagaaagggatgaggtgaagaagctggctgaccatgctgtattcccacgaggcattgagaaaactatggactgtgctgctgccttagcagggaagggaagagggaggggtggctggtcagcttgagataggggcacctaccacaccccttcctgcagggctgatggtctgggtgagtggacacatggatggacttcacaagaagcctttgttctcagtgggtggtccatccttccttctaaaatcgggaggatggctgcccccttgatcccattgatcagcatcaagctgatgtctctctccctcccttctttttcttcccagtttccagaatacagatcacagagggctggagggatgattagctcgaaaatctagacctgtccaaggggcttctccctttccttgagctctctggacactgcagaggacccatggccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtcctctctcacagtcggccactggatttccctcactggctctcaggagtgtgaccagagtagacttggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccatttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaa

SEQ ID NO: 14134 - DNA, 17156 bp, Human
aaacaaaaaaaacaaaccagagagagaagaagaatttgtatgttaaagccctaacccccagtacctcagaatgtgattatagttagagatagagctgataaaaaagtgactaacttaaaatgaggcttttagggtggccccgatgattgacttcttacaagaggtcaatgaccaggcgcggtggctcacgcctgtaatcccagaactttgggaggccgaggccggcagatcacgaggtcaggagatggagaccatcctggctaacacggtgaaaccccgtctctactaaaatacaaaaaaattagccgggcgtggtggcgggcgcctgtagtcccagctactcgggaggctgaggcaggagaatggcgtgaaccagggaggcggagtttgcagtgagccgagatcgcgccactgcactccagcctgggcgacagagcgagactccgtctcaaaaaaagcaaaacaaaacaaaacaaaacaaaacaaaagaggacgatacttctggggtgtgcaagcgcagggggacggccgtgtggggaaacagcaagaggacgcccatctgcctgcccaggaggaggcatccggagaaactagcccctcaggcaccttgatcttggccttccagtttccagaactgtgagaacgtaaacttctggttgagcctcccagtccttggtgttttgttctggcggccccagcgagcgggcgcgggatcgcagtgtttgcctttgcatctccagctccgcatcctgctcgctgtttattttgtgagcagctccggcggctgcccctgaactgctccgagactgagcagtttaactcacactcgcccacccgccctccccaggaagcctcccgcccgcttcctccagttccttccccacctgtccggcctcctagcccggtgctctcggcgcgggagggggcggctcgcagacccccaggtctcggcttcccggatctcccccgcctactcactccccggtccccggctcccggcactggcaggcgctgtggcttccgcgcagtggctgcagcatttaaatgtccggcacttagggagaggggtgcagtcgcggagcagccgctgctcccggcatctagaggggcccaaacccccgcgtgcccaggccgagccccgcgcgcagcccacgtgggctgagggactgagtattggccctccggcagctgcaaccgcgcacagctggagctggcggggcggagggcgggccgggaccccgcggggaaggaggcttccttcccatcctcctgctgcccggaaatccccccggctctcagacaacctgccccacggggtcctggggggaaggagaggggcgggatacagggatggggagggctggctgagccgaaggcccgggccgccctcccccaggccgcgcggcttcgagaaagcagaagcgagccctgccccggggagtcccacaggagcggggatctgggaagagaaacttgcggacgagggagttagagccgtggacccccggcccccgcccgggcgtcctgcgtcggaggagggtctctgggtcgggcaggggccacctcttggcccgccccttgtcgctggacgtccgaagattgggccatttcccttgccgcgcccttaccgcatatcggggtgcgcccggcccggcccggcccgccccacccagccctccgctcgcgcccggagaggaggggccgctggcgcagcgccccgggaccccgagaggccgccgcggcacatccagacctccgccgctcccgcgccctctcaaccatcctgggattcccgggcccacccgacccagcggcgcgaccctggccctccgggaccctccgctgactccaccgcgcacttcccgggacccccacacacatcccagccctccggccgatccctccctactcggtgccgggtgccccccgccctctccaggcccggatctcctcccccaggtccccgggtcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcctgggcgtggtgagcgcggggtccgcaggctcctggggtctgcagagagattgggagagggaagccgggcccggactcctgggtccggaggaggcaggggccagattccaatatccaaagagtgactgaggatggggtctgtgctcccggcttcttgggtctgtcgggaagtttggggctgggatttggagctctggaaaggagctgaggtgcggagctgaagtccagacaagactggcaaacccgggactgaagcggggacctatggaggggagcaggcaggcatccggggctggggccctgggctctgggtgcctgggaggggcagggctgccaggatggtggtgggcagagagagcccatacttttcacccagcccgcttcacctgccccctccgatgccctaggactggctgactcgctatggttacctgccgccaccccaccctgcccaggcccagctgcagagccctgagaagttgcgcgatgccatcaaagtcatgcagaggttcgcggggctgccggagaccggccgcatgggtaggtggcccccacccctacccagccctgcctctgcacccagcctgaccaccgcccaacagcctttagacctcagtgtgctcctggaacacggagctgtgaagatgctgatctcaggccccaaacccagagggcctcaggcgttcatctttccataagcatttatcaagaacctggtggctcatgccggtaatcccagggttttgggaggcggagactcaaggattgcttcaggccaggagtttgagaccagcttggccaacaaagtgagacccccccactctccaaggatttttttttttttttttgagacggagtatccctctttttgcccaggctggagtgcaatggtaccatctcggctcaccgcaacctctgcctcccaggttccagtgattctcctgcctcagcctcctgagtagctgggattacaggcacgcaccatcacaccaggctaattttgtatttttagtagagacggggtttctccatgctgatcaggctggtttcgaactcctggcctcaggtaacccgccggccttggcctcccaaagtcctgggattacaggtgtgagccaccgtgcccagtcctctaaggatttttttaaatttagctgagtgtagtggcataggcctgtggtcccagctactcagaacgctgagatgggaaaattgcttaagcccagaagttcaaggctgcagtgagctatgattgcaccgttgcactccaacctgggcaacagatggagacccagtctctaaccaaatatactttgagcatctcttagatgccacgccctttcagctccaatggtatagtgataaataaagtaggtaaggttcctgctctcatggagctaactttctcgagggagagagagagagacagatcaagaacataaatatgaaagataatttcagatggcggtgagtgtttagaaaaaaataaaatgctattggcattgaggggctggtctggttagggcaggtccctctgaaaagtgtcatatgagctgagaccacaaagaggaggaaccagccatgggaagatgtggaagaagagtgtcccgggcaagtgcaaagaccccacggcacgcagaagcttgtgtgcctggagcaaaaggagcattgaagagctctggcgagaggcctcagccaagggccctgaaaggtgattagggttgattccaagggtgattagcaaccacctaagtgttctcagaagggaagcaattcagaacttggtatgacttgcaatttttttttttttttttttagacagagtctcactctgtggcccaggctgcagtacagtggcgcaatctcggctcattgcaatctctgcctcccgggttcaagtgattctcctgcctcagcctcctgagtagctgggactacaggcatccgccaccatgcccagctaatttttttgtatgtttagtagagacagggttttgccatgttggccaagcaggtctcgaactcttagcctcaagcgatcagcccaccttggcctcccacagtgctgggattacaggcatgagccaccgtgcccggctttgacttgcagttttaagcttcctctgggtcctgatggagaatggaaggcaggagccctgagaccaggcagaagacggctgcggagtccacacgagggatggtggcagaaggatgggtggcatatgtggccagaagtagttggattcggggtgtatattttggaggcagggccgaggaactcttctgtggggttaagtgggcaggaagagggaatttgaaggatctggctcactacaaggaaaggtaggccctgtgtctgtcctggtgactcacaaacagcctagaacagtgtctggcatctatatgtccttcatcactatttgccgcctcaataaatgaggcgcagtttgaccttaatttggagatgaggctactggggatggagcccagctgggaaaggggaccccagagagacctaacccaggagggggtggcttgccacaggaggccagagacccagccggcctgggcactttggacctaatctgggtttgaggagaacttggcagtgatggtgtgaggcctgcacagctcccagggggttccagcctcaaagggtcctcactgcatacccagggctcctttctccagagtccgcccaccagggcccagggaagctggatgcaaaatcctggcctgagcctctgagcatcacctgcatgcagccagtttgtcccaggccaggtgacgccactccaaagggcagtaggaatggcttggtaggagctggcttccagagacagactgcctgggttcaaacctgggctgtggggccttcgagggcacatttcttgagccctctgagcctcagttttcccatgtagaaagttgactggtgctatgattaaggcaggctctcctattgtggacacaccccccaccgccaaatgtctcccgcagacccagggacagtggccaccatgcgtaagccccgctgctccctgcctgacgtgctgggggtggcggggctggtcaggcggcgtcgccggtacgctctgagcggcagcgtgtggaagaagcgaaccctgacatggaggtaggtcctggggcccacccgcaccctggccctgcctgctgggctccggctttgaatggctgcctgctccctccacggccacccttacacctcactcccctctccccagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaaggtaaaatctcctctcttatgagagatcctcttgccaggtctggtcttaagaataagttttctgttgtgtgttttgttttgtttaagaaacaaggtcttgctctgttgctcaggctagagtgcagtggtgcaatcatagctaactgcaaccacgaacttctggctcaagcaatcctcccacctcagactccagagtagctgggatcactggtgcacaccaccatacctggctattttttttgtttgttttttttactttttgtagaaacagggtctcattatcttgctcaggctggagtgcagttgcacgatcacggctcactgcagccttcacctcctgggctcaagtgatcctccctcctcagccaccacgtagccaggaccacagatgtgcaccaccacacctggctagttttaaaactttttgtagagatggggcttcactatgtcaccagggctggtcttgaactcctgggctcaagtgatcctcccatcttggtctctcaaagcattgggattataagcatgagccaccactcctggccaataattaggtttaaattatatttactgatggaggctttatcagctgggaggtctccagagaaacaaaaccaacaggatgtgtgtgtgtgtgcacgtgtgtgtgggatgtgtgtgtgtgtgtatgtgtgtggggggggtgtgtgtgtgcgtgtgtgtaaagagatttattttaaggaattggctcacgggattgtaggggatagcaagtccaaaatttgtacggcaggctggcaactcaggatttcagtgacagtctggaggcagaattccttcctctccaggaaaccttagctttagctctcaaggccttgaactgattggctctgcccccaccccacccccagccacactatggagcatgatctacttgacttaaggtcaactgattgtagatgttaattgcatctacaaagaccttcaccatggcatctagactggtgtttcaccaaccagctgggcacgacagccgggccaaactgacacacacaatgaaccatcacagaggcctagcaggtgcctagctccaagccagagctgggggcttgcggagacgaaaacaaatctttacctggcagctgagtcagaagagtgactggcaatgacaacacccacggtgacacagctccacagaatcccagcagaggaagtcctcaagcctgcaggggctcagagatgttggcccaaagctcttgggcaaggggaggcttcctagaagaggtgacttcattccctcaatatatatatgaatataggccgggcgtgattgctttcatctgtaatcctagcacttcgggaagcacaggtgggtggatcacctgaggtcaggagtttgagaccagcctgaccaacatgttgaaaccccgtctctattaaaaatacaaaaaattagccgggtgtggtggtgcaagcctgtaatcccagctactggagaggctgaggcaggagaatcagttgaatcctggaggcagaggttgcagtgagccgagatcgtgccactgcactccagcctgggcaacaagagcaaaactccatctcaaatatatatatatatatatgaatatccacacatacacactgagtgcctactagcacaagacaagacatacagagttccgctctccccaggtacacagggttgagatccaatgggaaagcagtgagccagctgagtcaggggtaagaggagccagtgaccagagaaatgacccgggacatatgaggccagaagccaaaactatggcatcagtagggagactgcagaaggcggcaggtcctggatcaccaaggaccttgaaagcatgtggaagactttgatcaatgggggaatcattaaggggttttgcattccggaactatcatcagcttcagcggggggcagggggtaggatagaggcagggaggcaggaagttctcgcagggtccaggcaagagatggtggagtgtggtcctggggaagggggcagtggacggatctgagggaggttcagttaggatgggcaaggattgagatctggctggatcctggtgacaggggagatgaggctggggcccttgaaggatggtgtcctggtgctgttaatgcaggtgtgagagtgggagggggaggagcaggctggcagaaggcaggcatgagtacaggtctgggcgggagtctgcagcgctctgggctggccacacgggtggggcaagggaggtggaggatcctgccctagagcttggtctcctctgtctgaggtcaggttccccagaggtggggctccagagggaaattcttgtgcaagcagtttctcaggggccatgtgctgaggggaatggggagcaggaacagcctagaagctgagtgaggatgtggtctcagctggagaggaggctgatcgcatgggagctctgcagcagggatggcaatgccggggaggcggtcccgcctgaggccaggcccagctctttgcagccccatattaactacattggctgctggggagcctgagtgacgggggaagggggcagccagggagggtgcctaggccctgtggagggcttggtaaggcagaggctggggaggctgtgtgcctcaacattcacatatgggcttcggctgggcgtggtggcacatgcttgtagtcccagctactcaggaggctaaggcaggaggattgcttgagtcagggaggttgagactgcaatgagctgtgttcacaccactgcactgcggcctgggtgacaaagtgagaccctgtcacacacacagaaaaagagaatgtgggcttcaaagttgaattcaagtaagtcagggttcttccacttgtaatgaacaacttccttaacctcattgtctcaggttcctcgcctgagaaatgcgaggagaacggcgcctgctggtggcgtgggcttgccgatgaaatgagccattcacccatgcctctcagcacagggcctgccctgggccgcatactgtgcattgtcagctgctgtcggagctgggctagcggccgccttgagagccagcagtccacgggggttggcgagcttctgggaggaaagggtggaacgtgactgtcaggtacagagctacagagaaccccagcatgaaggagtaggtggcaggggagaaggactcaacagagatggagaaagactaagcccaaaggtgatcaacaacaagagtgaaggaggaagtggtcagctgtggctggggcaaaacaagcccagtaagttacattggcctgtgtttggtcatccagggacaaagtgacctttttagtgcctgtaggcccagcgcgttggggaagaatttagaatgcagtggggataggtgtgagaggagcgggggaagtgaagattgagttgagaccactggctggagaacttgaccgggaagggagggcagagagcagcatggggtgaggggagggaatggatccaacgagcgtcttaggatgagggagttgtgagcgctcaacaccattacaaagaagggatcggggattgatagactgacagatgcatgcacagaggcaggtatggatgcatgcacagaggcagggatggatggacggacaaatgcatgcatagaggcaaggatggatggatggacagatgcatgcacagagtcagggatggatgaatggacagatgcatgcacagaggcagggatgaatggacggacagatgcatgcacagaggcagggatggatggacggacagatgcatgcacagaggcggggatggatggacagatgcatgcacagaggtggggatggatggatggacagatgcatacacagaggcagggatgaatggacagatgcatgcacagaggcagggatggatggatggacagatgcatgcacagaggcagggatgaatggacagatgcatgcacagaggcagggatggatggatggacagatgcatgcacagaggcagggatgaatggacagatgcatgcacagaggcagggatggatggacagatgcatgcacagaggcggggatggatggatggacagatgcatgcacagaggcagggatgaatggacagatgcatgcacagaggcagggatggatgtacggacagatgcatgcacagaggtggggatggatggacagatgcatgcacagaggcggggatggatggacagatgcatgcacagaggcagggatggatggatgcacagatgcatgcacagaggcggggatggatggacagatgcatgcacagaggcggggatggatggacggacggatgcatggccagaggcagagatggatgggtgggtagattggacggacagatgatggtaggttgttcttgtcctggaggaggtgatccaggctgagtcctcacactgggcagagcaagaggcaggaggtgagcatggggagatgcagctgtgtgccccagtgcaccggaagttacagatgacatcgatgtcctgtcctgatgaaacaggaaacacatttgtcatttgagagttagtggctggggctgggtggaagcttgaggggctgtgggcctggaatggggctgaggggagcgtgcaggagctgcctgccaaagcctggagcaaggatgacaggaggtgccggggcccctgtggactgccctctgggaatcttgtggggctgggtctgcacagctgtggttgtgtaacttcccccagatgcatggcgtgacaagggtgcaggaaggggtgcagggcccggaagcccagtatggccaaggagagacaaggcagggaagaaggtgagagatgaaagatatcgccctgattgaaacaccaaactacccccagtttctcagaaaaaggactcagagcaacaagagaacctacagtcgacagggaaattcgtcagtgcggatgtgatttgagcaagaccattgaagcccctgctgaaaggcaggctggcagagccagggtacctggccatctaccttgaagtctctgtgcctcagtttcctcctctgtaaaatgggcataggagacaggtttggtgagaagtgaacgaaaacgtgtttgctacccctcttaggtctcacgtttcatgcttagacgctcagcgagtggctttagggaccgagagaaatttgcttttcagttcaccaggtcgttacctatgaacctgccctgaacagtgctgaccttagttagagatggccatgaaactcatccgcatggggtaactggggcctccctgtggtgctgcggggctgtgtctctgtcttggtctcttcaggcctctcagcagctggagcaggagctggcaggcggctcaccggttgatgaggagctgggcttcagccggggctggcgtgtgaatcctctgggtcctggcagtcctgagcgcctgagctgaatacagagggaagaggctgggagcaaggccgggtgctggggccggcaggctgtgttctgagagtgcctgctagaggagctctgtgttcccaaggagatggaggaagacctggggtgggggtggtacagggtagggagaggaggggcagaggctgtgaacagggagatgggggaggggggatggaggactcaagggatgtaagggatatggcttgaggagggatgggggcaggaatgagggaaggtcttgggtcaaggacatggacctacatccccagcagatgggggtggcaagggggagacgggtgggggtcgctgactatagactgtagctgggaggaggggatgctcccagggctggggctgcctgaagagaatggcacgcaccttgtaggctcctgccctcaccccaccgccctcttaagtttcttttattttctttttctttttttttctttttactttttttgagacggggccttattctgtcctccaggctggagtgcaatgacatggtcatgcgtcactgcagcctccacctcccgggctccagcgattctcctgcctccctgcctcagcctgggacctgagtagctgggaccacaggcatgcgccaccactcctggccaatttttaaaatttttttgtagagatggggatctccttatgttgtccaggccagtcttgaactcttgggctcaagcgatcctcccacctgggactccaaaagtgctgggtttacaggcatgagccaccacacccagctcctccccctcaaacttctgtgcacaaagtgctcccttcccagaggaggggccccatcggtgtgtaaggtggcctattcctctgtgtgttctctggatcttttcagccctgtggtccagtgtccatcacagccatgctgactgagtgactggagacagggatgatggagagttcaggaagggctgggcagaggaggctggggccacctctggagggtgtcctgctgttcctgttggccccagctgcactcgcagggccttcctgtggcccctttccccaagcaggggcggccgcagctctcacccactttctcctgcagacggcgaggggaccgacctgtttgccgtggctgtccatgagtttggccacgccctgggcctgggccactcctcagcccccaactccattatgaggcccttctaccagggtccggtgggcgaccctgacaagtaccgcctgtctcaggatgaccgcgatggcctgcagcaactctatggtagggggagagggacctgccgcgaaaccatcattgccccatccagtgtcctctgcagcagggccaggggacgcacacctgcctgactctttcctcacagggaaggcgccccaaaccccatatgacaagcccacaaggaaacccctggctcctccgccccagcccccggcctcgcccacacacaggtgagtcccccaccaactcggagaccttgggtgaccagctgcccagcctcagtgtcctctgagatggggatggtgggggtccctgccttggagaaaacaaacccccctctctactcacctctcctttcctccccagcccatccttccccatccctgatcgatgtgagggcaattttgacgccatcgccaacatccgaggggaaactttcttcttcaaaggtgagtcatttcacttggcctcatatatgttggtttcctgcccacttccagtgacccactggggctgtgggcttaccctggaagcggaacttttttcttctttgagacagggtcttgctttgttgcctgggccgcagtgcagtggtgtgatcatggctcactgcagcctcaaaatactgggctcaagcgatcctcccacctcagcctccctggtagctgggaccacaggcacatgccaccacgccttgctagtaatttattttattattttgtagagatggagtctcactatattgcccaggctgggctcaatctcctggctcaggtgattctccggtgtcagcctcccaatgtgctggcattacaggtctgagccaccaggcaaggccctggcacttttagcgctaaaaagggaaaagtctcaggcgggccaggatgggctggtcaccctagatccattgcgcccttgatttccagatgggacccctccccacccagccacacaccctgggggaggagacctcctgctgtctcatgccttcctgcgaacccctttgtcccctgcaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcggtgagtggggccggcggcggggcgcgctggggccggcgcggggagcccacccctgacctcccggcctccaccctgcagggccccagttctgggtgttccaggaccggcagctggagggcggggcgcggccgctcacggagctggggctgcccccgggagaggaggtggacgccgtgttctcgtggccacagaacgggaagacctacctggtccgcggccggcagtactggcgctacgacgaggcggcggcgcgcccggaccccggctaccctcgcgacctgagcctctgggaaggcgcgcccccctcccctgacgatgtcaccgtcagcaacgcaggtggggagcgcggtgacctgcgggttactgggcctgggggtggggagagggatgtggggaatggggacatggaggccaccctgcggggatgggggtccttgggcatcagggagcggcggggcggggagggaccgggactcaagctctgctcctccaggtgacacctacttcttcaagggcgcccactactggcgcttccccaagaacagcatcaagaccgagccggacgccccccagcccatggggcccaactggctggactgccccgccccgagctctggtccccgcgcccccaggccccccaaagcgacccccgtgtccgaaacctgcgattgtcagtgcgagctcaaccaggccgcaggacgttggcctgctcccatcccgctgctcctcttgcccctgctggtggggggtgtagcctcccgctgatggggggagccatccagaccgaacagcgccctccacggccgagtcccccgccgctggacctggtcgggggttgtgaggcgctgcggaggccccttgtctgttcccacggacgggggctcgggcgcggactaagcaggggggatctcccgcgcaggggcggcggcggcggggaccggtcgcctggcgctgggctcagtctcctcagggtctgagaccccggcgctgccaccggaacccgccttcaggggcgcacgcgcgctgggaccatgcgtcggtcgtcgcccccgtcgttccctcccggctgccgccagggggcggtcggaccccgcctcccgagcccggggaggggcggggaggacaaggggcgggcccgcggcctcacccggagggacggcagccccggtcgcgcgctggccccgcaggaccttccttttccaggaagagccagcttttctcggagcgcagtcctgggactctccgcagccccgccccgcctggccactgcgtctggcattcctgggtcgttagaggacaggcctgactgcgaagctgtgccttgcccctctcccacccgcagtttctcaccccgttctgctcccacaaggcccccctacagtcactgccacactggtggggacctgggacccagacccggaaccagcccagatatcacccctgaggacccatgcgccacgtcctgggtggtggaatcagtggctggagggacgacccttgctctccaggctgttaaccttttccgttgctcccccgccacccacctcctcctccccaggccacccaacttgggcacctccctgggcccagaactgccttccattcaatggggaacccttctatccccaagaaccccttccctgcttgcaccctggagagaacagcttgactcccatcaactcaacgctggtggaaagacagggaccgaaccctggctcaggcctggtcattgcctcctcagcactccctcctgggaggccttagctctagagtgaggggtgggtggaacctgggggcacctcgttcaccctgtccccactccccacagttttaggatctaaatgattgcctctggaactattcttctagactatcccacatcagaatcactgggaaatttaagtttgcagatcccacactcaccctgaatcctcactcagggtggggtcaggaatctgcattttaactagtcgcggggattgtggggggcagtagctggctgtttcgtggcatttctgtggctctgcagtgttcctccaccccaggaccaatatgttcaggccacaccgatggcctgaaccccatgggtagagtcacttaggggccacttcctaagttgctgtccagcctcagtgaccccctagtgcttcctggagctgaggctgtgggcggctgtcccagcaaccatgcgaggggttgccccagttgctcatacaaacagatcagcatgaggacagaaggcaggagactttggtcagttacctgggaattctgggctgccaggaaacgatttgggcctctgtcagtttcttttccatgtatgaggagggggaaatttgtatattagaaacttattcatcccactcaggacaataaaaacgaatgtacaaaaagcccttccattcttctgagcattgatggacctggggagaagtgtggtggcaggaactggactgacctgaatctccctgcttcgcagaaggaatccatggttgatggggaatctaagaaggaagagtgggcccgggcgtggtggctcatgccttaatcccagcattttgcgaggcccaggcagacggatcatttgaggtcaggaatttgagaccagcctggccaacactgaaatcccatctccactaaaaatagaaaaaaaattagccaggcatggtggtgcatgtctgttatcccagctgctaaggaggctgggacaggataatcacttgaacccgggagagggaggttgcagtgagccaagatctcacgattgcactccagcctggccaaaagagcgagactccgtctcaaaaataaaaataaaaataataataataagaagaaagaagagtgggaggacgaagtagagaggaatcgaaaagttggttatggggcacccggaggacggacggccactgtggaattgagactgcctcatggctccatgtagacttccagagcctttaaaattttatgactgctacacaaaaatgtcatgtcaaagtgattatttttattttttaagtggtatcgtttaaaaatggcatggtctcataatcaaaatgtaaaacttttgtgcttcaaaggacatcatccagaaagttggaaagaggctgggcacagtggctcacgcctataatccgaatagtttgggaggccaaagtgggaggatggcttgatcgcagggtttcaagaccagcctgggcaacatagtgagaccttgtctctacaaaataatcaaaaaattagccgggcatggtggcaacccgtgtctgtattcccagctacttggaaggcgaagaggagagaatcacctgaagccgggaagtcttggcaacaatgagccatgatcacgccactgcactccaccctgggcaacaggtgtgtctcaaaaaaataaaaataaaaataaaattggctgggcacggttgcttatgcctgtaatcccgcatttcgggaggctgatgcagacgtttgagaggcagatgtcacttgagtttgagagttttagaccaactggccaacatggtgaaaccctgtctctactaaaaatacaaaaattagccaggcgtggtggcgcatgcctgtaatcccagctacttgagaggctgaggcaggaaaatcgcttgaacccagaagttggaggttgcagtgagccgagatcgtgcctctgcacaccagcctgggagaccaagcgagattgcatcaaataaaaaaaaaaaaga

SEQ ID NO: 14135 - DNA, 17156 bp, Human; identical to SEQ ID NO: 14134

SEQ ID NO: 14136 - DNA, 36580 bp, Human
tgtagagaaggggtcttgccatgttgcccaggctggtcttgaacccgtggactcaagctatctgcctgcctcccaaagtgctgagataatgagagtgaaccactgtgcctgggctttttctcattttaatgtatagcattatatattgatgtatagctctgaagagatcattgcagtcccctatagaggaatgaatcaatattcaccctcatcactcatgtctcagcactaagaaacacaaataggcatttctatttctaaaagatactttaaaaatatggtttctttctgctactgaagtttcctaaaaatcaaaaagaaaatagtttcattttatctttacaatcttttgaacactagagatatcaatcagatatatccatttacaaatgaataatagctaggttactctaagaaatatatgtatgtgtatattcgtttaatcctcagcatcacctgatgagttaagtgtttttgttgccagtattttattgccgtggctatcaaagcacatagaggttaaccaacttgagtgaggtaagagttgcgcattgaagaaaatacaggtcagggtattagtgaaagtctccagcaaagttcccagggttcataggttctatttattctgctctgtatgccacaggttattccttatttcttaaaagatcttttcctcagggctttcataacatcccgttcctttcttgcagcttcattatatctttattgtgcagacacattgacttgagtatgtaaaacctaacagtgcctattgttgcactaaaaaatgccttgctattaaagcatgaggcaaaagcctaacttagctgtttcctgaagtaaatccatatttatacagaaaaaccccttaacttcctctaaaacaaaaggcatatactctacatagacatatatttgagacattaaagaaacatcaatttccattttaaaaaaacgtttaacttagtatcctctgtcaaatttctggtgcctacgaaaaaactgtaaaaaaaatagcttttgaaatattactcattttaagtgagtcacgccctaaaagaatttacttgggagtcaaagctagttgaccctaacatctcagaaataaaactccaatttgtttatccatttaacctaccatgagtctgtgatttggcaacttgtgaaaagcaacaacaaaaaaacccactaaaatataactggtcactggaaaccctctttctggtctgtactatctaaatgccagctgtcatgtcaggcaaaaagtaatttgtagagcagccttgtggtccactgtattatgtaggaaagacaatgtactggaagagcgaggactcaatcatttcgtgtctactactgagaaactaaattctgtagagaacatgaggctaaacggaggctctggtcagctcaataaagatacgttggaagaatcaatggggagtttacacaagagtaaaatgaagagttccaagctctctcattgctaaccgtacactctccatggctgttgcaagtggttttgcaggtcatccaagcactaatcttttcttagcccgaacacatttaaagagggaaggggcagagatcattcacactgtgaatgtttctctctgaacttcctgaagtcaactgggcggaggccctaccggttcaggcacctgcaatttccgcctttctccttccccttcttccgggctcccgtcccggctcatcacccggcctgtggcccactcccaccgccagctggaaccctggggactacgacgtccctcaaaccttgcttctaggagataaaaaggtaatgatcgtcatgtgcagtatgaggtcttcacgtgaaagctttatttgggtaggaaaacctagcctacgagaaacgggtccgtgcggtcacgcctgactgcctgtctccgggtcaaggctgccaggaccagctccagccctccgcccgagaaggctgtcctttcccctcggaactctggcttccctaaagcggccgcgcctccttccaggcctcacctcctgccggctccgcccggcccggcccacctcgcccccacctcggcgcccacccattgtcccctcgcgcagtcaccgagcgcagatcccgcgctctcgattggaacgcctccccatcactcagccacactcaggggctggacgcctcactcccgtttccgagccataaaaggtctaggaccgcttcccccgagccagcaggtaaagccgcggcggcgggagggaggccgggaggggccgcgcgccccggtcggcccagccggggaaggggagcggcgggcggggcggggggcagcgcaccacacacaaccctcccttgccgtgcgaccgcgccctgcccccgccccggggcccccgccccgcaagtcctgatcacaatgccggagccgccgagccacccttgtcatcctgcccggggacggccctggggcagttactaccgcgaagcacggagggtggggcgggccgggcctcggggaggggtggggggatgtgaaaggtcccggatgttgctgaacgggagccccttccagagggagtgactggggcaagcgcagacgggctgagcgaaagctaaggtgggggtagggagagaacgccttcccgccggctgagaggaagagtgggccggcagaggctgcaggggagagggagagagagggcgttggggacccaaagggaaggcgaggagtgggggatttgcgttggggaggaaaaggaaaaaagcagcctcctgccctaggtgcactcgggacaagcgtagaggagctggaagccgagcggggtgggaggagtggcggctgcgggcgaggacgcgcgcgcctccgctcgccctccagcgcgggcgggcaggacgagcgccggggagcggcggttacgcggggccccgatcgctgtgggcaccaatcaacggttgccatagcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacaggtgaggaacccggccgccgccgcgcctcgcttcctgtcccaggccagccttccgaacgcgtgggagccgtcctcgctccgtcccctcatccccactcgccccgcggtggcggcgccgggctgaggcggagtctcctcagcggacacgggcggcggctcctcttccgctgggctcgggagggcggctagcggccgcctccggctccttgcttccgcatcgacgccccggcgccgatcggtgctcgctcccccgtcctgcccccgggggtgggtagggcgcccacacgcgagatccctggggatctccctgtcgccggctcccgaaggtggacgaggcatggccggggcgccgccggccgcgatccatccccacccttgtctctgcgggcttccaccccctccctcgccgcccttctcgcttccgcccgagataatgactcggcggcggcggcggcgggcatcgcagtggcgcaggtgaggccgccccctcccctctccctcggccgccccctcctttccctccccctcgcgcagcctccgcgctgggcgctgcggcggcgggacccggccctcccccaccccgggaggcggtggcgcggcggggaggggccgggggcctcggggacccaagcgcgagggaaaggcctggccgagagcgggccggagcccaggcctggcgcggcggcgcccgccaggtagaccggggcgaggctgcgcgccggcgggaggggagtccactgcggggtgaggttttggggtggggctcgcctgggacctagagctgaatttcctgggctccgcggtgggaggaaggacttgaattttcctggtgggggtgggggatgggtctgactttttttgctccttgtgaacgggcgggggaggtgtggacgggggctgcaagtccaggtcggggtagagaacagggtggtgagcccgcagtcggctcccgtgcttgatggactagaactggagggtccctgcgctcggtttggggacgcatatcctgctttgggggcgggtgagcctgagcatagccgctggtggcccgctcggctgggtgtggctctcgtcccctcccccacctgcagctgtcggtcccttagagacgctgtacacggtcaccggcgctgatcggtggcggggaaggcgctgggtgggagagcggggtgtgtccgcggcggggctggtagtggttccgcttctgcgggctgctgtggcgtctctgccccggggtcgggcggcttcgctccccacctcccccccccccccaacggcttgggcgggggcgcgggctgctcctccctctggctccggtcggggggaggaattaacactctgcagtaggttgggctccctgacacagatccgccatgacaaaggaggagagtcggggacttgagccgtggctccgacttgggcggagcctggaggggggtggttgcgatacgcggaccggagaatttgcactttaaagtccgggtctgcccgttttcgtttcacagtaaccgacgtctcaagtcaggtaagggttaaatgggtgcggtgagtcctgcccgcagtgtagaggcgaggccttggagcactcgttactgtgtgagaaaccttatccacttcctcttgtaccgaagtgattggggagagaatcctttgtactggcttaaatcattttttgttagaagcagaaataaccagagagcgtttctgagatcctaagggaaaaatcagtaatttagagacctgacgaaaataatgccgtcataaaggttaaatagtttacgtattgagccagtaccttgcatccaaagtggttaattatttgtttaaaatgtggcgacctgttctctcatttggttaaaaaaatattgtgggatttccctgggaaggtaaaagatgattaatattcgggagccagctgccaaggtggactcttctgttcaccttctaacttaaaagtgcacttcattcagggtgtgtattttcctctgaagtcatttattctgtggtgtcactgtgtggattagtatctttgtgctgttcggcaacttgcaaaagggtatctttccagaaaaatgtagctgaggtaaatcgaaaaggtccaggaaactaaaatgcgagggaaagagaattagatgggtagtcatggtaaaggacagcttgagtggtaacatccaattacattatgatggctagaagcaaaatgcagcacttctgcatttcaactggagcgatgacattggaaacacttgtaaattaagtacttccaatgtgatatattctagtactcacagtaagagttgaagtgtcatgacttgcggatatttttaaagcatgtggacatataacaagataaagagttgagacattagggtcagatattgatcctttgtggtggatttatactcaaaatatctgaaaacaaacagttggtcattcccccccaaattgttatgctattattggctggcagttgttgcagagatctagtaggtttggggtaggggtaacactaaagctaaaatgtaatcactcttgacaagagtattatgaaagtaaaaagacgtgagttacattaaactgatatgaattatgattctggaaatatgatagaaatccagatgttctctgtaaacaatgcttttactaaaggaagaaaagctgcttaattttggatcacttagtggtattggaaatgagttgagattttgatcaggtaagattaggggtagtttttgaggcagcttttggaagtaattttgacatgtgaaatttgggtcttctgaacaaattttaagttttgctacactgatgtgttaatggctgtaagtttacctctgatgctgagtatgctaaatttttttcccttttttgactatccttttgtgaggctgcattttaattcctcatgtgaacagtctttcacaggcagttaggtttcaggtttaaaaaactcatttaccacaggtataattttgagtctgtttattttgatgggaaaaattttaaatactccttttttcccccctgcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactggtgagaatcaattcagtctggcttcattatactgtagggtccctatgagtatcagttacattactcttaactttttgtttggtttttcttttccttctaaacattgtgtgttccaaatttaaaagtcttcatggtgtcatgactaaaaagatgttaagacaattatagatacgtgtatgtaaaataattgcaacaatgattatgaaacagttcagttttgttaaaaataacagactttagtattgtattttatattaattgaaaatataaactaattgtgttactgttttacttatggttagaatatttgtagtagctctatagctggttatcttaaatgtacatctgtggataaaggaattttacatactttaggtaagagagatgtaataggatactcattgtagaaatagtactcttctcaggattagccgctataatgttaatgtaatgagtcaaccatgcagaaaactctggcgtcacaactatgaaacctcttcctgcattgaattcttgaaggtaaattttgaacactcacaaccatgatgaaaggttatgaacaactcaagcttgattttccagtttgaatcgagtattttaagtattcagtacttactgtgttgaagcactgcgcttaaaagaattaaactacattttggttaattttaatctgtcatataaagtagggctttttgatcaagaatagtttaaatttgaggataaaccagtagagaatccaaccaagctggcagtttttggaataatatttaaagtggttttactaaatggttacacttaaccagtatggaagggctctgatatacaaagaggggcagcatctcgatttttctggacagattactgaatctggaactcagtatggaaatccaggtttgttacttactatatgaaccttgtttatggaagaagtgctataatgagcaataggataatgtctgatgtggttgtgggtttggggtttttgttaaagttgtgatgatactatcatttctttacatttgtatttactaatggaatagcatcagttcctaaactgtaattttctcaaatgatacttacttgacactgtctttttaaagaatagtgattttttaaacatgcttatttgggttcacagccacaaactcaatgaggcatctgtcttggggcatttttttgttctttgcttattgaaacctttagaatgatagctactatttgtatctaagttgaaaaaaggaatatcttgcttttattggggccaagtgacaaatgtctgttttgtgattttgctaaggtaataagaatatttaaattttgttttttgtttttttttttttttgagacggagtcttgctctgttgcccaggctggagtgcagtggcgcgatctcggctcactgcaagctccgcctcccgggttcacgccattctcctgcctcagcctcccgaatagctgagactacaggcgcctgccactgcgcccggctaatttttttgtatttttagtagagacggggtttcaccatgttagccaggatggtctcgatctcctgacctcgtgatccgccctcctcagcctcccaaagtgctgggattacaggcttgagccaccgcgcccggccaaatatttaaattttgaaaatgtgattttttttttctataataaaaaatgtattgggtttttttgttttttttgttttttttttttgctcaccttactaactaatatctgtgtatgtgtaattcagttttgttcagtctggagtgtttttcccaattattacacctgatcgaaaagtttttattttggcttcaaagggtgtgttacacattaacatttcccttaagacaaaagtcaattttaggaataaaaaggaatgtaacatttaccttttactaacacgcttatttgcaataccaggtaggtatgtgcatgttttccatatacaaagtataaaagttcctgtcattgtgagtcttttccaaggaaaagacttgtagcaggtttgttttttgtgtatgtttgtttgtttgtttgttttgagactgagttttgctcttgtcacccaggctggagtgcaatggcaccatctcagctcactgcaacttccgcctcccgtgttcaagcaattcttctgccttgacctcccgagtagctgggattactgggcgtgcaccagcacgcccagctaatttttgtacttttagtaaagatggggtttcaccttgtcggccaggctggtgaccaggtcaggtctaactcttgacctcaggtgatccactcgccttggcctcccaaagtgctgggattacaggagtgagccaccacgtccagcccaacttgtagcagttttgactatgcttccctttagtttccttatgaagaaaatttgtttgcatagaaccagtagatgaggataacaagataatctcttcatataaatagtttcttcttgttatgattattaaggaagttcactctggtccctacccacatcgttaccctccagaatagcactggcttcccaaaaagttttaatggtatttacactttgaaagtttggataaatgagagtttaatttctttactatacaaatggctttgaagagaattctaaacaagcttttgcttccagccttggtcttttcaggagtaagacttagtgatctttgcatactcaacgtgtaatagatgctcaaatatttgttaaacaagcagaaaggcttctttagagaaagagcatagaattaggtcagcagcactgcaaaatttccctagctttttctttttctgcttgggaaaatttgatatttaccgataataggcttctttttcctaccatctttttcaaataggtcacatcgactctggaaacatattgcataaaattccttctgccctttctgtgagatggaagaataaaatgtagcagaactgatatttctactagaaaaagttattgaatcattattaatgattagtaaaaatattttaaattatatttttaagatcttacatgataaaaaatcaattataattttttattactccagccttttctgggctttgatatatatattttttaatttgagaaaaataagcaggtgtccctttgcagaaataatagtattggcttgtggcattagtgataaccagattttttatattgagcacctattttataatagctatgaaaataaactttcttcctacaaaaagcagctaatctccaaagttctgagtttttctgaagagctctttagtaacccattctggttatatgtatttatctattgtttaaccatttaataagcaaagagcttggaccatgttgcatattacaagagtaaatagagcattatggcgggaagtggtcactggcatgctcttcacaatgtggactttgcattatgtaaaagaacttgggtttcttctcttccacgtgttaatttcaaactgcaatatgtgaactaatgcaatctgcctttcctgccagatgcttagacaaaagctctcttggtagttggggagggactcaacactagtacctctttaaacctgaaagatggcagccaaaaattgggtagtttttatcttgcacatgatgaaatgaataccaaggaaatacagtctaggaagcctctttcaaactcaaagaagtatgtcgaggtgaataatggagctcaagatactgagtcaaactagttttaccatttaatagatgcatggcctgaggaaatcactcagtccctctgagaaaactaagctcaattaaataggaataatactcatcccacagggttgtggggaatgagagtcaggtaaagcaccttgactaccttctgtgtcctgtttatcttagcttttcagttctatttaaaagtgtgagcctgcctataatagtgcaggggtctcttaacttacagtccatgaatggaatttcgaagattgaagaagcctttaaaattgtgtatttttgtggggcagaaggtccatgccaaccatcaaattttcaaaggtttcattttaaaatttaaaatccactgctgtaggcagagaatgactttatataggaggtctccgagaggaagcagtgtaaaattgtgtgtctaacatttataacagttggcaactgcagttgagtaatcttaatagtgattctgttaatttgactgagttctattttattgctgctctacgtttttatttgctcagggcaattttaagttgtggttatgggtcactgatttttatctccagcccacagaactaccattaaacagaaataagaaagcaagcggctttgggtccgttttagtctgaatatattattacgtgccttgggctttaaaaactgctatgtagagttagcagtttttaagatgaaaatcactagacagctcattggaataagggcttctccaaagaactctgtagggttatatctattgttactatttcattttattaagatatactgtatatttacatgtcttcatggttttggtatgtttcaaagtataaataatcccagttctgtggtctcaggaaggaaaaaattggacagtgtcttttttttctttttttctttttttttttttttttttgagacggagtcttgctctgtcgcctaggctggagtgcaatggaacgatctcggctcactgcaagctctgccttccgggctcacgccattctcctgcctcagcctcccgagtagctgggactacaggtgcccgccaccacacccagctaattgtattgtatttttagtagagatggggtttcaccgtgttagccaagatggtcttggtctcctgacctcgtgatccacctgcctcggcctcccaaagtgctgggattacaggcgtgagccaccgcgcccggcctggacagtgtctttggtaataaagttcagttttttttaatgtaaagtgccacacccaatgacatattttgtacaaatacaaaaagtctgaggtatatgaagtggaaatgatgaaaataaaggaaagggaatggaaaggtgtagaggcctttgctgtttgatgggaagggaaactagctctgtctttataatactgaattaaatgtcattggacttttggattaatttctcaaatttttgattccaaaataagttactcttggcatatttatattgaatgtgtgtgtgagaatttttaagtcagaatgacaggtgttctgatatcaagtaagttttaaaagttagcatatagtttattgaaattctaataagtttcttagaattttttgtagaattcctggttccctattgtgatttcattctagttcccatagcttttgctttactcttgacagttccacatagagaataaacaccgctcaaggttttaggggacttagaactgctgtcagtttcaatatactcaaagccagcattccttttccttttgaaactgcctgttctttataactacccaattttagcatgttttctagacttaatcacacgacatgttggactcaactttgacttaattttcagattacaagctgttgatgtttcccatatcattggttccctatcctttacattcacgctgaattgtatagttcccaggattatactcagaaaagtgcacattgccaaataggaaaatgatactgtatggataaacttgatgtgcttttaatggacaaaagctaaattataaacatctttttactgctgcttgtggtcattcacttggacttgttactcttatttttcctttttcagttctatgttgcatgtatttcttattctaatctttctaaaatgctgatttcattccatctatttgcttgatccttgccagaattccctgcaagaggcttttagctttagtttggtcgtctcactatccctgatacaaactgttgctaattaccatctttatggcctgagggtttctgcttcattactcgatttaggacttattttaatcttgattatctgtctttcagcatcagaagattggctctgttcttttctccttgaaaacatttgtgtatttgtaaagtacactgaaggagtatatgctttgatatttagatggcacaaatgtaaattttggtgtgggaagaacggtcgtatcagcagttctctcttttttattatgtgtatttctatgtaaccgatcattcacttgttctctagtcagtaattccatttaattatgaaaagcttgtatatgtgaaagttactgtgcaatagcagttgtcattgatttagttttgttttctggtaaggtataatgtgatagaagtagtagtgtagtgtaggatagagttttacatattggcagatttcactagtttttttttctattgccattcaggcaccaaagccatgtggatgaatatagctgacttgatatcagtaagatcattttgtgtgacacctgcccttttgtttacattggataggttattaaaaagtttcagcatgtaagctcttgtggatttcttttgacaggatttgttgtgagccttccttccccaaataaaaatgtgcttacagtggtaacaacaggtaaaagaatataaggatagtttcagccaagtattaatctataaagttaagcggaccaacataagatttgcttaatgggttggcctgtatgcatgtgttgaattttaaaatctaagaaggattattgcattaaatttgcagggactgcccaatttttgttgtattagtattttattttaatcgtttaatgagttgggaagttagagatttttttttttttttgtcgttttttgttttgtttttttctgagatagcagtctcaccttgtcgtccaggctggagtgcagtggcacaatctcgcctcactgcagcctccaccttccgggttcaagcgattctccctcctcagcctcccaggtagctgggactacaggcgcccaccaccatgcctggctaatttttgtatttttagtagagacggggtttcgccatgttggccgggctggtcttgaactcctgacctcaggtgatccacccaccccggcctcccaaagtgctgggattacagtcgtgagccaccatacccggcctagaaatgttttttagtggcagttaatttctaacttgcaaacaatttttgggatctagagtttttaaaaattagcgttataccaaggaacccactggtatgcggaatgtttctcatctaagtgattaattacaaacgcttttctgagacagacctatttgttgatccaagacttatgaacactcagcttataatttttttgctccttaaacgtaataaacattgtccagtttagaatgacatacttggaccacattcaaccaagagacacttgatgaaaatattatgcaaaatacctacttaaaatgtgattctgtggaattgacagttgaaggtagtattatataggcaagctgtagttcttgcctagaacaggcaagttctcaattcaacaatttgatgagtcctttagcattgtgttaggaagatgtttagaaataagacaactcaagcaatctgctttttgtaagagtaacgacttttccttcccagttgccctttgattgttgccatctaatggaggactagcatcaggctctttttctttaattggagcagagataaaactttaagcatatccctgtgtaacatttctaaaaataaaggatactaaagtgtatactaccttactttaagagaggtgataaaacttagcatgagccatgcagtctttttgaatttttgattcattgtgtgatttggggcaagttttactgcatttgtctgtgactctgtttccacatcttcaaaatgggaataatactatctacctctaggatgttttgaggaaattgttgaattaacacacccctgtggtggtgttaaatagcaaatacactgctttaccttttgtacctctgtgatatcactttattgtggtttcatttataaattttggattaaatttaagagaactttagaaagctgaaattttttatttaatatttgacaacttgctattttataagccctgggctattacaaaaataaatgtaaaagcccctgctcttcagtctggagagggaaatagacgtgcacaaataatacaagtcaaagagggaaaagtactgcaaattcattgaacatagaaaagctggtctttagccttttttaaaaaggggctgataaaatatagtcccccatgtagtttatccataatacatagcgtgccacttacaagctaaaaagccctatgaaaaatgaggcgttttaactaccaccaccaacaacaacaaaaagcatcgtgagggaaatactggtaaattgggccttggtttgtgagaaacttcagcgcaggcctagatcctgggggaggggagaagaggaacgccttcagtgagtgtcaataatttttaagtttatacttaactactcattaagttctttttgatataagttctttttgatacttgttagtgtttcactttttttttttttttttttgagacggagtctcgctctgtcccccaggctggagtgcagtggcgcggagtctcgctctgtcccccaggctggagtgcagtggcgcgatctcggctcactgcaagctccgccttccaggttcacaccattctcctgtctcagcctccctagtagctgggactacaggtggccgccaccacgcccggctaattcttttgtattttttagtagagatgaggtttcaccaggttagccaggttggtctcgatctcctaacctcgtgatccgcctgcctcggcctcccaaagtgctgagattacaggcatgagccactgcacctggcctagtatttcacttttaatctttaggaacaacatttcaaaatttgttttcagatgttcctttttttatttttattttttttgagatggagtttcactcttgttgcccaggctggagtgcaatggcgtgatcttggctcaccacatcctccgtctcctgggttcaagcgattctcctgcctcggcctcctgagtagctgggattacaggcatgcaccaccacgcccagctgatttttgtattttagtagagatggggtttctccatgttggtaaggctggtcttgaactcctgacctcagatgatccacccgcctcggcctccaaagtgggattgattacaggtgtgagccaccgtgcccagcgttagatgttcttaaaacactgattccttctaggattattttgctagcattcatgattcggagggagacaattctctgaacctgatttaatttggcagtttttattctcacttcctgctagccctttcacccagttgattaaaaaaaaaaagttttagaacagaacagatggggctttctatcagcattgtttagtgtaggtatcttttgttttggggtaaatatcagggagcagctactcttttaacaggaattatattaataaagttttaggctggctttaacagttcttgaacatcaggaacatcttgctttgccagatttcttgttgattaaaagtgcagatttgccatctattaatggaaaatgcgttaagtgattaggcacaagcctgcttatagatgaccttatttatagaacatatgttcacagcttaaaatcttattctgttaggccacattgcatagaaaggtaataatttaaagtcaaaatgtctaaaagacttaataaattagttcttgacacctcctaatcattagcatttctggtggagcacttttctaattggttgaaagcaagtgaggaaattgcaaatcaaagaatggaagccactccggccacaagggggagtaagagattaaatctatgggcccctaatgtgtgacagattatgggcttcttgcatgatttctttttaaaattttaagagatctaggatttatacaaggcccagtgtctctacagaataaaaattataggaaaattatctctgcataagagaattgtacaagaccagaaatttgaactacactatgctgaagagttggaattaaatctattaatgaggatgttattaaaatgacatttgtggggtatttttgtgagtttttaaattgaataatataaactgggagttttacataatttatagatttgtagaaatatgtttaagtatacagaaatttcattgagtcattgaattttagggttaaagggacatctgatctagcctttttattttaacagatcaagacactgcagctcaggggttcagctatttacatgaggtcatacagtaagcattaatatttgtagtctcttaatgtagtatcatcttattgtagattgaaacatgacatttaatctgctatcaagatactgggtttgtagggggggatgaggagttgtcagaataacaaaataagtggctttaattttattgaaaacagtggggtttttttgttgtttgagatggagtttgactcttgttgcccaggctggagtacaatggcatgatcttggctcaccgcaacctctgcctcccgggttcaagtgattctcccgcctcagcttcctggatagctgggattacaggcatgcgccaccacgcccagctaattctgtatttttagtagagatgggatttctccatgttggtcaggctggtctcgaactcctgacctcaggtcatcctcctgcctcggcctcccaaagtgctgggattaccggcatgagtcactgcacccggccgatttttgtttcagactataattagggtgctgtacttactgagaatcacttttgagggctcttatgcctcagttacttgctacctcaaccttttaacttctggtgtgtgtatgctttgtatgaaagcaggcatgtctgtgtcctaatgtctctctcttcatttgttgttttggaagagagccatgacagtacaatctaaaacagaagaatgggttatggaggcttgatctttctcccactcacatatttggtgaggtcatgtcaaagttagcccagctgtattcgcaaatttcaattcataaatgtctcaatagaggttgattgttttgctttgatattctggggggatttgctatttgctaatgacactcgatgtctaattatctttgtgcgaattaaatttaatattaggaccagttggtgaaatactgttttaagacaagatgagaactttctctccaccccacatatttttctttacaaatgtatcattgtttttgtaccatttctgtgttaaatacaaaagtagtatcagccacataaggaaatttgaaaaaaaaaaagcatataaagggtatgaaaaagggtatctttcagaaataaagacaattaaaagggacttctttaaaatgtattaacttttcattttgaaataatttcagatttagaaagaggttggaaaaatatgaagagtttttcatatattttgccagattgtccacatgttaataactacagtataattattaaaatcaggaaaatgattaaagtaaatgataaactattatgtaacctataatcttaattaaatttagcaaattgttttactgtaatttcctgtttctgctccagaattccatccagaattacactttgcattttgcttacatgtctccttactctcctttaatgtggatcagtcttgttttagtctttgcctctaatgattttggaacttttttcaagagtactggctggttattttgtagaatgtctctcagtttcgatttgtctggtgatcctttttgtttgtttgtttgttttgagatggagtctcactctgtcccccaggctggacttcagtggcgagctatcctggctcactttgcaacctctgcctcccaggttcaagcgattcacctgcctcagcctccccagtagctggaattacaggcacccgccaccatgcctggctaatttttgtgtttttagtagaggtggggtttcaccatgttggccaggctgatctcaaactcctgacctcaagtgatttggccgccttagcctcccaaggagtgagccaccgtgcccggcctgtctggtgattcttcatgattaaatttaggttgccagtttttggtgagaactcctggaagtgatatggtgtcctcctcagtgcattatattaggaggcatgtggtgttgtcctgttacttaaccaattatatttagatagtgcattatgctgttaggacttctgaaaacacaccccatggtgcaaaatacccattgaatcttttttaaggtatatgccttaagattatgattactttgtcaaaggttacaaactaaattattttgccaaagtgctttttaaataagctgcctctgtttatactgaataggttgcttcttcaaaggggaaaataggatcccagctctgtaacttgtaattttttttcgaatttattttcattagttggcttcttgtgttctagttggcaagcccaaatctcagcacatagcacggtggtttgagtgtatagtggcaggttggctattcttcaggactgaggtgaatgtacaaatacttaatgattgagttcttgttcataattttggggtttggtctaaggacccttagtttataaattctctgattactttttaagaaaaaaagtgatcttgaatttaaagaaatgtaagggatagtggtggggtgggaaattcattatgttagaggagatttcctggcattggaagggagattttgaaattaatgctgtagtgaaacacaagaagattaaggtgaggaggaggctggtcatagttttgtatttgaaatgcctgtcttgcctcttagttagtagaattagtaccataatctaggacccttgacttcttaacaagtttactctgccttgcaacctcacactctcttccagttctctctgcaggatttttcttaggttcttctttgttcattacatagaaacctggagcttatccatattaggaggtgcttagcctgcccctttgctgctgtttctgaatatatgtgtttagttcagcactcacatattttaaatgagcaatctcttaggttttcagagaagtagaacattgttgtgtctcttacagcagaatattcattattgaatgtagtgtcaacctgaatttctatcaggttttgtcttaactatttaggaatttggtaaggtaatacactcttgatgatgaagactttctgaaaaatagtttttaggatgttgagctattaaaatatcctccaagatagttttaaaatgttttatttaaatgaagctattacagttatgcgtatattattcagtcagggagtttaatatttttgagtgcttaaaatgtgtagaacgtgcctttaatagagcctatgagtaggttaagagtatatatgtgtgtgaaaagttaaaggtgcaaaaccataattgtttgttttatttgagatggagtctaactcattggagtgcagtggcacaatctcggctcactgcaacctctgcctcccgggttcattcaagcaattctcctggctcagcctcccgagtagctgggattacagtcgtgtgccaccacatccaatttttttttttttcccagtagagacggggtgtcacccaggctggtaatctttattttaaattgtacttgctcctaagaatttaggtgttaagagcatagcatgtagaaggaaaaaataaagctgctgtaacctcatcctgccttcttggaggtaatctctgttagtcctttgtgtatcctgggaatttatgtgcaaagtaaacaattctgtccttgaagaataaggatcatatacttagtttggtaaattgtacaaaactacacactttgatgtatatcttatgtttcattttgacaggtacctccttactcttttgttttttggagacagtctcgccctatcgcccaggttggagtgcagatggcacaacctctgcctcctgggttcaagtgattcttctgtctcagtctcctgagtagctgggattacaggcgcctgccaccacacccagctaatttttgtatttttagtagagacggagtttcgccatgttagccaggctggtctcgaactcctgacctcaggtgatccacccaccttggcctcctaaagtgtgggattacaggcgtgagccaccacaaccagcccgtacctcctcactcttaatgtctgtatagtattctattatttgggtatgtagcaacttacttagccagaccctccttttaaaaaaaaaaaaaaaaagatagggtctccctctgtcccccatgctggagtgcagtggtgcactcactgcagccatgacatcctgtgctcaagtgatcctcccatctcagcctttggagtagctgggagtgcaagtgcacactacactaggctaatttttttttttttttttttttttttttttgagacaagtctagctttgttgcccaggctggagtgctttggcacgatctcagctcactgcaacctccgcctccagggttcaagtgagtctcctgcctcaagcctgccaagtagctgggattacaggtgtgcaccaccatgcccacctcattttttgtatttttagtagagatggggtttcaacatgatggccaagctggttttgaactcctgacctcaagtgatccacccacctcggcctcccaaagtgctgggattacaggcgttagccaccgcgcctggccacgctaggctaagtttttaaattatttttagtagagatggggtcttgctatattgcttaggctggtcactaactcctggcctccagcaatcctcccagctcagccttccaaagtgattgtgattaaaggtataagccaccacacctggccgttagtcctttattgacagaaattaggatatttcccttttttctcttcagttaaaaagctctacactacacactatctgtacagacaatgtagatgaagctgaatagctttgaataattagctttagggagaacatagcattagagctaggtatggagaggtatttagcacagattcttttcattttatttttccagctttattgaggtacgattggcaaaaaaaatatatatttaaggtgtacaacatagcagaggttactttaaatcagttgttaaaagtgatatgccgaccactgggagtcctttggggaggtgtctattacatcacaaaaagtcacaactattttcttcctttttttttttttgagacggaggctcactctgttacccaggctggagtgcagtggcacaatctcggctcactgcaacatccacctcccaggttcaagtgattcttctgtctcagcctcccgagtagctgggattataggcacacaccaccatgcccagctaatttttgtatttttagtagagacaggctttcaccatcttggccaggctggtcttgagctcctgacctcatgatccacccacctcggcctcccaaagtgctggagttacaggtgtgagccactgcgccgagccaggtcacaactattttcatggcaaatactgttaatactgattcttatcactttgttgacatttagcactggtgcaaacccaagggttgctcaaacttactggttccttatcgctaatcaaggcagtgatactatactgtactagtgattattgtatttctttaccattatgcactcactgtttcttttaaaaagaaaaaagactttttttttaatgtccttgaatctgaaacattattttattaatagcccttaaatagacatctttcagtgaggcaaaatgggaagtccagtggttgtctctaagaaaaacacttgcagttatttgaattgtgagataaactagctgcttttctttttttatggaacacttttttcttcaaagaactgcaggcagataagctgtgggtattcagacctaggtattcgacaaatatcttaaatgaattgagcctctcactttaagggaaaatgatatttttgacagataaaattgaagctttggagcaaaaatgagaactttggaaaataattactaccaccatgatcttagttttctacttttttatgactgtaaaagtgtcttgagacaaacttttaagccataaatttgaagtattgttaccgtttagggttttttcctagaaaatgtacctatttatagaggtagtatatatgtaccatggttgggagaaataaggtaatattacttaaatattaggaaattatttcacataagagggagttctgagctaaggtggtttttgggtgggtgagtgggtgggttaagatcagttactgcagtacaaacagtacttgaagtctaatgtggttgacactagactttcaccttccaaaaggatggcagcacttctttgttgcttactatttgccagactctgctaaatgcttattatatgttaattcatttaatccttacaacaaccttgtgcattatgtctactactaatatttgccttttacagatgagaatctgagacccaggaagatttcagagttttgtcaaggtgacagagtttgaatttaggcagtaagcagtctgtctccatagtttgtgttcctaacaagtctgttgtttaaaaagagaaaataaatactaaaggaaatgttctttttttcttttgttcttttttcttttgttctttgatatgtcttaatcctgtgtttttgaatgaaaacttttttgcatcctacttcaccatttttcctagttatacaaattttagattaccaaagccaaaatgatgtacttaagagtacaagagcactaaagcagatttttgaatgtcagaatctccatactttattttcacataactgagcaaccagtgagtagaatgcctactctcggttgggagctgtgaatggtgccctcctgtttatatgttcatttagacctcataacagccttttgatgtggattttcatatagatgagaaaataaagattagctattgtgtaaattctcaaaattaatgggttagggtggaatttcaagtctgcctggttttagagtttatacgatttgcattacatcaagcttttcttctaacaagtgttgaatgcccgaaaggttaaagtcttgccaccagctcaggcagcagttttggtggtttaggggtaatcatactgaaagaccagtgagaaaggcatatcactagagatagattctcagttcattaacttttcattaggaatatttgactacaggcaggagtgagtgtttataaaattcatattagtgggatcaggttgagtctatgccaagaagggatcagaaacagatgacctgtcaatttatgtggttccttaattttaatagacttaattttaaagacaaaacatcattgtaaatatagactatctttggattaaggcatcttttggaaactggcttgggaggaaaaatgttatttgaaccccatctcttggaagtgttttcacaatctaagaggttaattatactacggtgcagtagagagaaaaatctcttttatctctaaaatctcaaatttcatgtaatttacctgttggttaggttaaggattagtgtcctctcttcagagcccatatcacatatttaactctggattaggagctgtttaccaaagagtattagataccggcttcttgtggcattttgctgctgagtaaatgatttcttatcccacttaatattattagggtgaatgctgtataaatgcattaactctaattcagcaaattaatcttgggtattttctaaaatgttggccatgatatctttaaaagacagtggctgtcatgaaaaaacatatttaaaagttaatgggagcagggcaagctatgatggggccactgcattccagcctgtgtgacagagcaagacctcatctctaaataaaaattaaaaaaattaatgggagggaaaaaagtaaaacttacatccacattttgaagtaaactgaggaaatactgtggatttctaaatgagattatatttcaggaagattcaacagattaacatttagccttgatttagcttgagtgtaggatgtgcttgaattttgtttgacctcaaaaccatttagatttggtttaaaaacttaaggtactgtgataattgaaaaattttacaagttgaaccttcagtcaacctagcccttgttttacagttggagttggctgggcgcggtggctcacacctgtaatcccagcactttgggaggctgaggcaggtggatcatgaggtcaggagttcaagactagcctggccaatgcagtgaaaccctgtctctactaaaaatacaaaaattagctgggtgtgatggcatgtgcctgcagtcccggctactcgggagactgaggcagaagaatcacttgaaccggggaggctgaggttgcagtgagccaagatcacaccactgaactccagcctgggcgacagagcgagacttcgttctaaatacggttgaaattgtgacacttagtgtatacttccttatattatggtgtgcccactccctcccctttttacttcagactttatttcagtcatgattgctttcattgtactattgtaggtgaacgaaatttaggaggtttatttctgtgttgagcaggatattctctgaagttattgcatattttgaaagtagctatcagccctttcctcccttccattctctacttggtgcacctccatgtttttttctgctttgttgtaactgctgcttcctttttcttttgttcttttattcatttttttctattcttcctacattgggttttatcttctggcttccaaatctggaaaacttggatttgttattcttcggtcagtttgacaaagcaacatacttaattgcctcttttatgttaccattaaattaattctgtgaactctgacttcccttagaattgaaaaagaccacgtgtacaaaaatccggttagatagtagaaataagttctagtattcaatagtacagtagggaaattatagttaacatttatttattctaccaaagtagctagaagaattgcagtgctcctaacacaaatagaagatcaatgtttgaggccaggtgcagtggctttacgcctgtattcccagcactttgggaggctgaggcaggtggatcacctgaagtcagaagttcaagaccagcctggccaacatggcgaaaccccattggtactaaagatacaaaagttagctgggtatggtggcacatgcctgtaatcccagctactcaggaggccaaggcaggagaaacgcttgaactcaggaggaggaggttgcagtgagccgacattgcgccactgcaccccagcctgggtgccagagcaagactgtctcaaaaaaaaaaaaaaaaaatcaatgtttgaggtgatggatatcccagttactctgatttgatcattatatattgtatgcatgtatcaatatcacatgcacccccaaaatatttacaactattttgtcaattaaaatttttttaaaagaaacagatgacatcttctttatgaatctcctctacaaaatacctaagttaccctctttagtttcctgttttacctttatgtgaaaagagggaattcactgagcaggttccagtactggaccactcataagttttctcatactgaacagaaatcttccctcttgctaaatttaattggtcttgtctcttggagccattcatgtcctgttctttccattatcctgacagtttctagtatactcgccataactttgattcctgattgtggaataacgtcctttctagtaggtatatcaccccattgaggctgagaatatgttcctttttttttttttctttttaagacggagtttcactcttgttgcccaggctggagtgcaatggcgcaatctcagctcactgcaacctctgcctcccgggttcaagtgattctcctgcctcagcctcctgagtacctgggattccaggcgtgtgccaccacgcctggctaattttttgtatttttggtagagacgaggttttaccgtgttggccaggctggtctcgaactcctgacctcaggtgatccacccgcctcagcctcccaaagtgctgggattataggcatgaaccaccacacctggcagaaaatgttcttttatagttagctttttttgagctacagtgttagcccctttaaatttaatctttaatccagtcttgcttggttttgggtttttaaatcttaattagcttatgtcattggacgatttattagaagtaggccatttatgcctttctcaactctttttttttgagacggagtctcactctgttgcccaggctggagtgcagtggcactatctcagctcactgcaagctccgcctcccgggttcacgctgttctcctgcctcagtctcccgagtagctgggactacaggcgcccgccaccacacctggctaattttttctttttgtagtagagaccggggtttcaccttgttagccaggatggcctcgatctcctgacctcgtgatccgcccacctcagcctcccaaagtgttgggattacaggcgtgagccaccatgcccagccacctttctcaactcttatggtcagcatctcaccagaaacacttgccacttgtttggttcttttggtctatcattaggccagtaagcagcctgactgctgtttacccagccctcctgttacttgtgggttctaacaaatagctttaaagttgttttatggttaattcagtgttcagctttggggaaagaagtgcttaactgccattttaattcccagggaactgcttagttcagcatattacccaggtagaaagttactacctacaaaagatagattactacttttagtagcatttatcaacacctttcctaaaaaaatttaagtttttagtacagctttaaaattttacatcttaagtgactggttcactcttaagtaactgcatgtgtttatggccttcatctctgcatacatagagggggttaaagttaccgaaaagtgaaagacgtgattaggcagtgttactctttttgagacagcctcactgtcaccctgtcctagagtacagtggtataattcaattacagatcactgcagcctcaaactcctggactcagatgatcctcctgtctcagccttccaagtagctgggactataggggtgtgccaccacacctggttaacttttaaatttttttgtagaggcaggatctcatgttcaccggggtggtctcaaactcctggactcaagaagtgatcctcccacctcagcctcccaaagtgttgggattacaggagtgagccaccgtgccctgcaattcttgtaaagtgtattgtaatggaaggaatgatagccttgtctctacagctagattatgaattaccagaatattgtgcttccagcttctagcatggtgtctggtgttattgtgataatagaaataaacatttaagtgcttactcctaagtgcttacctgtattttttctcaataatcttagaggtctctgccttacaggtgagataactgaatcattgagattaagtagttcacacggtgtatagtgctgtaattcaaaaccagactcaccccaaagccacttatgtttataccatctcccatagttgaatgaataatacaatttgtgtaacaatgaaacttttgaaaatcctggtcatttgtttcttaaaaccattgtttttaagtggaaagactcacttgactattttaaatgcaagtgtcttccactgtttgaggcagatctccacagagcaaccataggtggtaaaaagcattgtattcaaaggacaaaacacttttgcagctaagagaactttgaatatgaaagtatgaatgtggtgtaagacagaggttgctatcctaaccaaaacgttcttctgatttccggccagtaattttattttatttttatttattttgagatggagtcttgctctgtcatccaggctgcagtgcagtggtgcaacctcggctcactgcagcctctatctctcgggctcaagcagttctcctgcctcagctgggattacaggcgcccgtcaccacgcctggctaatttttgtatttttagtagagacagggtttcaccatgttgacgaggctcacctcaagtgatcctgccaccctagcctcccagagtgctgggattactggcatgagccactgtgcccggcctcaggccagtatttttaaatatcggttaataattgcaggaaacatcatttcaggttgacttttctcacctttaacctctttatatagcacagtgcaatctggccctactgccacttcatctgggttatctgtagcttgagttgtaaaaaaaaaaaaaaaaaaaattgggggaagaagttgggttaaaactgttcacctacccagcattggaacataatgggtaaacaaaaagttggagttaccatttaaaagcatttttcaaatttatattttatatataagtaggtgctatataaactaatactttttttttgtaagaatggatttggaatttagctcagctgaaaattgacttcaccttgattctcagagtgtacttgaactttaaaggaagtggggtagtgagaatgggtggttggggtttttttgctttaatgtttacctaattctactactagaattatttttctcccccttaactggaaagaaaaaaattacacatttattgagacttcttcccatccccaacacaatgatctaatctttttgctttaaaatcagttaaagagtgtaatttttaaaatcctaatcaaatgactcagattgtaatagtagttttagacagaattttataggatgatgttttaattttatctgttgtctgggatgatctgtaatcgtgtatcttactagccgaaaatgacttcaatgagattaaaggtctgctctttaaaatctgtaagtctcctaccactgtctttaggaaaaataaaacttttgaacggtttttttatctgttgtgaggtttgcttgaattgtgttgttataaatgaagtttattttgttcctccttctctggcatggactccttaagtgtcttacattattggtttctgctttagtcatttctccagagtcccaaaaggttcatcccgtatgttctttctattttcatgtcatgaccacatgaaacttcagatggaaagcttgccagctcattagaaaatgttcctaaatgtgaacggtcatgccccacattcatgaagtcagcatgtaaatagataacattgtcagggaccaatgttcaattttattgtcctcaaataataaactgaacactaacttcaaacttaaaatattgctgcccaaagcattctgctttaaaccacaaattcatgtgccagctgcattcacaattgtattgacagtgactgggcgttaaagttttataacttaggctatagtttgttctttaagaaatgcaagttctttcagttttgtaaatgttttattctcactatgtctgtttcttttcttcttaagtctcttttggaaaagttcttgatccccaatgcttcacaagcagagagcaaagtcttctatttgaaaatgaaaggagattactaccgttacttggctgaggttgccgctggtgatgacaagaaaggtatgctgtttttaaacctgttggttgaacttgtataagataacatagtgaggaagagtctctgaagcgtacataatgtcttgttttgaattgcttagagtgccgaataaggagtagcagtgctctttgtgttctgagaatacacatctactgcctcatactgctattctaaaataaatgctttctgaaaagccaatattgtgtacagggatgttttttcaagattttaagaaaagtgaccagcctgagcaacatctctctctacaaaaaatattttgaaaattagctgggcatggtggtgcaagcctttggtcccagctaatctggaggctgaggtgggaggattgcttgggtctgggatgtcaaaactcgtcaattttttaaaaacataacaataatgagattataaagttgttttatcttgacattgatcaatggctagtgtgtaccaggagaaagctccctttaaaaaaaaaaaaggaccttgttcaattaacaaatattaagctgttacaggttagtatttcaaaggatatgtgagatattaaaggtttggtttgaggggtgaagatataatgcacactttatctcagtacgttttggtgtgtcttatccagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagtatgtattttacctgttacgtagaaatttagcagtctttattatttgagcactgaaatgtaatgtactatttttaaatcgtaggcttttgatgaagccattgctgaacttgatacattaagtgaagagtcatacaaagacagcacgctaataatgcaattactgagagacaacttgacagtaagtacataacagcatcattagtgatgaatgtggttgaagaggttatgttttactctagggaatttttttttttattaaatacatcttttaaaattttttctcaacacatttcataggctctcataaatatatctcagctactattaaagtcctatgaaggaaaattacagaaactgaaatattagactgagaactaaaaaatacacacattgatgagttacctgtcttgttaaaatttgttagtatcaaaagtgtgctgagactctacatgttttagttcctttaagaatgattttcttgcccatcaagttgcctccatattggtaaagataatggtagggaattaataacttgagttacaaaatctcaggtatctacagaatccaagtggaagtctattttgcctagcttcttattttaaatgacttaatatgaaaggtcgtgattgtccttgggatactgcagatgtataaaaagaaacagtgtcactatcacaccaggaacatcaacataattccctaataatgtttgaatatctaaataatacttgaattccaattatctctctttttttaagttatttgaattgggattcaaattcagtccacaatgcagttgatttgtatgtctcgtttgtttcttaggtcttctcattcttctccttcagataaatactagatttgaaattttgaggcttaggtgaaaaaattatcaagcatttgctgtgtgtcaggtaaagaggtaggaattgcagatcataatctaggtattactgtttttttgttagacttctagggccatttctcttggggactatgtaatctcattttatacatttctcttccaactttattctagtccactgccattttctataaaccagttctatatgctagtgctgaaaatcttgaagagttttttgaatagtattgtatacttgtttattaaacctaaaattactttattagcacaatttggagctatctataaacttttctgatacttgagtcaagataacaagccacagtaaagaatgaaagaatcttatatatcaaacataagaagcactttgttaactaactttagtattaaggatttttcttttctagtttgaagtgatgacatttttaaagtgatgacctgagacctagatactgtgttttgttcacatcactttttgagaggccctgatctactgtctgcttccaactgaattttgctatcagtatagcatgaagagcgcatattgcaataagaaaaccagggttggccgggcgtggtggctcacgcctgtaatcccagcactttgggaggccgaggcgggcggatcaccaggtcaggagttcaggaacagcttggccaagatggtgaaaccccatctctactaaaaatacaaaaattagctgggcatagtggtgggcacctgtaatcccagctactcgggaggctgaggaagagaattgcttgaacccgggaggcagaggttgcagtgagctgagatcacaccgctacactccagcctgggcaaaagagcgagactctgtctcaaaaaaaaaaaaaagaaaagaaaaaaccagggttttgattctaattctgtcactacttgtatgtcttctctgagccttattagtgtcagctgtcaccattataggttgattggaacatttatctgtcaagaaaagaaattatcccaaaacttaatatttcattctgaatttggttgaccaagactgtcaacacattactctagaaaaagaaatattttgtatcaaatttgcatgtttatacagaaaattcaagaatccttgaaagttagaacaggaaagagacattagaaacaatttcatcttgcaattacaaaaccccttgtttgacaggaggagcacacagtttccaagaggtcatttggctatctgtatgaccttggaagtagtctcctttccaggccagagatatatttgcttagtagataaatgaagctaatggatgatttggggaatataaaaataataattagtgtattttccccttcccctccattttcatgtgtaagtcatatataaaatttaagattgtcttgaatccttttgtaattacctctgaaaatcactagagagtggttaagacttcaacatttttaacattggagcaggtggaatagagttcataaccctgccacctatgggacaactttcatttttacctgttaaaagatttggttctggtttttgtccagcatttattttgaatcatatgatagggtagtgcaaaagtaattgagggttttgccatttaaagtaatggcaagagctgcgattacttttgcaccaacctgataaataaaggtttgtttttctaagcttaaagtgttagaaaagctagatttgtagtttagctcagagttgaggctggttcttgaatttcatggagtataggattctgtttggagtgtgagtcactttaagatctaccagtggagagtagtcaaccctagctccttcagcatgggccaaattagatgcttctggtatagttgcactcaccttggacgtccatctttcatattggggctctttaggttctgacacctattgatgcttagtttttaaaaaataatttagggcctgggcacagtggctcacacctgtaatctcaccactttgggaggccgaggtgggtggatcacgagatcagatcaagaccatcttggccaacatagtgaaaccccgtctctcctaaaaatacaaaaattagatgggtgtggtggcacatgcctgtagtcccagctactcaggaggctgaggcaggagaatcgcttgaacctgggaggcggagggttcattgagccaagatcacgccactgcactccagcctggtgacagagcgagactccatctcaaaaaaaaagtattatttcttgtaatttctcttcaccttctgtggataaccaaaactttcctgtatttgaaggttatttgaaggcaactctgtggtgtacttaacctgcttatatagtggttacaaaaaaagtaaatttgtatattgagatgtttttgtatcttgaagctaagtgatgctgctatctttttaagaatgctttccaactaaaacattcaggtatcttggcacttatatgaaaacgcccccccccccccatcccactgaaacttgctgaaaaatctttccttcttttaccagttgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaccttggggtctttatttccaggagaaaagataccttctgcatctagggcaacaatccttttccctcgcagctctttcttttac

SEQ ID NO: 14137 - DNA, 29638 bp, Human
gcaagctgagggagctggctccggccttggccagcccagaaaggggctcccacagtgcagcggtgggctgaagagctcctcaagtgccaccaaagtgggggcccaggcagaggaggcgccgagagcgagcgagggctgagtactgccagcatgctgtcacctctcagaagctttgttttttgcaataaatcttgctgctgctcactgcctttatgagctgtaacactcaccgcgaaggtctgcagcttcactcctaaagccaccgagactatgaacccaccaggaggaatggacaccttaacagctgtaacactcactgcgatggtctagtagcttcactcctgagccagtgagaccatgaacccaccagaaggaagaaactcggaacacatccgaacatgatgaaggaacaaactctggactttaagaactgtaacactcagcacgagggtctgcggtttcagtcttaaagtcagtgagaccaagaaccctattccagacacagctctgacatagagtggcaacactggtagcgtgcacaggagcagaggcagcagcaaagtgagaggaggccctccacttatgctgggcgccctagtagcagcagcaacacagcagcggtgccactggtggcctggcagagtggaatttggttgattcagcccagcaccatcaggctgtgactttagcagactgtaggtagtggtggcagtgggtccaagctgcatttacagcccccaggacaaggagacctgaagcggaaacaatgcaggagtagaacagcaaatgtcctaggtcagtagtgtatggaatctggaaccagatagccttgttcaaatcttgcatctgccgtttgctagcgttttgaagctttgagtaaattactaacctctctgggtctgttttctcctcagtaaataatatccagctcatagagaggtttagaaaattaaatgaaaaagcacagctctaaggaggtgattgacaatagtaagcatatgatttatttcctcatctttatgacatctcactctggtccagaccaagattacttaatattcagattaatttcatgaactgctatattactccagcaactcaaatccaaaatagatgaaaaggaaactaaagaaaactggacagccattgctgcacctattgtatagttacaaatgctgactacataccaaaacactgtttaggtgacttataattctggaatgtcacatacgaatttaagaattgctggccaggcgcagtggctcacacctgtaatcccagcactttgagagacccaggcgggtggatcacctgaggtcaggagtttgagattagtctggccaacatggtgaaacccccgtctccagtaaaaatacaaaaattagccgggcgtagtggtgcgcgcctgtagtcccagctgcttaggaggctgaggcgggagaatcgcttgaacccgggaggcggaggttgcggtgaacagagatggtgccactgaactctggcctgggcgacagagcaagacttcgtctcaaaaataataatttaagaattgtcattacttaaccatgggagagggtgtgggcagacaggggacaaagattttccactgtgtattttcatggtttttcctttgaacaatgtcctctcttccaacaaaattttttgcttttaagtgccacataaaggcagctcatgttccttacatcgccgttatcaagaggatcgtcattcaaataaagtaaccactgacaatgctaattaattggaagtaaagaactgggcggaaagaacggctaaccgcaagctgccgggtcgcaactgcggcggaaggcggactctcgcgggagccacaaagaggcagcagccggccacgtgacttcccggtggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggtgaggctgggggagtgtgcggaggggatggccaggaaggagatgccagtgatggcaagtttgaagttggaggcggtggccgctccgggtcctggggtccgcgtccaccccgctggcctctctccgccctctccccaagcctaggctcgtagcagcaggggtccccgcgggcgctggagaccccgctgcggcctgccccttgcacgcggagcgcggggccgtgcccgggcgaccttgcttcgtggccggccgagggctgggcttgctcctcttgccctggaccctcgcctgcaggagcggccagaactggagggtcctcggctgcaggaggaggcgctggacacggctgcgctccgagcgcgccgcagccgggctgtttcttttggccacctccggctccgctccacccccagcccctcgcgctcagggctgacgtgtctttagcttccacgccgggagtccgtcttcattcatttgccaaaacccttgttttctacacatctaagccatcagagtgtcttgttcaatggtcatctgccttgttcacgccctgcttgacccgtatgtgttactaggaggcttgatttcagaaaaactaccccatcgtcacccccgttatccgcccctgctgccaagcagactgaagaatccctgtgggatgtctcccttctgccttcttcctcttcttgtctttccatggaacaattttttgtttgtggaaacatcgtattgtgctgaaaaaatgtggcctacttcgagtgtttttaatacatagatttattctttcaacaattaacccagcaattaagtgtgaaaataacttagcagaatataaaaatatggcaacttgacttcctgcacaggttttgtcgtgaacttcgactttctaatttgtaaagtgaaataattagtctgactaagcatccctttcattctgtaagtttaagcaagctgtgtgtcttaacggtagtgacaggtattcacgagttgttttgcgatgaaaagtgaagtgactggcttctgtttaatggctagaaaaccaagtgggagaattaaacaactgttaatgagttaatctgcaggtttaacaagattttttactttaggagtcgtttgctggtactctttaagctttttaaaagaaaacttgacaaatgtagttttagttttagaactatttataactattttcaagttataaaaactttcaagaagcatgaattcattatctaaactgaattaatatcttgtaaacattttttgtgagaaacggtttttgtgtttggtttttccagttgaatgaagactgttagacttcatggggacaaaattgttattggttaacattaaaataataaaattgtttaatatttatgaaaggcctttatattccaaagtgctcaaatttaaccacgactttaaattactatatcagacatggtatttttcttactggtttttgaaaaggacttgtaagttatgaatgcactattttaggctttgttcagcaggcagtgaaatctctttagttcataatgcatggttcagtgttctttaatattttgcaataaatcttagcagccagtgagaacttaaagacatggaaaagactgcaaatgcatggtccttaactgtttctcctgggtgaaaacacgcttcccttcccatgttttttatccacagaattgccacatcatcattttttctgagagatgttggaagacactagaactttgaaattctttttatggtcttgcctgaaatagatataatgtgacttacttagagtactattgtctataaaactgtgattcaccttttttttgcattatacctgtactttgtaacactaagtttgagaaaaaatatcttaaaacatgtttgaagccacatgcaaaaataattggattctttctttgctatcaaacctgaagctaccaatacagtttttactaaacaatgtttttcatgcaagccagtttttaccatggatatgattacagatatttgttccttggcttacaaactatccagttctaagagtttcagctgtagtcacctctgataacagtgtttcctacatagaacattagaacttaagaatgctttatttttttatttttatttttttgagacggtgtcttgctgtgtcgcccaggctggagtgcagtggtacaatcttggctcactgcaacttctgcctcctgggttcaagcgattctcctgcctcagcctctggagtagctggaaccacaggtgtgtgccaccacacccagctaatttttgcattttcagtagaggcggggtttctctgtattggccaggctggtcttgaactcctggcctcaagtaattcaccctcctcagccttctaaagtgctgggattacaggcgtgagccaccgcgccggccaagaatgctgttttcttttaaacgtgggggttgtttagtttgctttgtatggttaatgacagggattacatttagaagtttcttatctttgcaaaaaattattttccttaatttgcttaacaaagttgcttgaagttctttgtgcttcaaggcatctttagtttgtgccattcatttttccatctgttgggcactttttgaagttaaaccacatttcccattaaaaataacatggaaggcagggaacagtggttcacgcctctagtcctagctacccaggaagctgaggtggaaggatcacttgggcccaggagtttgaggctgcagtgagctatgactgcacaactgtactcccaacctaggcatcagagcaagaccctgactcttaaaaaaaaaaaaaaaaaattgatatgcagttgttaagactactagtaaactaaaatataaatattcttcggtgcattgtaattggcatcattcaggtgaactgggagattctgttagtccaagggaagttttttttgcctatacctgatgttaaaaaaagaaattagtatttcagagtaaagggtaactgctttttctgtattttatcattaggcttgttagcagtggcacaagatcttacagaggatgaagaaacagtagaagattccataattgaggatgaagatgatgaagccgaggtagaagaagatgaacccacagatttggttagtgttacatactatttaatatatgtaaaatgtatgtaattgtattcatctgttctcatgctgctaataaagacatacccaagactgggtaatttataaaggaaaaaggtttcattgacccacagttcagcatgactggggaggcctcaggaaacttaccatcatggcagaaattgaagcaaacatgtccttcttcacaaggtgacagcaaggagaagtgcagagcaaagggtggggaaagccccttataaaaaccatcagatcttgtgagaactcactttcacgagaacagcatggaggtaaccgtccccgtgattcatttacctcccaccaggttcctcccacgatgtgcagattatgggaactacacttcaagatgagatttggttggggacacagcaaaaccgttatcaatagtacatctagaatttatccttacttatttatttttagagacagagacttgctctgttccccaggctggagtgcagtggcacgagcatagctcactgcagcctcgaactcctgggctcaagtgatcctcttgcctcagcctcctgagtagctaggactaccgtcatgccccaacaagcccggctaatttttgtaatttttttttgtagagacagggtcttgctatgttgcccaggctagtctaaaacttctgggctcaagtgatgatcctcatgcctcggactctgaaggcactgggattatgggcatgagccaccacacctggcctagagcttatccttatacaaaaatttaaaatcccaacttttagaggtttgttaatgtgatcaaagtgaattgaagttgggagaataggcaccagtcattgagaacagagcataagtattttctggaacagggaaggagacatgaaatagttaacaattcaggatcgtggtgacatgagtctagaagggtaacaacatagtagaaatagcactggacctcatggtttcatagatttggaatacctgctgcttccttttctgacttatctctgtgggtctcagtttctttttcgcttgcttgcttttactctgtttttattctttttgcttgcttgttgtatttctgaatccttatgtgccaggcactgttcttggtgctgggtgggcaaaccagatattttctctgctctttcagacttttttttggggcagttatatgtgttttaatggcagggggtgagaagcagacaacaaacagtatgtaaaatatatctggtgaagaataagggggttagagaagatctcttaaaagttgttcagctctgaaatgtttactatgtaatacaacagtaagaatattgggctggaattgggatcattgcagcatgcatctagttaattttatttcctctctggaacgactataatccatcctacacagctttttttctttctattttcgtgtcatacttgaacctggaacctctcatgattccagattttgtcatttccttcaaaattaaaccactagttccctattttcttatttcagtatcaaaatatttattcttatatatagatttctgcttcttttttgacttactttcatttttatggaatatgtcttccaactaagcaaatctgttgctattttattggtgtttttgagttatcatttttatgcttctgcacctactgttttatctggataggatgtccctagtaatttgtgaactctcctaatttccccctctttaggaactccttactgattatctgtgagtcaagcctttcatatgtatgtatacacatacctttagggtttatgttaagactccacgtcttcaacccagcctgcattaagtgaatagctttaactagattaatacatttctgctgcattgttgttaataaatatttgactagttgtggtaagataacttagagtgatggttggaagggaatccatctaggaatttaggattaaagatggtatttggggcactgaaatttgggcatgtactgaaatttattgatgaattatatcgttgttaccaattatatgaaattacttgtgctctctggcactagaatgtacttattgtggaggaagagggtagaagagagatgctgaacgccatgaggcacgcctgtaatcccagcactttgggaggccaggacaggaggatcacttgagtccaggagtttgagaccgcctggccaaaatagtgtgacaccatctctactaaaaaaattagctgagtctggtggcttgcgcctgtaatcctaactgttgaggcaggaggatcacttgagcccagaagttcagtgttacagtgagctatgagtgtgtcactgcactccagcctgggtgatagagtcagaccctgtctctaaaaaaaattaaataaataagtagagggtagggagtagagaagggaactgttagatccttgatagccttgtgtcgttgaccagaacttttccatatcttaatttctcctgtcttgagaaccattagaggaaaaagaacaactctgattatccactttctaccctggccaattagtacagaagtgttagtaccctctgctttgttacttatctcaaatcagaaaataattaaggtagattgaaatagaaaggcaggaaaagtattaccttccattgtactagaccacaccagcaggggtaggcttgtgtgtagactgtctaagaaagatgggccctcaaaggcaaggctgctacagaagtcacctccagaactgaatgagctagaaagttcacctactgctgctgttcccaagatttatcaccctatactcagctgccaaggcatcaagggattgggagatatggaaggatcctttgccactgggccagtgtcctggagtcaagtgaaggaaaagggggtttttcataagatctaagatatcaacagctggtttagacacaggttattggtttagaacttttgaggacaaaccttttttttttttttttaagtcaccttgggctttcccccacccccccaccacccagacagagtctcgctctgtcgcccaggctggagtgcagtggcgtggatctccgctcactgcaagctccacctcccgggttcacgccagtctcctgcctcagtctcccgagtagctgggattataggcgcccgccaccacacccggctaattttttgtatttttagtagagacggggtttcaccatgttagccaggatggtctcgatctcctgacctcgtgatccgcccgcctcggcctcccgaagtgctgggattacaggcatgagccactgcacctggcctagtcaccttgggcttttctaacccattgattattcttttactctataaaactgggtcgcaatggaacttgccatcattcctgaaaggtttttttgtcctccccatagaaatgagagaggtttttgttttaatttttattaaaacaagagctgtagtagtaataacactaactaacttaaaaaaaattatttagccaggtgcagtggctcacgcctgtactcccagcactttgggaggctgaggcgggtggatcacgaggtcaggagatcaagaccatcctggctaacatggtgaaaccctgtctctactaaaaatacaaaaaaatctgccgggtgtggtggtgggcacctgtagtcccagctgcttgggaggctgaggcaggagaatggcgtgaacctgggaggcagagcttacagtgagctgagatcgtgcctgggcactatactccactacactccagcctgggcaacagagcgagactccgtctcaaaaaaaaaatagttatttaaaatagatgatatattcaaatggctcagaacttacaaggtacagaatatatgatgaaaagtttcccttgtgtgccttccagccatgaagtcatctccctgtaggcaagcagtaccaccagtttctatactctcctctggagattgtttgcaatagctgaaatattctggagttttaccgggtagcagatactaagcgttatacatcttacatgctgaatagctgtaagataaatgagttacttagttttccacaatcagtgttccaaacatttgccatgtttaaatccctaaatgagttttcagtcttggcagcaacattgccttcagtgtcagaaagtgaagaaggccatcaagcatgaactctatcagattttgtattttctacttccaaatatattattcacccatcgttctgcattttcttcttaataatgagttgtccttgttctcttctaaggctaacccttccacctgtgttcatctcttcctgcggaattttgttacattattctttccttttgtaacgtcaggcattaatcctcctcagtgatttgattctgttaagccacacatctgcttatactgttcatccacatttgctgcacctacttatctttaccaagaccggtggcttcttgaaagagaaacagggacagcttttctcttctgctcacttcacatttattctctatcatggtctggtcccatatatctagtaaaactagtattgctaaggtcaccagcaacctaattgcctaattccttgttttccgttgttatcctgttgtagctcttttccagctcttcacaggatagtttcatctgaatgctccataagtacttcacattttatatgtccaaatcttttgccatgtgtcctactccataaactctttattgttttgatatggctccagtgattcaagctgttgtcttgttacttcttccgtttgtttttattccaaaacccattaatcagatatcagggatttctcttgctgaaatataccctgttcctgtctatccctgtcatttatggtttcagcctctctgtctctgttctcttttcctacttatgggtctcttttctcagaatagaaacttactcttactaaatgaatgaaatcattaaggatacttaaaatataacttacaacacagtttcacagtcattgaacaagtgtgtttgagtgcactctctcttaagtgcatgagctggatggtggaggattttaaaattatgagataatctttgctcttgacaagttttatctattggaggaaggagtattttatgtaagtgaaaagttaaatgccaataaacaatggcatcctgaagcatctcaatttattaagagtctggatacttcaaaggtgtgactgtctctaatccatattgatgcctggagaaatgatgctgcactgtgtttaaagttttaaataaaatttgttcacattttaaaaaaatttgttgagatacagtttatgtatcataaaattcatctgttttaaacatacacttagtaaatttaccaagttctgcaacataaattcagttttaggacgtttctatcaacccaggaagatctctggtcacactcttttttttttccttcaaaattatgtgactgatcctcacaggaaaattttgttaattagaatggaaatctctgtaggctgttaacaaggtacttgagagcagaggtgggcataatgtggttgcaagccacatctagcgatccccattcatttacgtattgtctgaggctgctttcacacagtagccccagagttgagttgaatagttgcaagagaggctttatggtctgcaaggccatatctgctatttggccatttacagaaaaagtttaccaagctctgttctagaaccttggagttcacaatatggtctgaataccagcagctttggcattttctgggtgcttgttagaaagagaatgataggctttgccctagacctgaattagatctgcaacatccccaaagaattggtaggcacattactgttcaagaggcactgctccaaaagttctgttttaattaatgaggtatgatgaaattcttattgctaatcccagcaaagctgtagagaagcaatatttcttcctaacataaagtgaagtctttatttcttttttttgagtcggagtcttgcattggggcattctcagctcatacaacctctacctcccggattcaagcgattctcctgccttagccttccgagtagctgggattacaggcatgtgccaccacacctggctaatttttgtatttttagtagagaacggggtttcgccatgttggccaggctggtctcgagctcctgacttcaggtgatctgcctgcctcggccaagtgctgagattataagtgtgagccaccgtgcccggccaaatctttatttttaaataatgatttttttttctcccatagtaatctcctcttaattgttctttttcttaggtagaagataaagaggaagaagatgtgtctggtgaacctgaagcttcaccgagtgcagatacaactatactgtttgtaaaaggagaaggtaatacagaagtattagttttaattcagatgtaggcattttaaaacgatgagcttgttcatatatatctgaatacccatatctgtaaagtaatattgttggcatttaaagggaatacgtaggtgatatagacacaataaaaaataaaccaaggggaaaaaataaaataaatactacctagtttaactagaaattgactgtccttttcaaagattttgtttttgagacagggtctggctctgtcacccaggctggagagcagtggccccctctcgactcactgcaaccttcacctcccaggtttaatcgattttcctgcctcagcctcctgagaaagatgatgttttaaaacttctttaaactgccacagcaaagtaactttgtcttttttttttttttttttttttttttaagatgtagtctcgctctgtcacccaggctggagtgcagtggtatgatctcggctcactgcaacctccgaggcctcccggtttcaagcgattctcctgcctcagcctccctagtggctgggattacaggcacgtgccaccacgcctggctaattttttgtatttttaatagacagggtttcaccatgttggtcgggctggtctcgaactcctgacctcgtgatctgtccgtctcggtcttccaaagtgctggaattacaggcatgagccaccgcgtctggccctttgtcacattttgagtgttaaccattaatgagatacttaatttttccaatatggtctaggttagagcctaggattttttgtttgtttgttttttgagatggagtcttgctctgttgccaggctgcagtgcagtggtgtgatctcggctcactgcaacctctgcctcccaggttcaagtgattctcctgactcagcctcctgagtagccaagactacaggcacgctccatcacgcccagctaatttttgtatttttagtagggatggggtttcaccatgttggccaggatggtctcaatctccacctcatgatccgcccgcctctgcctcctgaagtactgggattacaggtgtgagccaccacacccggccagtgcctaggttttattaaaagaaaataattatggctgataatttattgagggctatattctcaatacttggcatgtattatttagttctgacaaacccactgagcgtagtcattgtcgaactgaagtttggagaagaaactggtcagggctcccagttcataaatagattggagaacacaggatccagacctagatctgttggccccatagcctgtgctgtactcagtgaaactcagctttgtagactactgtataattattgaagacttaatattgaaagttatgaattttcttggtcttcttacattttctgttttattctcatgtgcttttgaactttatgcctgtaggaagtataattttattatgctttttttcttccatttttgtagctacatccttgggtcttaaccttcaaatttgcattttgattaattgcttaacgtggattgggattgcctgattaatttttacgttctaacagatgctagttttcagatgaaactcttggactttatcttttcttcattcttctatttacctgcacagataacactaagctggaggtgaaggtgacttcaccaacacacgtaaccctgctgcttgattatttcactgccaaaaatacgcaactcttttttaccacatgatttggatgtgatctggtctgaaattgagacgcttattgaatgcttatgtgggagtgctagcgtacagacaaaagggtttcagcctatacagcaacttgaaccaatttctcgttagtaggtgactggagtgctctattggaagggattctgacaccaaagtccacaggaaagggtgccagaatccattagtaatgcctttttaaatattttgtgctctttccatgtgttctaatttttttgtctctattttgtttctcagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacgtaagatcctctaaaccttctttttgtttaagttagagatggatgggggcggtgacgttgtttaatagaatatatctgttcattcagttgcctgttttgtggttgaacctgtgatagccaccagggaagcaaagataaattgcacgtttcttcttcaagtctaatccagtgggggaggcatatgaaaacaggcactagaacatgctgataagtgatgcatactagagataaggggaataaggtgctattgtgtgggagtggaagtgaaaatggagatgtaagtaaagctatgagccggatcttaatgggaaaaggagcagtaagacacacaatggagtctacagcttattcagatgttaagatctgttgctgggtacagtggctcacacctgtaatctcagcactttgggaagctgaggtgggtggatcacctgaggtcgggagttcgagaccagcctggccaacctggtgaaaccctgtctctactaaaaatacaaaaattagctgggcatggtggcagtcgcctgtaatcccagctactcgggaggctgaggcaggagaatcacttgaacctgggaggcggaggttgcagtgagctgagatcgcaccattgtactccagcctgggccacagagtgagactccatctcaaaaaaagaataaaagatctgtcaaataatttgttttgtacctccttttgttgcttgcattttgcccattttactacttctgtttgtaaatttaaagactgtctataattgttttcccatcattttatgtactcatagataaaatagaaccatatattttcaatgtagtttcagcagcaaggtttatcatttactttttgatttaggagaaccaaatgtcctaatataagctctgatgccttatgatttttaataatgtatactatatatcagtcatcaatgactgaatgagagaaccctagtagaaataggtcctctaaatgagagcacatctaaaccattcctctgtcaaaaagttttcagacgaggaaattttattttctcttggaagctaattcaaccttttcattaccctggtgttaacatgtttaccttgtgtctgagttaaatttctagtgctgcaatcaagttttcttttttctgattacttagtagagaaaaggaagtattttcatcctgtcctcaaaataataacttacagttattacttaactctatagttaagtagcttaaagaattactgattttagcttgtttttgagtagaataaaatttaatccaacaggtatatatgaagttttagttccttcttttaaattcacctgtaccactttttttttaatctgtgtattattcctgaaattatcaatagaggaatgcaaattgaaggatcttgaagtaaaacttacataattacagtttagcaataagtgacagttttgacaatgtactacctttgtgaagaatagctgtgtattgccccagtgagtctaatgcatttgaaaactgaaattgtgaactgataaaattatttcaagaccacaacataaaaatattttcatacctaaagtgaccatcccatttattatgaagaaattggtttccagcccactgtctttttttttttttttgaggtgggagtttcgctcttgttgctcaggctggagtgatctcggctcatcacaacctctgccttctgggcacaagtgattctcctgcctcagccacctgagtagctgtgattacaggcatgcgcaaccatacccggctaattttgtatttttagtagagagggggtttctccatgttggccaggctggtcttgaactcctgatctcaggtgatctgcctcggttggcctgccaaagtgctgagattacaggtgtgagccaccgcacccggcaccactgtcattttagaacatgaatttaacttttgttccgatctagttcttaaaatgacctgcttctgcagctgccgctgtactcttccttccttgttttgaaggattgcaaacaacagaaggtaaagcttgttggcgtaagaatgctgtgagctttgtttctttctgcacgttttatctcatttttattttactctctgggtcctcacaccaccacccctaccccagaagaaaattcaggggacaactttggcaaagtcggtgactttttttaaaggggtgtggatctcgctatgtttgctaggctggactcacaagtcctgggttcaagcagtcctcctgcctcagcccccgagtacctgggaccacaggcatacgccatctcacctggcccagagactttatttcatgtgagaaaataacaatgttgagtccctgccacagaatattgcagttacatatgaatttgttgagtcttctaagtgatgggaaggctatattcaatctgttagagtaactgttttaagtaatgttacatgttttacttcctttattgcatttagatttttctgattattttattttcttaaacagggcaatgtattccaagatgcagtcttcaatcaaacagttacagttattgaaagagaggatgggttagatggagaaacgtaagtgaaagttgtagtatgtagatcttgattttgctcgtaaagtaagactggaaagcttgctctgtttcagcattgttttagatgttgacgatggaatgaactgtatagatttggtgaaatccttacgatattcattcatacttcagatgattcttataactataaaagtcaaattaggaaagatagttgaaactgatggaagaatctctttaaaagttagtattggctttctgtccttcctctcatctaaattttctacctcatgcttataaactgttcaccagcctaaactaagtctcgtgcctctgaaattactattgaaaacataagttagaagattttatcttgaaaaatgtaagtgttctttctgaatgatgaatctttttttactctaaacttatatataattcacttaaggtaatttttaaattggattgtgcaaaataatgtaatattccagggagatgaaagctaatgcaattattttataaaccaagcttttgaatagagcataaattgtaattctattttcaatcatagagttttttttaattgactaattgctcttaaaggtaatttataaaacttaactacctggatttaagttgaatacaaagcattttattccttttcgccacaagttatttggaaagcttctattatgtgttataattatagttgtaattagacgtggtatttcctctgaattaaagacagttcatattttctccttttgtaccagaatctttatgtatatgttccttgctggtcttgggcttctggttattgttggccttcatcaactcctagaatctagaaaggtaattatggatgaacacctcttacagccgtgtttcaaaagttgttaagtactaagttaagcagtctagttcttcggcctcatactgtcactgtgggtttgtatacgtagaactttgttgtacctttttaaaataaaacctgaagccttagatatgtaaattgattcatttaaacttactttctttttttttctggagacagagtcttactttgtcacccaaggctggagtgtgcagtggtgtgatcttagctcattgtggcctcaacctcctgggctcaagtgatcctctcaactcagcctcccggttagctgggaccataggtgtatgccaccacaccccgctaattttaaaattttttgtagaggcagggttttgccatatgcccaggctggtctcaaactcctgaactcgagcaatctgcccaccttggcctcccaaagtgttgggattacaggtgtgagccactgcacctggcctcatttagactttcatacacacatacaattatttattgtcctttgtgccctccagagtgatatttacctttggattggtattgtagctctaaatgctagaatttttattccctaaactcagattttattgttctgtttactttactttttaatgggtatgctattttatctgcaagtaacctagcttttatattttctttaatattcttttttttttttttttttttgagacagtctggctctttcatccaggatggagtgcagtggcacaatcttgcttactgcaacctccgccttcggggctcaagtcatcctcccacctcagcttcctgagtagtcgaactacaggtgcacgccaccacacccagctaatttttgtatgttttgtagagacagggtttcgccatgttgcccaggctggtctcgaactcctgggctcaagctgtcctctcatgttggtttcccaaagtgttggaattgtaggcatgagccaccacactcagcctgcgttaatactcttaattatagaaacaatccttaattaataaacaagtcctttcattggaaaaagaactaatacattttgttctctcagtcaaaattctgtttttgtggttagagtaataaaatggtaacacctagggtctgccacgatcatggttctcactctggattcattccctaccacatccttatttccctcctcttccccattccctcactcaccctcctcctttccttccctcactcaccctcctcctttccttccctcactcaccctcctcctttccttccctccagcctacaaaaacaaaacctatactatttctctcagtgggaaaatataaacaattttatcaaatatgttaatataattcattagaccctaaacagttgctaatcattttggcgattatttattaagcctttagtcaggcagtcaaatctatattaaaattaacaatgaatgttattaataagctctttctctttaaaagagaaatactttgtgtttaaatgttaatttctaaaactcgctttgcctcattgtcataatggttggaatttttgctgtaaatttgtatattaggtataactgcatctccatttttcttctatttaaatgaaactatttttaagttatctctccatgtacttaggttctaacttacggattatataattaatactgtttcttatgtagataaactgaggtttgttggtttcttgggtttttttttaaagcaaggctaaatgagtcatttttactttctagcagttttgctgtaaatactctagggagaaagtttgaagttcttaaattgaggtggttagcttaatgagattttatggtttcgttttgttttgtctgtgccaactgtttaattgtatttagcttacgatgcagaaactgcctgcatgtaacatatcagcagttatcctgaattttgttgaatatagaaataaatttattctttgattacaatttgattcctaaagggaaataaagtcattgtataaatagatactcttatgtggtccaccagtggtacataacatgaacctttatagcaaggggaaaggtctttaaagcctgaaaataaatgtgatgaagatttattctttatcatcagtactagacatgattttctccttccctttaataaagtatttgagtagaagtatgttctaggaagactagaagagaatataacttgtttaccaagatatttaaattaagtaatttgataggtgttttaaaaattagagtaaacagctggtcatgatagtatgtgcctatagtcccagctacttgggaggctcaggcaggaggattgcttgagcccaggagttccaggcagcctgggcaacatagcaagacctcaactcttttttaaaaaatattaagtaaatggtgtaacggaactcctttaaaatatgtctttatgttcttttagcgtaagagacccatacagaaagtagaaatgggtacatcaagtcagaatgatgttgacatgagttggattcctcaggaaacattgaatcaaatcagtaagtagtcttacagacttggctgggaagtttttctcttaagtggaaattaaataccttagatttagtttaaaaaaaaaactttttcagtactatttaacattcatcttttccattacttgtgtagaatctagtatagtgattaattaagaccttaaaggtttattcagtgtgtagtcttcttatgctttaatttggaaattcttccagatctgcagcttatttatgaatgtgtgaattttctgtgttcctaatccatttcctgtctcttttctttctgttgcttcagtgcagagtagaagaggtgaggcatttaatttttttaatggtttttgctagagaattgggggctctcaaatagcacgtaaatattttacgtcaagtttaatgagtaatggaacaatttttcttactacattttattagaaaaactacccagtataacttgaaagaataaacctaaaatattacccgacaatttattttacagatacatttcagttttattacatattcagttaaaatactaacctttataaaagaatatagaaatgtttcttcaattgtaggacattttaaaaatgtttattataaaaccaatgcagcctcattataaaaaattaaatagtacagaagtgaaaaaaataagtcaattcctgacttcattaatcctatttatttatttatttatttatttatttgagatggaatcttgctctgtcgcccaggctggagtgcagtggcatggtcttggctcactgctacctccgcctcctgggttcgagtgattctcctgcctcagcttcccaagtagctgggattacaggcacgtgccaccacgcccggctaattttttttgtatttttagtagagacagggtttcaccatgttggcctggctggcttcgacctcctgacctcaagtgatccgctagcctcggcctcccaaagtcctgggattacaggcgtgagccaccacgcccggccctatttttcataaatggtattatgtttatattttccattaatttctatatatctataagcatatacgcctattgtttttatgtgagtatttagttcagattgcatcatgctgtctacaacttcagttttcataccttggatgtctctttgtagtaactacataaatatttactaaactgtttttttacaactagacaatattattttatatatatatgtatgtcatgatagattaaacctgttctgtattggaaggatattggttacttttattttttcactcctacagatgatactgtaatgaatattcttatatataaatttataggataacttcttaaaggtagagtaactaggtctaagattaaatacactgaatttttatggaagggaccccatttccctcctaaaaggggaaaaaaaggtagtgccaatttatgttctcaaccatgcacaatattgcctatttaatctgtcggtatgatataaaatgagtgtcttactgtttcatttgcatttctttaagaatgaggttcagctcctttatacatattcatagttgacccttgaaagacacaggtttgaactgcttgggtttcactttatatacagattttttcaatataattgaccctcggtatattggtgggttccacatctgcaaccaaaagcagataaaaaatacaatatttggccaggcgtggtggttcacacctgtaatcccagcactttgggaggctgaggcaggaggatcgcctgagcccaggagtttgagactagccttggcaacatagtgagaccccatctctacaaagaatgaaaaaaaaatacatgtgttgacgtgcgcctaggctgaggtgggaggattgcttgagcctggtaggtccgtgattgctccatgatggtgccactgcactccagcctgggtgacagtgagactctgtctcaaaagaaaaggtgggggtggggaggaaaggaaatcattgaggagctaagctctgaggacgcagaggcataagaatgatataatggacttttgggactcggggaagggtaggaggggggtgagggataaaagactacacatgggttatcgtatacacagcttgggtgatggatgcgccagagtctcagaagtcaccactaaagaacttacccatgtagccaaacaccatctgtccctcaaaactagtgaaataatagtaaaataaaatctattaaaaaaaaaaaaaggaaatcacagtttttgcaggataccaaacctaagtacagggaaggctttttgtatccaccggttcctcagtgctgacagcggaacttcagtatgcctggatttgggtggggttgccgtgggggagtagtcctggaactaatttcctgcagataatagagatgactgtattggctagggtttcttttcctgtgaattggctgttcaggtccttttccatttttaaattgttttctctactgctttctgtgagctagctgtctctttctgtgagctagctgtcatattgcagtatagcagttgctttatgaaaggtgggttcaaagtaacaagagcacaggaggaggtcagcactagacccgagtcttgaaaggttgggtgagaaggagtctttaaggttttatgagctatgctaacaacttttgactcctaggtcaaagagccactttaaaggagaggaattacaattgtgttttaaaaattatggtaagctgggcatggtggtgtgcacatgtagtctcagctactggaaatgttaaggcaggaggatcgcttgagcccagaagttcgaatccagcctcggccacatagcaagtctcccatctctaagagaaaaaaaagaaaagaaaggaaaaattaggatcactttgtggaggactgcaaaggagctgctggaagcagggttaccagttccgcgatttcagtaaagcacagaagtcactggggcctaagcagaggcagtggtgataggagtaaaagggagtagaaggatgtttcacaggtggagtagatggggttttttatgactggatgtgttagtgagggaggaatgaaagagcattctgaacttaggcaactgggtgaaagctgatcccattaatgtcccataatctaggaaagagaagcatggaaggatgaggagagatgtgtttggattagctatgctgagtgtgaaaaacctttgggactcccagataaggatgtccaggaaacatttgaaagttctgtttcagagcacaagtgaatcaagatttggaaacattgggacatatagcatcagtggtagctcaagtcatgggagctacacatctgtttttttttcttttgagacaggatctcactctgtcacccaggctggagtgcagttacgtgatcatggctcactgcatcctcgacctcctgggctcaatccgcccacctcagcctcccaaataactgggactacagacgcacaccaccatgcccagctgaatttttatatttgttgtagggagggggtttcaccatgttgcccaggctggtcttgaacttacgggctcaagtgatctgtctacctcagccgcccaaagtgctgggattataggtgtgagccaccatgcccagctcacatctgcatataacagtgatgctcacacagatggctgttaaatcctagagtactttttgaatcctcaaaagactatgttcagcatactgcttatttgaaaaagttttatttagagattggttgtctgtaagggcagtagttcctagtctaacctttttgaaaatctgataaaagttgtagactttcttcatcagaaacatttgtctgtactcacagctcagttttaggtaagttgaagagcccctgaaaccatctattagtaacctacttaatgaagtagtgagagcagttttctgggtttttttcacacttgaaaagtgagggcagttttcctgtgatatgtaggctctgtcttaatattttagcccttaactttttttatttttctgagacacggagtcttgctctgttgcccaggctgcagtgcagtggtgtgatctcggctcactgcaacctccggcccctcggttcaagtgattctcctgcctcagccttccaagtagctgagatcacaggcgtgtactgccacacctggctaatttttatagtttagtagagatgggatttcatcatgttggccaggctgggctggtcttgaactcctgacctcaaatgatctgcctgcctcagcctcccaaagtgctgggattacaggcatgagccactgtgcctggccttagcccttaatcttaaggagatttctttgaaaaatgtgtagtctttaaatattcttggctgggccaggtgtgatagtgtgtgcctgtaatcccagctacttgggaggctgaggcacgaaaatcgcttaaacccaggaggtggagagcggagatcgtggcactgcactccagcctgggcgacagagtgagactctgtctcaaaaaaaataaatattcttgataaacatttactcattttctaggcatggtgatctcataatttggggggtgagagatcttttgaacagattttttttttccattttatgaaatgcttacagataagccccatgctttggtgaaaatcactttctagcccttcactttttttaactggaaaaaatgatttttatttctaacttattctacagtatacaaacataccaaaaaaaaacaatacgaaatcaatgaatgcaaaatcaatcaaaatcaatacaaaaacaattatacaagtaatttctaacttattctaaaatcttcctaatatgtaaagtaccccccagaaagtaagacaagacaataatagagggaaggtacatacatccagcctttcactggttgaggaaacttataaatgacacctcttaccaaatggaagtagaaaaacccaccacaaatgtattttctgttaaatagaccctactgagaatctaacaaacatatgggagatacagcttgtgtgcatagaattgttttagcattgaaatactgatttcctttattctgctgcttattccaggtaaatttatgaaattgaaaaattatgcaaactgcatgactgcatttgtaaatacaaaatcagcagtttttaagcgtttacttatgcatgtataaacttggttaagttatagaattgaagattttgcatggtgtcttcagcagtacaataaccaagtttaaatctcttacccaccctaattgcaaaacactttcattttaattggggttacctcttgaaggattatgttaaagattgtttttaaaacctagagctagataggaggcattcattattagatggtgttcacccatgtgtgtgtgtaacttagtggtaaagttgaaggtaaatactttttaacatgtcttttgaattcaatatacttataataggcaagcttaaaactttctcttttcttccagataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatgacctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgctttggttgtatagcttcctcatttacttcatggtcttacatagctggtgactttcagggctaatctgccctctaaagcattgtcccaggagaggaaaaggaaatgggacctcagaagtagaagcctcagggaaggagtaaagtagaaatcagaagaaaagaagcttcacttgatagtaataaggtttttaacttcaagtaccttcagaaaatgtgattttgataagaggaaagggcaaatttagaccttaaaaaatatggaagaactactgccttaaaagtgcatttgtagcacatcagcctagaactgtatcatggctgtgctggggagaagtaaatggtggtaatgtaacattgccacctttacttaatgatgtgttattttcgaggtacagtagatcaatatagtaataggcgagcctcatatatagcattcatcttgtacaatgatatccatacccttgatatgaaggaaaattgacttggtttgtgcatttgaatactgaaataattttttaaaactcagtgacacataccatctcttgccaagactagaccctgtattttagttcctaaattagatgtttaaatttaaaaacattttcagatgtacttaagtacttccatagtacttttttttttttttttttttttgccccctgagacggagtctctgtgtcacccaggctggagtgcagtggtgcgatctcggctcactgcaacttctgcctcttgggttcaagcagttctccctgtctcagcctcctgagtagcttggattacaggcgcccgtcaccgcacctgcctaatttttgcatttttagtagagacggggtttcgtcatttggccaggctggtcttgaactcctgaccacaggtgatacgcctgccttggcctcccaaagtgtgctgggattacaggcgtgagccactgtgcccggcccactgttcactttttgaatggcatcattttatagctgtagaactaaaatcaatgtttgccccaattttcttaagtaaaactctactttgagctcttacctccaacttagtaaaaagcagcttcacacacaaacaagattcttactggtggaatgttaggtttcgttgttaagttaatctgtctataagctcatccttagaggatatttgaggaggaagaacaccttgcagctgacttgcaaacatctaaataatttatttcgggtgcttatgaatgttactaatggattttgtatgaatttttatcccttttcatttatacaaaaacctgggcttttatgttaattatatcatctgaggttctaaggttttttttttagattttgaaatttagggataatagctcttaggtttgggtaccactttgctgcagtttaagaaagggggaagggaactcatttattaaacatcaatcacgtgctgtgttctgtttgttttctagtcatcatatcacacacctttacgacagctcactgaaggaaggtgatactgttcccattttgtagatggaatagacaaaacctgaatttaagtagcttgctcaaggttccatattgaatatggaaagttcaaatcatctcagtaatgaatataccatatatacttgctgtattgtatctatgataattcagttacccacaatacccttttaaatttctgttaatgacatacctttaaatgtctccttgatgaacagaatcatggtctttaaaaacattttcatgggttgattgcattttcaagctctaaaggattgaaagataaatcttcacgttaaaggtaagagtgaagtatctgctcttgggttacagaaccagatagtactagaactaagattacagggtaaagctgcttttatcttttttctttttctttttctttttttttttgacatggggtctcactgtattgcccaggctggaatgcagtggcatgatctcagctcacggcagcctctgcctcttgggctcaagcgattctcctgcttcagctttccaag

SEQ ID NO: 14138 - DNA, 121068 bp, Human
agcccctgtgcgggatccactaggtgaagccagttgggcttctgagtctagtggggacctggagagtctttatgtctagctcagggattgtaaatacaccaatcagcaccctgtgtttagctcaaggtttgtgagtgcaccaatggacactgtgtatctagctgctctggtggggccttggagaacctttatgtctagctcagggattgtaaacacaccaatcggcactctgtatctagctcagggattgtaaatacacccaatcggcactctgtatgtagctcaaggtttgtaaacacaccaatcagcaccctgtgtttagctcaaggtttgtgaatgcaccaatcgacactgtgtatctagctgctctggtggggccttggagaacctgtgtgtccaaactctgtatctaactaatgtgatggggaggtggagaacctttgtatcaagctcagggattgtaaacgcaccaatcagtgccctgacaaaacaggccactgggctctaccaatcagcaggatgtgggtggggctagataagagaataaaagcaggctgctggagccagcattggcaacccgctcgggtccctttccgcagtgtgggtgctttgttcttttgctctttgcaataaatcttgctactgctcactctgggtccacgctgcttttatgagctgtaacactcaccacgaagatctgcagtttcactcctgagcccagccagaccacgagcccactgggaggaacaaacaactccagatgcgcggccttaagagctgtaacactcaccgcgaaggtctgcagcttcactcctgagccagcgatactaccaacccaccaaaaggaagaaactccaaacacatccaaacatcagaagggacagaatccagacgcgccaccttaagagctgtaacactcaccgctagggtccgcggcttcattcttgaagtcagtgagaccgagaacccaccaattccggacacaataatatgggttttagaggaagacttgggttcaaaccttacttggtagctttgtaatattaacaagttgttaaatttcttggtaacattgtggtgaaattactgtagaatgcaagggggaagggtgcagtgattcaaacctgtaatcccagcactttgggaggacaaggcagaacaatcacctgagaccaggagttggagaccagcctcacaacatagtaagacttcatatctcacacatacacgcgcacacacacacacacacacacgctggtatgatgcctcatttgtagtcccacctattcagaaggctgaggcaaaaggataacttaagcccagaagtttgaggttagagtgaactatgattgtcattgcactccagcttggacaacagagcaagaacttgtctctaaaaaataaacaaatacaaaataagaatacaatggtatgatttatataaagaagttatcactgtgtctgtatcaagtgtgccataaatgagagttaccttcatcattatttattatttattaaatgttaagtgtcaggacctgggttaggtgctgataattcaaaagtatataagacatagatattccctcagggcacttaacagtgctcaagctaatattcaaggtaattggacctaagaaaatattatatgaggctttctcatccacatgcttctcaaactggcccacaaacatgagataaatagcactattttaaatgacccaatgaaggggtttttaaaacttaatatagcaagcagtctctaagatcttttccaatgataaagtggaaagttcctggttgagaaatcatgacaaaccctcttaccagcacagctgtcaacaattccttttatggtgaatgagtcactgctttagttgatactttgtttcatattagtgcatttctttgcagaggttacctctttttcttgtctctcgtcaggtctctgacattgacagagcctggacgttggaggaagccccaggacgttggaggggtaaagtaaaagtccacagttaccgtgagagaaaaaagagggagaaagcagtgcagccaaactcggaagaaaagagaggaggaaaaggactcgactttcacattggaacaaccttctttccagtgctaaaggatctctgatctgggtaagactggggcaggggtgggaaaatatttaccagggttcatcagttttatctaaattgaccattcccacaacaggccgcagctgagcctgctgtgggacacaagtccacatactatcctggccctatcaagtggctgcaggttccttagtgctctctgctcctgctgtgaactagtctccagcatagagagatgggaatgtttctaaattgttatttctttcttgacactatcttaaattaactttatcattattagtatctgcttaataaagttagggctccatcacattcattattgccacttgtagagctctaggtaaatgaaggtaggcaacttgggatctgcaaagagagggaacacgttattataattagggagcttatacagtctttgtgcagctacttttctgagtcagtcattgattgattcccattttaaggtggtttacatcatgctatacaatgaaacagaagtcttgccagaagtgtctgtgagccattgttgtaagagaaaatgggtcctgaccacagaaaaatagtttttttgccattgtcccctgaagggatgggaaacagataattagatataagccttcatcagagcaagtcagaagtaatcgactccatattataaacaaagcactctttattatagaagaaggaaagctgtaatgcttacagtctatgattgtttgttaaagaagttataaatgttatatcatgatcattttaagttacagggattgagacattcaaggcaaaaacacaaattaagatgttactacaggaaggcttcttgctcattttaaatttacaaaattatcaaattatcaaggcctggttaaacaggatatgcctacaattgtgtatatactgctctccatgaagcagaagtcagaaaaaaacaagccctggttcatcagagaatgtttcctgatgctggcttcattacctgaaataactgaaagcaatatgcaaactgatatacatgcaggtgataaagaatcagtcttaaaacacagagaggttaaaatctggtaacataattgagtaaaaaatcagcagattttctacatgtcagatttgagataccaagcttgagtgaataacaggtgaatgctgattcacagcaaatattaagaacaagtgatgtcctgtggtagctcaaagggcttcctgcatagtgataggaagaagccactgggtaacctgagtcccacagtctgaccagaccctgtccgtagaggggcttggaagaaatcaggaccaaggctgggttagaatggtatctatgtttcaaagtatggagatatgtatgacacaagattccccaggtaaaagttcctattactgtgtacatgagcttagtgagctcagctttgctcagtccaaatatctaaacgtgaatgtgaaaagtttccaaagaaaattttgtaattaagtcagaaaatgtgacatatctagaaaaaaaatccattttctgaacagtgagatacaagatgatctggtgggaattcaacctgatacatccttctggagaggaacttggcaatatccaacaaaataaaatgctcttaccttttgacctggcaatctcacttataggatgctatcctaaagttactcctatagcaatataaaaataaacactcacaaggttagcagaggttttcattgcagcattgtttgtaattgctaaatattagaaacaatctaaaagtctatacataaaagaacggttgaataaactgtgctatgtccacataaatggagtagatgcctgtcaaaagaattgagaaatcttcctacgaactgatagggaaagactcccatatttctaagtgatgtgatctttttgttggaaaatgtgaataagaaaatatacatgtatatgctcattaatgaaaaaaagtccaagaaaggtaaactagaaactaacaagattggatatctatggaggataagtgggcatgaagtggaaagaatggaaagacagatggaatgggaatgcagtgccaagatgaagggaaagtgacacttctctgactacagcttgttgtaaagctctgactttcagaactctgatatttcgcatactcaaaaataaatgcatacttaaaatcaaccaacaaatgaacctaactatattacaaataaatgatttaactacaccaaagagaatggagaaggaaatagtagtctaagcaactttggaatacagtgttttgactgtatgtgtaagaccaaagacaagaacttttaactaatagtgcactctagttagcaaatttatctttcaaacacttatgagttagtaactttaaaacaaattatatgtactagaattgagcaaataactaaatttattatgtataatgacacactcagagaaaaggttttaaaaacaaggggaaaacatgaataagttttgttttgttgaattggaattagaaatatcagaagaaacttaagcttatatatagaaacagatagacgagaaataaatgtagatgtgtgtattcatgtgctggtatataaacatagatttcttaactttccacctgagagggcctagaagtaatgactacacctagtgtgataatcttgttgtctatctaccattatccaatgaaagcaaccagagcccttgggagaaatggtcgattctaaggctgaagcagaaaaaatattagataagcctggcatatattgtaatgtcagaaggaaagacgcactgaaaatatgatggaagcacgtccatagtacctgggctacagcttgaaggagctctcagtgaactaatctgggacgagttgagcaatgagataaatagtgatagtaaagtgttacccatatgataaatctacactgatctactatagatctacactgatacaactaaatgattaaataagtaaataaaataaatagaggagaaagggcagttcttgctcacattagaactctaataaatgtagaaggaatgaaaatagaaaattacttttagtcaaacatcacagtaagttataagcaagaattatcaacagatgctaaaaatagtgactgaaaaaattatggaagtatgatgaatctttatttgcatagtcttcaaactgtctcttcaaatggtactttttagtgacaaaatggtacataacactttgtggtagagaaacctggcagagaacaccttaaccaagtgatcaaagttaaggtcacagcaccagaaaaagtcatgtcaacatcatgaatcccttaatacaagacactgaaaatggcagaacatcactttggtgacatttgcaaaaaaaaatgtataacttcaatctaataataaggaaacatcaaaaaacccaaattgagggatattctacaaaatcatagccagtcaacttctaaaatgtcaaagacatgaaagacaaggaaagaataaggaactatcaaagatgcaaggaaaatacagaaacataatgactaaatgcaatgaggaatcctggattgggtcatggagcagaaggacattagtgggaaactggtgaaatgtgaataaggagtgtaaattagttatcactctaccaatgttaaaatccttgttctatggttatggaaaattttaactttaggggaaatgatatatgggaactttccatacccattgtacatcttttctgtaagtgtatttcaaaataaagttatttttaaagaaagccagtgacccaatttgtaagacagccttaaagagaaaccaggctttaaaaaacgtatatgaaaaaatgttcaagcatagaaaacaaaaatttaacccatattgtaaagttcagcatagctaactacctaaaaactgctttccatttcatctttttccttgcacacaagggaacaacaccctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggtgagtgacaccagcaaagctctaagccccttctgtccgtacacacggcgaacatccagcttagggatgtgagcatagaaagagatgagaatgaatgttgaaagctaactttcagtccattaatgggctctttacattgactttggaggattacagtcaactgactcttcccactttacttttattttatactaagggtataaatgtgcctttctggaaggaacacaatgttaataaagaaaattaacttctataataatgacttataaaacatttattaaaatgttcatgtagtgacagcaagctttcaatgaactttaagaaaaatatgaatgtttcagtgtgtattaaatatctaattttcctgtttccaggattgtaattaagatttatgccagttgtattttcttttatctcttttaacttcaattatgttaacttttatctcaatttccagaaacacctactaagtaatttcttttcccttttatcctctccttctacaggcttctctctaggctccacagtgaagtctcacaccaagggaatctggatgtggtgtgtgcctcatcccaagaagccagaacacaccctagttctgctcgacactgagggcctgggagatatagagaaggtaaaaaaaataagtattttaaaaatttcacttaggtagattaaaatctacataaaccaggtcagatcgataaccatctttgcacaatcactcctactccttgatttagggctctagttaattatattaatatattatttcttaaaatttgtgtggtataagcattcagagtacacaataagttcaattgattaattatgggtaaacctatgaaataatggctaatgatgttttcagttatttctctttcatattatagtaaaatgttttggtgaggctgctgaaggtgcttataaacttcagtagacgttttacaaacatgtctgactttttacagtgggatcccacaaaggtagtaaaaatgttcacatccacaccagcaccagtagaaagagaagcaaagtgtaaaatctaatgataacatctttgctcattaaggataatatattactactgttataaatcttagacatagaaagcttttattaaaggagcttattttaactactgtgtaaaaaatgtcttactatgatgtgccatggaaatggaatagggtcataaactaagtttagggtaccagtttgaattttagtagctgatcaaaatagcttctcctaccaagtgctcatgtgtttcctgctgacatatatttatatataacaccttaaattatacatcataaatattataaatttgttctacaggtagaaaaaaatactgcataaggaagtgagttacctaagttttcagaactaatgagagacagagttggagttcagtcagtcttcagctatctgaattgattgtacattctgctagtcattcttctttgtggcttctacaatgacttacagggtgacaatgagaatgactcctggatctttgccttggccatcctcctgagcagcaccttcgtgtacaatagcatgggaaccatcaaccagcaggccatggaccaacttcagtatccttttttgtggtccagaacagcagtaaacctagaaaataacagcttcattttttcaccaagtacagaggcagacagacaggtactgaagaattcataagtcctctctttaataaatctcattatgctgaacatctcattctatctcaatctccatctgaacttcaagtcttcccagttacatgtctcgttagatactcagccacccaagactctgtatatcctctatctgacttaatctcctatgcctgtccaaaccttcaatgtcctctagaactcatgttctcacttctgcaactctctatattcttatcatctgctctaagtgttgccttctaaatgatacctagctatacactatagatactatttctcctacagacctctccagtggtcttatgtgatgactatttttaatcccataccttgcatatcataagtgtaagagatgagttaggtatcctccttgctccatattagagttctggacactttctcattcctttaccattaaaaagagaatcttctttaatatatatgccctcagactacaacactatttttgttgcaattatctagcaacgttccaataaatacatccttcattcattaaagattttagttcctagtgtctttttagagactagcaaccaatagacaattatttaacaccctggtgtctcagttccatcaccttattggaactctccacccttattgtcattctccactctcacacattacttaacctagttcattatcaatgacctcaccatttccattagcttagtttcaagcattatactgaattagatttcatcaagatcacccccatattcctatatgtaatgcacagttctcacctcatttgatcttccaatcttccataagccttttatttctctaggagcattacataaatttgatcccttccacctttctgaaatgcctgtttcacttggaattggttcctattagaataccacatttcctaattttccaccttccttattggtagactttttcagattactctatcctctttctccttttagcctctaaatattataacacttaagttcttgtgcctcttttctttttctgctttcagtccccagatgatcacatccagcttcaaggctttcagtagcaccaatatgtttatcaccatcaaatctgtattcccaagcatgagcaaattcaaacttttgtatccagcttctggtgcaacatctccattcagatgtgtaagagacatcttgagcctaaagtgtacagaacaaaacttaatttccctgtccaaaacaactccttcccagtctttctaatcacaataaattcccacatcattcatagaagtgctcagatcaaaaacttaggaatcatcttggatgattccattccttatgttttggaaattattaatcatcaaactccttcagctccactatcaaagttatttctctagactagccaattctcactacttgctccattgcctctcatcttggttatcttttcaactacctaattgctttttgtattagttttgtttgtttgtttgttttggcatacacacttgactcacagatgcaatgccagccagtatgatttaaaaaacaaaaaacgatactatatcctctcttcacttaatacccaccaatgacttcccattaactttctattaaatttcaaacttcttactttggtttacagagcttgcatatcccaacctctatttattttaaggcttctgccctaccacactggatttcttgatatatgttgtgcacactcagtaatttcctatctaagggccttgaagggtctgtgatctctgtctgcaatgttcctccattggatttgtacatgactggtttcttcaattcattcagatcactgctcaactacaatgtcagagataatttacctggaaaactacatgaaccagcaccacatgcagatacacacaattattctctgctttccttattggtagatttgggagacaccagagtattagatgaatgtctattggttgctagtttctaaaaatacattaggagctagttgcccagttcgttttccttcaagacaattgttatcaatacctgataatttatttttgtttacctgttcattgtttgtctccatcattagaatgtaagctctatagtggtagcattgtctcattcattacagcgttcttagtccctagggcagtgcttggttcatagtaggtgctcaataaatgtttgtgagtgaatgaattctgtaaataaatgtttgtgaatgaatgaatgagctaataaaaggaaaccaaattattttaggtaagcattaggataaaatgtagtataaagagtggcattttctgtagttttcttaatttagcatctcagctatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggttactgggtctgatgcttggttgggtaataaatagagagcaaataatatcaaaataaccatttctgtgcagtgctaaaaattataatttttaactgtatttttctgactgttctgctagaggaaatggaaacattgcttgactatatcagttggaaccaattttaaattgcattacctacctcttcttggagactttcctttctctacccctttaattttttatttcttcttcctaataaatttcctccttacatgggctttgtgaaaattataaaattgaaagatcatatttgaagtaattaatttgaagttttactacttctaattttcattcctgtaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattgcagtcaatgggcctcgtgagtcactctctctacccacttcctacctggactttctccttctgcccattgtagaggataaaatggaaagcataagggtcacttctgacaaatgcatagtctattgatggcaaggaaaatacaacatgaaaatcatattataaattttacatgaaaactaaagctatagtatcatctcatattccttgcaaggagaaaaaaaaaagaaaagaactagaattgaattctattatggtaaacttctccaccaacttctcagctccctctttatcaaataaacatccaggatatatatactgagcaacaaagaaaaaagcaaatactatatgtaagtgagactttgccactaactaactgcagtacaattctcttgttcagcaattctaaaatatttagggaatgcctataatgtaatgtaccaaccactgagtataatgatggataaaagaaatgtgacttttatcctcattccagcataataggagcaaaagatacttctgtaaaaagtaaaaaaaaaaaaagtataatgataaatagtggttaacacaatgcataaaaataataggctgctatgaaagagtaaagggagaggcagggagatataatttagagtgtgagagaatgcttgtctgtgaaagtcacctgtaagatgagaacttaaaaatgattgagttggctgggcacggtggctaatgcctataatcccagaactttggggggctgaggtgggtgaatcactttgagctcaggagtttgagaccagcctgggcaacatggggaaacccttcctctactaaaaacacaaaaattaatcaggcatggtggctaacacctgtaatcccagctactcagctggctgagtctgaaggatcacttgagcctgggaggcagaggttgcagtgagcggagactgcaccaccgcactccagcctgggagacagagtgagaccctgtctccaatatatatatatatattaaataaatggttaagagctaaccaaagcatatagaggaatagctttttagcaaataatgtaatgtggaaatgcatagggcaggatagaactttgcaacttcaagaaaatagaacacaggaggctaatgcctgtaatcccagcattttgggaggccaaggtgggagaattccttgagcccaggagtttaagtttaagaccagcctgggaaaagtagcaagacctcatcattatgaaaaagttaaaaatcagccaagtgcagtggtgcttgcccagagtcctagctactcaggaggctgaggcaggaggacccagcatgagcacaggagttcaaggctatggtgagctatgatcatgccctgcacttcagcttgggtgacagaccagaattccatctcaattttttaaacgaaaatagaagaaagacaggcgattggaacaagagaagactgaataagagtggtgtcataattggaggggtataaaggggtcaggtcttgaaaggactggcagaggactttgaggagattagagtttgtctaagctctagagaagatcttgaagaatttttggcagtgaggtaaggttatctaatttatgtttatacatatctttctgaatattttgtagataatttgttggagtagtgaaagggagggaatgagaggatggatgctatttgcagtggttgagccataaatgggcattgggttagtctcagattatgacagtgaaaatggtgaaaatggacaagatccgaacatactttggatattaaatctaaaaggcctgttgatagagggaatatggatttatgaagggaataagaaggaaatgccaagcctgtctccagcgtttcgagtttagcaattgcttgaatggctgtgttatttaatgagatagtagcatcaagaggagaaatagtttttcagagtggatgaagttttgatatttagattatttaatattgagattcttctgatttatgcagtaaggaatatacgataggcattaaaaataaggtgcaaaacttatttttaatccaaagcttaaaagaaatgtcaaagcaggaaacaaaatacaccagccatccatacagatggtacttaaaaccgcagagagatgagaaggtccaggattgagtcaaaaagaatcatcttttgttgtgtgatcaaccactccagtttgcctaagatgaggttttcctggcatgtgagactttcagtgctacacccagcaaagccctggcaaactcgatgagttgattatcctatctgtagttctgatgagagaatatctaagaagacatatttacctaagccagacaccagactagtgactagtggtctgcaccactaaaattaataaaaataaaaaggctaagttttctcattgacttttttcataaattagtagtgaagagagaaagggaatagagggagaggtgagagaaaagaaaggtaagaaaacacattgacctagtatctcagccccaaaatatcctaacctattcatttcaatatcttccttttgggtgaaggaaataggaaagagccacttcaatttcctctgtgattagaggttaacaaattattccattactattctttatccaaaacttatttaaaagtattatttgtgacactcacttgaaaagcacacaaaatattctgtcccaccaactgatagtcacatttttttaaaaattcccttttgcaggtctagagagcctggtgctgacctacgtcaatgccatcggcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggtatatttggtgttctacgtcatgagaggcagaaaaatatgggcccttcatgggaaaataattctttctagaccccaaaatagttacactcagttatgtgtacatatttgaaataatcattaaaagactagaatgtgcatagccttagacctttaaaaaaagacacctaattttttactaaaatttgcttttgttagtttttcctctctgggtcccatattttaagaaagtaagtagatggtacaactgcattgttaaagactattttaacttattttgtccttttaaattaaaaaatacattgtttttatgttccctggtaattatcagtggggactaaattatttttaaataaccctaataatttttttaaatgtgagccaatggtaaaatattcagaaggccaagaaagagaaattaattatataaattttattagagaatgtttttaatgtctgcctcattccaagtgaacaaagtatttttgcatgcagaatgaccacttgacaaatgaaagtcctttccctagctaggaaggcaggatcttataaatgatacgttgctacagtcagaggttctggtgaagctagatagccgatgtcagcaattgtcacccttccaacctaaggaggaaagagaaagcttcatagttaagttatcttgagtgatttaatgtagataaatgtgctgttctatgagactttccaaatactgaaaatacctatggcacaatcttcattactttcattagccctatgctgagaaaatacacaaaaatattcttatgttaaagaatgtactaaataatcatgtactccttactgagcacttctaaaaagtccccgggcttaatactttacatcacctcatataaccctgcagagaaatctatgagataggtattgttcctctgctgcacagacaaggaatcctcagttcacaaagactgagtgtcacaagccacagtgtagtgtatccgggaactccaggcaggctgcctgactccagtgtttgtgctcagaactattcctgaaatgagagacttggaaagataaaagtttcgtatgaaatagtgtatgtgctttgagaatcattctctgaaacaggaaaactgggagaaaggagctttaggaaatcacaaacagagaagtagataaatttctgcaataagcacaacttagggatattctaggatctaacagcaatgtgaggagcatggccctatttagagggccacaatttctgaaggagaagcattttccagtctccacatagttaacatcctcctcatggctttactgaaacatctgtgctgttttgtcacttcacaggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggtaaactacacggtgggtaccatttcttgggactcgctgaggggatgcttttaaagcccactgggaagaaggtaaatggcactgcaactggtgcctagggcctctgcctttcatttttccatttactgattcattcaataagagagcccaccataacaggaattcctcctcagaagcacagatgtagccctcaaaaagaggtttatcgaattgactcatttatttattcatctagtcattcaacaattatttattttgacctaactgtataccaggaacttgtcaagttgctggggatacggcagttaaaaaaaaaagttcaagctctgtcaaagtacacacaggcaattagcaaatgatagcttatgaacaaataataataacagttaacatttatgttgcacttactgtgttccaggaactgggctgagagcgttattcatttaatactcagagcaattctataaaatatgtattactaatatccgaaatttgtaatttttttatttttttacttttgtgggtacatatggtacatagtaggtgtatatacttatggggtacatgagatgttttgatataagtatgaaatgcacaataatcacatcattgaaaatggggtatttgtcgactcaggtatttatcctttgtgttacaaacaatccaattacacttttttagttatcttaaagtgtacaattaaattattattgactatagtcacccttttgtgccatcaagttttatgctctcaagtatgttgtgctatacttgattttattcattctttctagttgtttttacctattaaaccatccccacctccctccccccaccaccccattacccctctcagcctctgacaaccatccttctactctctatcttcatgaattcaattgttttgattttcaaatcccacaaataagtgagaacatgcaatggttttctttctgtgcctggcttatttcatttagcatgatgacctcaagttccacgttcttgcaaataacagatcttatttttgtttatcagttctaatagtttttttggtgtggaatctttagatttttccaaatataagatcataccatctgcaataaaggagagtttgtcttcttcatttccaacttggatgccctttatttctttctctttactgattgctctcgctagtatttccaatagtatggcaaataacagtggtaaatgtaggcatatttgttgtattccagatgttagaggaaagtatttttgttgttcttcccattcagtatgataatagctgtgagtctgtcatacatggattttattatgttggggtatgttccacctatacccagtttttttaatgttttattaatgaagggatattgaattttatcaaatgttttttcagcttgaattgaaatgatcatatggtttttgtccattctgttgatagaatttatcacattgattgatttgcatatgttgagccgtccttgcatcccagggatgaatcccacttggtcatgatgagtgatccttttaatgtattgttgaatttggtttgctagtactttattgaggacttttgcatcaattttcattagagatattgtagagtttttaaaattatttcatttcatataggttttggggggaacaggtggtgtttggttacatgaataagttctttagtggtgatttctgagattttggtgtacaccgtacccagtgtgtagtcttttatcccttgccccccctcctttcccacaagtcctcaaagtccactgtatcattcttatgcctttgtggcctcatataatagcttatctccaatttatgtgtgagaacataggatgtttggttttccattcctgagttacttcacttagaataatagtctgcagttccatccaggttgctatggatgccattgtctttttcctttttatggctgagtagtattccatggtgtgtgtgggggggtattatatgttttacatatatatgaaacaattttttatccactcattaattgatgggcatttgggctcattccatatttttacaattgcgaattgtgctgctataaacatgcgtatgcaagtatcttttttgtgtaatgacttattttcctctgggtagatacccagtggtgggattgctggatctaacccacaatcactctttcttcattctacctttctctgtataaccaggccaaagaggtgctgaaaaaatatttggagtccaaggaggatgtggctgatgcacttctacagactgatcagtcactctcagaaaaggaaaaagcgattgaaggtgagaacagctgaaaacactctacatggtcggaaagctctcaaaatgttagttagcaatattggtccacctggaattattattgtagagaaagaatggcaagtatcattcatagttctatgagagttttcttaactaatctgtatgatcattggttttctggttacccgaggcaaaattacaagaagttttctcaatgatgtaaggataagacaaacaaaaacgagggaaaggaaaagggaacacctacaattgaatattcatatctttttctgcttatttttcttccacagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggtattcaattgcatcatctcaattttctcttccagtgccccatatcgaaaatgaagtataaggttgagaacctaatgcctcccaaaaaaactttctagcccagacactactacatttttccttccctaactatttttatgccagtcatctctggttagtaaagactgtttacttgcaggatacaatcacatggaattctttattatgctatcactaataaacattgctaggcactgcacaagtattttacattatgtgatcaaattttcctctaatggtagaggaactattagtttctcatttgctaaatgaagtaattataatctcatgagcagtaagtaacttttctgcatcagactacctagagaaatatctagccagtctttcctactgagagggatccatggggattttgtttctgttatgcctgctaagactttatgtctggaagcactgttatgagtagaaagattccctaaccaggccaggtgcagtggctcacacctgtaatcctagcactttgggaggccgacgggggcagatcacctcaggtcgggagttcaagactagcctgaccaacatggagaaaccccgtctctatcaaaaatacaaaattagctgggcatagtgacgcatgcctgtaatcccagctatgcaggaggctgaggcaggagaatcgcttgaacctgggaggcgggggttgcagtgagccaagatggcgccattgcactccagcctgggcaacaagagccaaattccatctcaaaaaaaaaaaaaagaaagaaagattccctaaccatctacccacttaagcacactggttaagtgcccatggtgccaatactttcttgttctctgggctcttttccacatttacgtttgcccagaaatagcctatgggccactgtaagccctgatctcctcaatttatttctgttacctccgaattttggagacctgtactaaattccctgatcaaacacttgccctagtcttgagttatatagtaacctaccaattggaaatcatctatctttcataccttcctagatatatatttaagagtccattctatatagatcagaaatgaacaacaacaacaaaaagaacaagagaaagttatggtttttccagaaagactgtgttgcatgagtgcaaatggtgaagggaccaaggaataaaacgctgggtcactaatattttagaaactgtagaacaacaacatttttgaagctaaaaaaatcatagaaaaattattggcaggtataggagactcagaagagagtgatagtcaaaaattcttgaaggatcaatataagtaccaaaaggggaactaatttggtggaaatgtgttaagctggataggcttagtctccactttcccttttaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatcatgatgcatgcatttttgttgaaccataaagtttgcaaagtaaaggttaagtatgaggtcaatgttttacctacagagcaattcaactcatgcttatttatagtactaacttttaatatgatctttaactaaatcctatatttgaaatcatacacaaggactcaagagagatattgtgtaactaggatgcattttccaatgagatatcttgcagtttctgttctgggtagatttttttctctcatatgcaccacccttactgtatattcagtcctatactcttattcagggatttaactatggtcgtagcatagggctgaagtgttgtgaatatgatgaaaatgtgatgagaccaaacaaaccatggggcacagtagagcatcactcctgccaagtggtctttgtatggcatgctggctgcaaataaaggagatctgggacacttaactaggcttttaaagtacagacagtgcacagttctcatttggatggaggctgcatgatctgtgggcactagcagagaaagtggttgcctctgtgcagaatgcatttatgagtagaggctccaccttctctgtccatgtaaaccctctaggtaattactgccccattcccaggccacctagatctctcttctctagtctcccttagtcttttctctttcctgaagtttagaaaataacttctacaatcacagaaaggaaagctttaactcaaactcaaattactttccattcttctgaggaccaggactataatcctataaagcctaaaacttgactgcatttttctctctgctcctctgctatgacattatatcctcaaagctactcagggtaaatgacttactaaaaaaaaaaaaatgacagattgaaaaatcaagaataattcattaatacaaaacattatcctactacaattgtttcaggatgtgtattattcagagttcttcatggcaaataagaatctgctcagcaatttaagtaaaaagtaatttactttttaataccattaggttgcacaccgatgctccagaattgtgagggagccatactctacagctattccaccgaggataatactaccattgtaaaggcatctcacgggaaaacaacacagctaccatgaaccagcaccatgatctctggatgaaatgctggaagcttctgcagtgtcagctatgagtaaatggatgccaccaccttcacattttcagtaaacaaatactcccctaccccatgaaaagttgcatctttgagctgctcacatctccagctaagcctcacaaaagtcaatctgcagggaagaatctaaatcatatgcctacccatgggaaagtctgagaattagagtatttttgtcttctacttttggaggaagaaactaataacgtgggaaattttcctgtatgtttagtcaaccagtttttccatgcagatgtatggagataaatcttatagtaggaataacctaagacttgagttagtatttttgtgtacatcagatacaacactcttctcatcttttttgtcattatttttcaatgttgttttaatctttccactgttgtttcatgtcatgcactttgttaatattctttaagttattcttagtttttaacaatgatacttaagaaagacttaataggactatagaataggtactccctattccccaaccctgggaacacaatataacatattagttcatttgtatttaagatctatcttgtttacgcctcagtttagttattgctcttacctttcaaacagttaatattttgtatctagttctgtgaaagcaaaaagcaactttattctttcttacaattccccttttacttaatcggaacatttctttcctgtttgttcattagtcactctcagataaatgaatagtctctttttctaaaaaaaaaaaataacatttgacctaaatttttaaatgtctgagttttgatttaaagttcctccccttgtatcttgctccccctcagattccactcagtcacacagcccaggcctgattcagccttacaggcacacagtgagaaaggtgtacgactttttattttcatttccagctctccctcccactgggtacactagctcatgttgatgataccttcaagttgttaacactagagtgcagggaattaaggaaaagaaaccttacatgatacataactgatctggtgttggcaccttctggtggtggcttaagtccttaaggatgatttgggttctttgctgatcccccttgccaggacctcccaatagcacgtccctattgtagtccacttctgattcctttcctcaaattctctcttctagagatccactcattcaatatattcttggtgttgagatcaatgcctcttgacatgttgacatcttgtgcaggatttccttcaatatgacccaagtccagaacaccccagtgattatacccatgagaaaaactcatgcgcaccagtttagccatacaccgtaggaacaggattcccccaactctcttttctttcctattttgccacaaaccattccatcccagactatcacttttagatgtttttaggcataagttgggcaccagtactagtgtccccaaaccccaaagagcacatatcagcttttcaagaggatcttttaagtgcccaatgctacttagtttgtaaagatagtaagaaagaagcacctctcattgccctatggggaaaatgagcagagataaagagagggtggatatcaatgcacaccaataagtctctcaaaagagttctccattgctaatctattctgatcagtctctttaactcatcttatatgccccagatgcaacttggtgtaagacttacacaatctctcagtactattattttagaaaatgaataatcaaacattcataattggaggggaaaggtagagatacacatacttagttccagattgttctagtccactttctttcctagcctactttgaagaacaaggagcagttattaaacataatttaaccttctttttttcaacaaagtgagttatcatttgaaccaagtgccagaaccttgtggcattatgaactgtcataaaatgtggttaaaagtcttagtagtctgcgcagtgcattctggggaccgaggtcgagccagccactgctgccgtcgcctgagggaagcgagaagaggccgcgaccgggaagaaaacgctgagtcgccactggagagaagtggactccatagcagcagaccccgccagagaggcccgcccacccgttcgcccctccccctgccccgttcacaatgcagcctgcttctgcaaagtggtacgatcaaaggcactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatacaaacgattccaagcataaaagaacggacagatcaattttatgttgtttacgaaaaggagaatctggacagtcatggccaaggttaacaaaagaaagggcaaagcttaattggcttagtgttgacttcaataattggaaagactgggaagatgattcagatgaagacatgtctaattttgatcgtttctctgagatgatgaataacatgggtggtgatgaggatgtagatttaccagaagtagatggagcagatgatgattcacaagacagtgatgatgaaaaaatgccagatctggagtaaggaatattgtcatcacctgggttttgagaaagaaaaataacttctctgcaagatttcatgattgagagaattcctgagttgatctaaaagcagatgctgtagctgcctactttaacccatttttcaacctgtttgttttttaaagggcttcactaagggttgatatgtaccattgtagggggcaattttaagtcagctaaggcaataaccttatgcatgaacatttcccagactttcatgaagctgttgaggtcctaggcaattaatgcggcagttgtgataaataaaaacatctcacctaagtctccttttcttcataatatagatactgacatgatgataggaagctctcagcttagggaaagagagctaaattttagattatagaacatggattcaaaagtggctgaacaaattggctgacaccttactggtaacctgctattcctctggtgttatccttcaggattgttccactaaaatttatttttcaaaaaatttacttcacattattctatgtaagtgatcacttgtcagtgttccaggtgtatattagctaaaattagagaatgccctaacttagatggtttttgaagcctgtacatttggtattgtttgacccttaagcttttacatctcttagcatggaagacgaagaaagctgtacattgttgcttgagagtctgtacatttagtccagatttgtatttgcattgtcagtatggcaaatgagtgaaaaatgtttaatacactattgtatttttttttttttgagagtctctctctgtcacccaggctggagtgcagtggccctatctctgctcactgcaagctccacatcccaggttcacaccattctcctgcctcagcctcccgagtagctgggactacaggcgcccgccaccacgcccggctaattttttgtattttttagtagagatggggtttcaccgtgttagccaggatggtctcgatctcctgacctcgtgatctgcccccctcagcctcccaaagtgctgggattacaggcatgagccaccgcgcccggccggattttttctttttttgattcagcttataccagggctgaaaacctcaatttatgttcatgacagtggggatttttttaaatgcctacattctttctaataaactgttggaagactttaaaaaaaaagtcttagtagtatatttgctgtaaaatgaggatgataacttacatcaacaagcttgtactgaggaataaattaaatttcataaataatacctataaagaatttaacacaatatctactgtataataggcactaaatgtaatatatatatatataatatatatatatatatttttttttttttaggcagagtctcactctgtcacccaggctggagtgtagtgacgcaatctcagctcactgcaatttctgcctcccgggttgaagcaattctcttgcctccacctcccaagtggctgggatgataggcacacatcaccatgcccagataatttttgtatttttagtacagacgggtttcgccatgttggccagcctggtctggaactcctgacctcaagtgatctgcctgcctcagcctcccaaagcactgggattataggcgtgagccactgcacccagcctgaatgcaatatactttttattataacactaacccagggttcaatgctgcaatgaaacttatgtattataaggtgaaagtatgatttaaaaattactacatgaaaatataattcatctcagtaatatttaaaaacttatgaaaatagcatgccattttccacctctcaatttagttaatattaaaaagccttattccacctgtttcggggggtggtgaagggatggaggcaaatttattaatacatctcaaaagcctttaataagaacatcatctctgaccttcatgctccactcccagtttcattcttttaatcaaaatacatatggaaggctacatccttaatttggtgctaggtactcatcagtatataagacatgtcctttccctcacttgctgcatctctaagtgactaacctgttccaatatgagtatgtcaaatatttgaggaagttagacttaaaaacaatatgattcctcctcattcttggcttttcaaaatgtcacccaaacctgaagtaagtgagattatatttcacatgatatgatggacttttaaaaacaacaacaaatggttatctaagatttcttccaaaaataaaatttgaagatgttaatgcaactactagcacagctcccagaaaattctttatagttttaatccactgctttgcactcaggactttcagatttagtttgtctagtctattgcagaagtttcttgttatctttccttctaattgtctgttctcagaaggtaacttggaaagctccaggacattataggggtgaaataaaaacacaaagatccagccagatataaggtcaagatccttatctggaatatgtatcaaatataatggagaaggcaaaattgcatcttgagcagacacaacttgattatgaatagaagtgttctctgcaaccttaaaaaatagtccctttgaagtgcatttaatattgtagttccatttgcaaagtaaatttcttcctattaaacatgcaggggtggtatcacaaggtaggaaggaatgtttatgcagtcaaaccccaatagttacagttaagggctgagatacagggaaaatctgtggagtattggaaataccacctgtgtaatacgcttactccaaagaaaaggttgagcaaagatggcagggtttaatgtagaaagagtagcaaccttatttaccaggaattgatgaagttgaccatctatattagtattgtatttactgtgaatgtttagcataaggcagaatattggatggtttttccttttctggtttttgtgagaacatcgattgatctgaattaggaatttttccatctttgtttttctcttgtaagatgggacaatcttctttcctatgtcctattaacaatatccaaacatgtccttgtcaacaagtcacttgttataaaatgggtaacctagctgttggattagtagtgctacaagtttattttggaacctgcttcatttttgttctaaagccctttcaaaatgctgtgccaggtattgtactgcagataaaggggctatttccattctaattggttttcaaatgtggtctccaatttcaggcttaactccattggcgaaatgagatgaaagagtagctattacatggacatcttccttagcttacaaatgttggaaggtattttctagtctattctgaaaatctcctatagtttcatcagtttgaatgactgaattacggcccaattaatttttgttggaaatgtttcaggtctggcttttaggagacttcaacctactcttatagcctttaaaaaaaattttttttttgaccctcagatttactgtggaaagaaggattctgtagctccctttccaggaaagcataaccagcttttgtcatccaggatttagcatttcagattttaaccaacatgactacaagttgatataggtcacacataggtcagtgtgttagactgctagtgagacagccaggtgggagggggtcctggagaaactccaacaagccagcccgctgaggtggagcctggggaaattcaggacttttgcagcagggaggagcccgagcctggcccctcctcttcctgggtggaacctcagattcaagtgcctggcggaaagccctctagcagagggactctggctttgcgagagtccctgtttcccctcttttttcccttttcacccaataaaaccctgcttcactcaccctttaaacctcctggaagcctaaattttcatgtccgtggggtggacaagaaccccgtctttagctgaactaaggaaaagtcctgcaacactagggctgtccgaaaaaaaaaagccatatactgggtggcttaaacaacagaaatttattttctcacagttctagagggtgggaagtgttctctccttgggctgcagatggctgcctacttactgtgtcctcatctggcctttcctctctgctttttcacagacaagaagagaaagatctcttcttcttctgataaggtcattaattccatctggatgtcctcaccctcatgagctaatttaaccctaattacatcccaaagagcccatctccaaatactgtcacactggaagttagggcttcaacagttgagtttgggggaacaaagcaaaaacattccatctataacaatcaggtaaccctgggtcatgttcatccaaaagaattctaaattctatgaatatttgccaaccttatttgagtttagggaaatcttttattagagttcttaattcagcttaattcagtacaaagtttaaactttatagttcccttcatacctggatcatgagaaagaatttttagaagtatccaccaaaataaggctgagacaaaaaatttgataaaagtatattggaagacaaatatgaggataaatcctggaagacataccaacacagttgggagttttccagaatctgctacaagttggaaggcttttataggaacatataggaaagtttagaagaagggaagaggactcttcatgttagtattttttactcagggacaggatgttgccatgaattacaagacctccccaacatgggtacctttggaagcccgtttacttttaaagtaaactgtcaaatgtgacctgtatcagaggtccttggcatttgggggtttcaggagagttgggaaaagctagaggtctgagtaagaggaggaaggagtatgaggtgttgaagcagggaaatcagaaatataagggggaatagagaaagctgaatatggggaggtagatgtaggcaaagaagagcaggatttactaataaaattagtcatttgttactacttaattttttcaaattgctcattggctttgaccaatgaatttgttagtgaagcagttttttattcagaattgcatttggagacttctgcatatcaaccaaaagtgctacccattgggccagataaattttatcctctttctttttgaaggtgcctctaaaatgaagttttattcaagacaaatgttcctcagagtgacttctgaaggaccgagtcatctttggtgctaaaaactccccacctctacatgcctacatatcagttatttttctcctcaacttccttaaatgacaagagctaagccctttggagagctagcaacggggatccctttcctgtatgttgctcccttgacttgctcaggctgcaagcctattaaatgttgcctgataaaaatttctgtttggtccagtgttaatttctatttacacacgagccaagaaatcagggtccaagctgcagtaacaagatgacttcatgagactggtgacagtctgtaagaaggtaatgcctgtgcacctcatgtctggtgcctccaacctgaaagctgaccctctccaaatgtagacccagtaatcttcactatccagcaggaagaacattagaaaaaaaaaatgttctatggatgaagcctgggctctgaggacaaaaatttaaatggaaggagacgctcatctggttttattggtgactgacccatagcaaaatttgtcctaatggatgccagttccatgaggactgaaaactcaccactctgtgaggccagaaaagtccaatacactatctgtaagtccaaaagcgtggactatctgtaagataacagagaattgaactgaacggtaatgccatgtcaaaaattatgcaaatttaattcatttaaaaatactacatatgctcatggaactctacatgacagaatctgccttaggctcccggttgaagtcattccattatagaacaacaatatctagtttaaaaaattcactggaaagtttcaatcaaatataaatttaaaatgtttaaatacatctataaattgatcataaaatgtgaatttgaatacaaacatagaagaactgccaatactaaaaaaagggtttagaataaatggagcaacagaccatgatctaaagtgaaagcaaagaagtaaaaatattaaatatctattgatcaatttatattggcctactgtatccaatacaatgccaatgaaaattttgtaggaacttcataatatgatcctagtttctgttcaaaaatggaaggatgagccaaaacaatgtgtattagtctgtttccatgctgctgataaagacatacccaagactgggcaatttacaaaagaaagaggtttaattggacttacaattccacgtggctggggaagtcatggcagaaggcaaggaggagcaaatcacatcttacatggatggcatcaggcaaagagagaacttgtgcagggcaactcccatttttaaaaccatcagatttcatgagacccatttactgtcacaagaacagcatgggaaagacctgcccccattattcaatcatctcccaccaggtccctcctacaatacatgggaattatgggagctacaagatgagatttgggcagggacacagagccaaaccatatcacaatgtattggaaaaaattatagtaccagataacacaacaaaatgtaaattataatcattttaaagtatggcactgagtataataaaaatcagcagacaatgggactaaatggatgatccagaaaacatttcaatacaaataagaacaactctctagccattattaaaaaaaaatctattgtacataactgacattaaaataagtactttaaatttttttaataagaaaacttattgtaaattgacaatgtatgattgtatatatttataaagtgctaagtaatgttatgttcatgaatacgatgtggaataattaaattaataaacatactcatcgcctcaaatatttgtcatttttgtgataagaacatttgaaatttactcacctagcaagtttgaaatatgcaatataccattattgaccatattcaccatgcagtgcaataaatgtcaaaaaaaaaaccacacaaaacctaattactcctgtctaaattaaattctttatcctttaaccatcatctctccatttctcccaccctcacattctggtaactaccattctactctctgcttctattaattcagttgttttagagtccacatacaggtgggaatgtgtggtatttgtcagtcttcgcttggctcattttgccagttccatccatgttgtctcaaatggcagaaatgacttgtttttaaggctggataatattccattgtgtatatataccacattttctttatccatccacctgttgagaggcacttaggtagattccacaacttggctattgtgaataaatgctgcaatgaacatggaagtgcagacatctcttcaatgtactgatttcaatttctttagatacagactcaaaagtgggattgctgcaccatatggtaattctattttttgatttttttagaaacatccatatcgtttttcttaatgactgtactaatttacattcccatcaatagtgtatcagggttccctttactccatatcatcaccaacaattgttatctttcatctttttgataataaccattctgacaggtgtgaggtgatatcttattgtggttttgatttgcatttttctgatgattagtgatggtgagcattatttcatgtatctattggccatatgtatgtcttcatttgagaaatgtctatttaggttccttgcccatttttaaaattggattatttgttttcttgctagtgagctgtttgattgtcttatatgttttgggtactaagatgttaccagatacatgctttccaaatattttctcccaatccataggttgtttgttcaccctgttcgttgtttcactttatgtatagaagcttttagtttgatgtagtcttatttgtctatttttgtttttgttgcctgaattttgtgagtaaaattaaaaaaatcattgttctaatcaatgtcatatcatttgtcccacgttttcttctagtcacttttcaatttcaagttttatatttaagtctttactcctttttaagttcattgttatatggtgtgagataagggaccaattttgttcctctgcgtgtggatattcagctttcccaacactcttcattgaagagactattctttttcaactgtgtattcttagcacctttgttgaaaatgaattgactgtacatgggtgggttcacttctggatcctctattctgttccattgagcaaagtgtctatttttaggccagtaccatactgttttaataacaatagctttgtagtatagtttgcagtcaggtagtgtgatacctccagatttgtttcttatgatcatgatttccttggctatttgggagttttctgtaactcaacgtaaattttaggatttttttctatttttgtgaaatagacattggaattttgataagaattgcaatgaacctgtagatcactttgggtagcaatctgaacattttaaccatattcttccaatccatgaatatggaatatttttccatttatttatgtcttcttcaatttcttttatcaacattttttaaggttttagtgtacaagtcttttacctcctttgttaaatttatttctaagtattttgttttattttattttattttattttatttttgtagctatcataagtgagattattttcttggtttcttttttagatagtttgatgataatatatagaaattctacctaattctcggatgttgattttgtattctgaaactttaatgtatttatttattacttctgatagtgtcttgctgaagttttaggtatacatacatagaataattagcaaacagaaaaaatctcactttattctttcctatttggatgctttttatttctttctctttcctaattgctctagcaaggtcatccaatactgtgttgaatacaaatggtgagaataagcatccttgttttgtgcaagattttagataaaaggctttcaatttttcatgcttgagtataaagtaagctacaggattatggtatattaatatgttctttatggtattgagttacattatttctatacctactttgttgagaatttcattatgaaagcatgctgaattttatcaaatactttttctgcatttaataaaatgatcatatggcttttgtctttcattgtgttgatgagatgtatcacatttattgttttgcatatatggaaccatcttacttctcagggataaatcccacttggtcatgttgagtgatacttttaatgtgttgttgaatttggtttgtttatattttgttgaggacttttgcatgtgtattcatcaaggatattggcctataattttcttctcttgtaatgtccttgttcaactttggtatcagggtaatgccggacttgtaaaaagagttttaaagtattcccttcccttcaatattttggaagagtttgagaagaagtagtattatttcttctttaaacgtttggtagaatgcaacattaaagacagcacatcctgggcttttctttgatgggagacttattattactgattcaatatccttacatgttattggtctattaaggttttccgtttcttcataattcaatatttgtaggttgcatgtgtctaggaatgtatccatttctcctaggttatccacttttttggcatgtagttgttcatggtagtcttttctgatcccttgtatttctgtactataggttgtaatgtctcttctttcgttgtgattttgattcttctttttagtatagataaatatttgttgattttctttatctttttaaaaagccaattcttagttttattgatcttttatattgcttttctagtttctattttatttatttctgcctggtctttattaattccttcagcttacattgggcttagtttattctgctttttctactttctggtggagtaacattgagttgtttattatagatctttttttgatatggtttctgtttctataaacttttctgttagaactatttttgctggattccataagttttaatatgttgtgtttccatttttatttgtctcaagatatttttaaatttctcttttaatttgatcattgacccattggttgttcaggagcatgttgtttgatttctatgtatttgggaattttctgaaattattcctgttattgacttctagttttataccattattgtcagaaaagatacttggtatgattaaaatttcttaaatttgttaggacttgttttgtagcctaatgtgtgatctattttagtgatgatccatgtgtcattgcgaagaatatgtgttatgttgctgttaggtggaatattctgtatatgtttattaagttaacttggtccgaagtattattcaagtccaatgtttcagtcttaattttctgattggatgatttgtccattgttgaaaccggagcactaaagtcctctactgttattgtattgcaatctttctctaccttcagatcatttaatatttgctttatacatttagatgctttgatgttgagtgaatatatagttgacccttcaacagtacaagggctatggacaccgtctcaccacacaaacaaaaatctatgtataatatttgacttccccaaaacttaactactaatatcctactattgaccagaagccttaccaataatataaagaattgattaacccatttttatatacgtattatattctgtattcttataatgaagtaagctagagaaaacaaaatgttattaagaaaatcataagaaggggggacatggtggcttatgcctattattctaacactttgagaagccaggatgggaggatctcttgaaaccagaagttcaacgctagcctggccaacaaagcaagaccccttctctacaaagaaaaaaaaaattagctgggtacaaaggtgtgtgcctgtagtcctagctacttgggaggctgaggtaggaggattacttgagcccaggagttcaaggctgcagtgagctgattatgtcactgtactccagccgtgggaatggtaagaccctgtctcttaaatttttttaagaaaataataaagaagaaaaatttatttactgttcattaagtagaagtggataatcataaacatctccatcattattggaaatactttttgtttctttcttcctctattgctgtctttctttgagttttcatgaatttatgtagtagtatgtattgaatcatttgtttttgttttgtgcatctattacagacttttgctttgtgattactatgaatataaaacatttaacttataacagtctatttcaagctgataacaactttgatttcatgcgacaactctaactttactcaccccaccatacacacattttgttttggatgtcagaattttcatcattttgtaatacgtatcccttgataatgtattttagctgtagttgttattaatagttttatttaaaaatagctcacatgcttcccctaaataggcaaggtgggcatcttttcccttgggtgagaccatggggaaggcgttctggctgagtggaaccactgtttgtcctcctgagttaagcaaaactagctgttattcttcaccaaaatgcacagaagatggtgtctccctgcctaggcaggtctttgggatcggctctgataatgggcttgaagacaagccatctagggactcaagccagtttgaacgtcccaccaggcttctgaaagcaaccagatcagctttctacatgggctacactggttcctgatatctccaactgggcatcacagctagcagaaacagaagtaccaccaaagactgcaagctggtcactgtgaactacacaccgtgcttctaaaagcaaccagctcagctttatgcatgggctatgctggtggctgatatctccaattgggtaacacagctggcaggaacacagaggtaccaccaaagactgctactctcagtgttttccatgtggttagaccagagtgaacttgggaagactctcagaatgctagggaagctgacagaccacctccaattttctttttcctctgtaaaaaccatggacccaggccgggtgcggtggctcactcctgtaatcccagcactttgggaggccgaggcgggcggatcacgaggtcaggagatcgagaccatcctggctaacacggtgaaaccccgtctctactaaaaatacaaaaaattagccgggcatgctggcgggcgcctgtagtcccagctactcgggaggctgaggcaggagaatggcgtgaacccaggaggcggagcttgcagtgagccgagatcgcgccactgcactccagaatcggcgacagagagagactctgtctcaaaaaaaaaaaaaaaaaaaaaaaacaaaaaacaaaatggacccaaggaatcccctctgtgtggtattgtgctgacgtgagggaataggaggggcagcgtggtcaaagtgagaccatttttcttacccttctaattcagttttactcagttctgtggaccctcaggtgttttaggcttgtttccaagtactgtactgggactttcacaaacatcttccagtctatggttaatcgctagttgaaatttctgaaggagagagtgaagcctgaaatatatttcatcatctcgctgatctcatttctcaaaataagtccttgatgaataaaagtttctgtgattactgggtatatacccaaaggattataaatcaatctactataaagacacatgcacacatacgtttattgcagcactatttacaatagcaaggacttggaaccaacccaaatgcccatcaatgatagactggataaagaaaatgtggcacgtatacaccatggaatacttgataggtgcagcaaaccgccatggcacatgtatacctatgtaacaaacctgcaggttctgcacatgtattccagaacttaaagtaaaaagaaagaaaacaccaaaaaatagctttctttagttcaaggggattaaatagaaatctgtcttcactgtttcattagctctagtggtagacattaaatctccttcttggaattaaatgtcttatgaatgtgtaaacacagaaaaaaatatttttggtgaacattttcttgaataactttgtgtttctaatgtgataatctgtatgttatctttaaaccacttaaaagtatctttgggctgaaaaaagaagacagacaaagatctgtttcagttctgaaatgctatgatatcacacttcaagcttttttcttaaatagccttaagagcccttaacacacttttttttccctaaagtcaacggagatgtctcatatcttttatccattaagaatctttttaaattatccactaccaaactttatgataattgtcagtaaccaattcaccatcaattttagacatatacaatgtgacaagatatgaagtaaaactcttctcccaggactcataacctgcctttgaaggtaaacgctgaagggtgccctaaatttcttttataaaaaataatattattggaatattcacacaaagttactactttaaagacaaaaaaattagcgtggtctataaattatgtaggtttgttaaaataaatattgctgctgtagaaagaagataggatcactagtgcaaacaagggtgagaaagaacagtggagaaagaaggagagaaatctgcattcaaaaaccaattctacaacctactagttgcctcacctcagaaagttacataccttttaagcgtcattcttctcatatatttgttgtgagaatgatgaagaaagatatgaaaaacacttattataactaggttcttttaccttaatactgaaataaacagactcttaatacagaaaaaaaaaagtgtccgttgtatagaaatggccttaggattgaacagaaagacaagaaacatctgtcctaaagcaagatgctatcagcttgaattcctttgaactctccattccagtcacagctgggatgagaggagacattgagaggatgagtcagtgtatcagatgcatctgacacagttcaccccttcagcactctgatcactgtgcctgccctacattaaattcagtctgttaccaagtcctcaagttcataaccagctacagttctacaaaaaacttaatacacaggagttggtggcacataccacagtttgctcctgcaacttcaatcaaaggcagaattgacgttcatcctatccctcccctaccacttattttatatttccttccctttgtcatcacaagtagacatttcatttaaactatttttaacaacattaatcttatttcttctaactatatttttgtacccatatttcaaaaaactaaaagagtggaattggaatattccgaacacaaagaaatgataaatgcttgaggtgaaggatatcccaattatcctgatttgatcattgcatattttatttttgtatcaaaatatcacatgtaacccataaatgcatacaactattatgtatccataaagaataaaaattaagaaaatgcacattgatctgtgtgcataatacactcttcttcatgatgaatccaaaaagaaaatataacttgaaaataccttagtatttaacattttcagtactatgaggtcagcttattcccttataaaagagaataagatccatatagcacattctgtttatttagtgatgtttttaaagagtgcacacatctttaatccttacttttcataatagctatattatcatagcacagagtcagactaatcccacaaatcctgttcaatggcatgttacaatcaactagaatttgtttcatttgttgaatatagtcagataaataatttgagttagaaaaaatatttcaagattttttgtaatagtgttagcttgtaagaatcaaggatcagtatttatccaatctggtataaaatctaataaggaagtagtttttagaacctgctttatttatttaacatttcactttctatgtgcctatttctatttcaattaagtcttcataatttattttggatacaattgtcatatttattttcacacactgccatttttccaagtactcatgagagaatggatcaaattcagcaaacggtttgatgattctcataagatttttattatttaaagagtgccagttgaggggagggaccaagatggccgaataggaacagcaccggtctgcagcaccgtgaaacccacgcagaaggcaagtgatttctgcatttccaactgaggtacccagttcatctcattgggacggttaagcagtgggttcaaccaactgagggcgaacagaagcagggtggggcgttgcttcacccaggaagtgcaagaagccggggacctcccacccgcagccaagggaactatgcaaacaggagggaactgataacccatggacacatttattaacattccttcctcctctgggtgagaggcccacaagtatctgtaggctcaggcatccaaacactattattaacataaacctcaaccggaggttccaaccatgtgacagccctactcaaatatagtatggattatcagttaaacgagctgtttaatttgttacaacaaactgtaagaaaaagaaatttcccattttgtattactcatattcgagcacaccctaatttaccatggcctttggctaaagcaaatgaacaagctgacttgctagtatcatctgcattcatggaagcacaagaacttcatgccttgactcatgtaaatgcagcaggattaaaaataaatttgatatcacatggaaacagccaaaaaatattgtacaagattgcacccggtgtcagattctacacctgcccactcaggaggcaggagttaatcccagaggtctaagtcctaatgtgttatggcaaatggatgtcacgcatgtaccttcatttggaaaattgtcatttgtccatgtgacagttgatacttattcacatttcatatgggcaacctgccagagaggagaaagtacttcccatgttaaaagacatttattatcttgttttgctgtcatgagagttaaaaaaaaaaattaaaatggacaatgggccaggatactgtagtaaagcttttcaaaaattcttaaatcagtgaaaaattacacataaaacaggaattccctataattcccaaagacaggccataatttaaagaactaatagaacactgaaagctcaattggttaaacaaaaaaaaaaaaggaagaaacagtaaggagtattaacactccccagatgcaacttaatctaatactctatactttaaattttttgaacatttatagaaatcagaccattacccctgcagaacatctaactggtaaaaggaacagcccacatgaaggaaaactgatttggtagaaagataataaaaataaaacatgggaaacacggaaagtgatgacatgtgggagaggttttgcttgtatttccccaggaaaaaaacaccttccagtttaggtacctacaacttacagataaagttgtcatccaccaagaaagcggagccgccgacttgggcacaattaaagaagctgacacagttagctgaaaaaagcctaaagaacacaagggtaatccaaactccagagaatatgcagcttgcagccttgatgattgtgtcaacggtggtaagtctccccaggcctgcaggagcaactgcagctaattatgcctattgggcatatgtcccattcctgcctttaattaggcctgtcacatggttggaaaccccggttgaggtttacgttcatagtagtgtttggatgcctgagcctacagattctcgtgggccctctcacccagaggaggaaggaatgttaataaatgtgtccgtgggttatcaattcccccctgtttgcatagggctggctatctgttgcctaaaaggctaccgacaacattggctagttaagattccaggtcataatcaaagaccagtatcctgtcatttattttacaaagtttggttcaattggaacagtttaagcccagaaaagagaggtgtcaacaacctcaataatggtcaaaggatttagaaacattgatttggaaggattgcatcactgatcacactgtggtactgcaaaataatccctatggaatcatcattgattgggcccctaaggggacctttgcagttaattgtaccaatcagaatgatagatgcaagataggactaaaccaagaactatattatcaaagagatgacaccatttacactgaaaaacgtgctcattttcccataatttggaccaattttggtatggccgacccacatccaaaaatgagtaatccaatcatagaccctaaacatcctgaattatgaaagttaatgatggcccaatctcatattcgggtttggaaaaaaaaattatattaatggagaaggtgggagacatcaatttacgtatcagttttgttccagccaaacaatacccattcagagttgtgtcaagcctcctttaatgttaattgtcagaaatattaatattcgaccaaattctcaaaccattacttgtcaaaactgttgccttttcatctgtattgattgcacatttggtgtaaaaacatctgtgttgctggtgagggctagagaaggagtttggataccggtttccctcaatagaccttggggagcctctccttccattcatattgtcacagaaatgttaaggggactgtttaccaaaacaaaaagatttatttttacccttataacggtcattatgggccttattacagtcacaggtactgctgcggctgctggaattgctttacactcctctgttcaaactgcggaatatgtaaatgattggcaaaaaaattccttaataaaagatcacacatttacacattataacaaattttatgctctgaaaacatttttagaaagagcatatatttacatatgtttgggaaaggtatcttgatattaaataattaattgacagtgttacattttcaatgttcaaaatgagctaagacttttatgtacattatcttatatcagcctcactaaactatacaaactggatattgatgtgctcaatgagaagacaatggaataaggcatggagagctcacaaagctgaggagtggcaaagttgctttccatatgtgatatgacagcacctccctctagtggtgacaccatgcttttcctccatattcctgatgtgacaaagctcagagtcacagatttgatgccctttattcttattttttgcttccaaatcatttatcctctttatttagctttttcttacagtatgaacactagacaaaaacagttaagtcatttgcttagtatatggtgtcaataaagcatggtctgacaacatttatttttatttattttccaacttttaagttcaggggtacatgtgcaagcattatataggtagattgcatgtcacagggatttggtatataaatgatttcatcacccaggtaatcagcatagtacttgataggtagttttcaaccctcactctcatccctcaaccctcaagaaggccctggtgtctgctgttcctttctttgtgtccctatgtaataaatgtttggctccaacttataagcgagaacttgtggtatttggatttatgttcctgtgttagtttgcttaggataatgaactccatctccatccatgttgctgcaaaggacacaatctcaatcttttttatggctgcatagtattctgacaatacttatttagaccatatttattttatacagatacaaaatgctatgtaatttattttatgtcctctcatcctgaatagacattttatagacatatgtgaaatatcaaaagagacattaggcaaagtactaatgataccaacataaaagataacattattacatattttgtgctctgaaaacatttttagaaggagcatacattcaaatactaagtttgggaaatgtgttttaatacttaattgaaagtgttactaagttttcaaagttcaaaatgagcctctaataatgtgttaagacttttatgtacattatcccaattcagcctcacaaaataatatgaattaggtattgatgtgcttattgagaagatgatgaaaggaggcatagagaactcacaaagctgatgactggcagagttgctttccatatgcaatatgccagcacctttctcaagtgttgacaccatgcttttcctccatattcctaatttgacagagcttgaagtgacagattaaatgcccttcttcctcttcattgttgcttccggataacttaccctctttctttagctcctcaacccaccagaaaaccacaaaacaacaacaaaacaaacacataaagtgaagcacatgtcatcaggctgtactactcaaaactcctttgtgctaggcatcctggatctcccaggatgcctttattcactgaatattttaacaactgaccctttctctccttaccattactcttgttgatctttgggccctttcagatatggtagacaagcatctccccagcctctcagttccttgacctcctaatagctgaaagtcttttctatcatctcacctcagcctgaaacttttccttaccagtaactaaacctcctccataatctcaatatcaagagtcccacacaatcagtccctctcatgacctgcctgctccatgctgataggtcgaatggtcaattctccatcctcattttattttatgtctcagcaatatgacaaagataattatcccccttcttcctagattcttgtgaactttagaaactatgagacaataaacgtttcagttcactacatttagagggtatttcttatgcaatatcagataattaatacagaaacttttacctgacttggaagagcatagattgttactgtctgttttgttgttattgttgttgttgttgttgttttcagacagaatctctccccgtcacccaggctggaatgcaatggtacaatcgcagctcactgcaaccttcgcctcccagattcaagcgattctcctgcctcagcctcccgagtagctggaattacagtcacatgccaccacgcccggctaattttttgtatctttagtagagacggggtttcaccacgttggccaggctggtctcaaactcatgacctcgtgatctgcccacctcggcctcccaaagtgctgaaactacaggtgtgagccaccgcatccagctattgtctcctttttattctttatataaactgaaacatacacaatgttttgctgtatgactgacttccttaactcaatattatgtattaaaatatatgtgaaagcttttgggttctgtaataatatttcactacagatacttaggagtagaagtattcaatatatagtatgcattttttcacctcatagtacataatatcaaatagatttttaatatgattgtcacaatttatactctcatcagcaatattaaggctccccagtgctctacattcttgccatcatttggatatgtcagccttttggattatagtcattctagtgggtacatgtagatttcattcacagtttaatttggttttccttgagaataaaagacaattacggaagttgaacatgtgttcatgtttgctgttcattaggagatcctcttttggatgagcttatttaagacttttacttctatttttttgtagatttgaagactgcattacatattctaattatatatataatatgtttttaatctttgatttgccttttcagtctcttaattatatctttgtcagttctcaattttaatgtagttaaatgtattgactttttttttttacacttaatattatagttttgtatcagtttcccaatctggagaatgtgaaaataatgtcattgactttttttttctataagtttgattgttttatcttccacatttagatctataatccatttggaattgccttatttttaatgtcaggagggtaagaaccaggttttatttctttctaacgtgtatagaaggcctgacaccatttattgagaagattatcctttcactatcgttaccataaatcaactcactatatgtataagtctggcaattacattgaatatatagatatatttgtggaaaaattagactcacaaaatagtcagtcttccagtccataaccatgatatgttccaccatttattagcccttggcatattgcatagttttcagtgtatagtccttggcatattttgttatatttatttccatattttgttagataagtaaattactttgaagcataaatacacatatagaaaagtggacacatcataaatatacagctctgtggatttgagcaaactaaatatattcagaatgccagcacccaaagaaaattcagaatacaacagtttccatgaagccctcttcatgctctaccacctcctcctacacccatcaagactactatcctgctttggtactttaggcaaatggaatcttagagtacatatttcttagtatccagtgtcttttactcaataataaacatgtaagattggtagatattttggggtttagctgtaggtcaattgttctcattgctctatagtgtttattatatgaatatatcatgaattatttaacgctcaactcttgatgaacatttgagtgctttcacttttatgtctaactctggtgtctgtggttatgcagagttttccgttatattcctatgccatttggtggttttccagagccagctgagatgatgctgtgtcactgacagatcctttccaataggactttcccaaccataatgaagaagacctctcagttttgggttggcagtttaacatgagatagaattggacatagtgcctcatctaccctcactcccaaatgtaagacaattgagaaagcacatttgagtgtagtagaattagttaaagatgtaagtgttggaagttttcttcctaggatttctctgaccatcataactttgagggtaaccacagcccttcactccacaagagcccagcctacttctaccttgctagtttcagtctgtcctctcctatattctatcctcttccctctactcactaccttgtttttcaaaacaaacaaaattttttaacaaagcaatttaatagtcattttttcttgcttaggtatctgctgatacttaaattgttggagctatgcctcttctccaatatgcatttcaagtttgtttccaagaacatacatttccctctctatcaggaattttggagtctgacattaatattaaacaatgaaccttattttttacatttttgtaatacattatccaaatagccattccactacaagtgaaaaggaaattctacagaaaacctatgggagttccacatagtgcacagacaccattgctttggaaactttgtggcaaaatatgtcacaacagagacatgagcttaaatcaaattaggcattttgaggaccctgaggtttaggtgaatttttaccagagcatcagctgcacatgccatgaaatgtcctggcagttgaaacagccccagtggaagaatattgggtctgaaggcaacttcaggtacagtggtttatttaatcattagcagatggctctcatgaagaattctatagatttatatttttaaaaataaacttattgttctacaagaacagtaaaggagtggatcttagaaataagcctattatgtaagtagctattcattgatttcagttttaatctcaatcacaatcacaggaaacaacatctccagctgccttggattgaccaaagagcttttctttatgcaagaccttatacaaaaccgttttaaacacaatgactggaagtgtgtgcaacttgctggggacagaggagaaacaccttccttttgctgttgttttcaacagcaagtgtttaaggcagtcacttcttgaaatctttttacaaagaggctggtcattttaggaagctggggattttttgggcctgcagtttcagttccacaagacggaaaagccctaggctgttgtacagcaatgtgaatacacttaacactactgaactgtacacttaaaacttgttatgatggtaaattgtatgtaatatgtaaagctcgttagagaaaaatttaaaaggaaaaaagttaatacatcaacaaattgattatgaaatttacatttgaattgaaatgtagaaaactaccaaataataatgagactaaaaaagagctttgaatacatacagcaagaagccatgattgaaaacaaaggcagttaactaaaaatagtgtctataaatcagtgtatatttggcacacatccagtacaaatccagtgctggtgcaattcacaaagtgatcctgattttcactcagaaaaattggttaattattggggaaaattcacccccgatatttcacataggttcttttctattttccctaagtgtcagctggtctgagaaataaagggaaagggtacaaaagagagaaattttaaagctgggtgtccagggggacatcacatgttggcaggttctgtgatgccccctgagccataaaaccagcaagtttttattagcaattttcaaaggggagggagtgcatgaataggttgtgggtcacagagatcacatgcttcaagggcaacaaaagatcacaaggcagttggaggcagggtgagatcacaggacagggtgaaattaaaattgctaatgaagtttcgggcacacattgtcattgataacatcttatcaggagacaggctttgagagcagacaactggtctgaccaaaatttattaggcaggaatttccttgtcctaataagctggggagcgctacgggagaccggggcttatttcatcccttatctacaactgtaaaagacagacgttcccaaagcggccatttcagaggcctccccttaggaacacattctctttctcagggatgttccttgctgagaaaaagaattcagcgacatttctcctatttgcttttgaaagaagagaaatatggctctgttccacccagcccacaggcagccagactttaaggttatctcccttgttccctgaacatcgctgttatcctgttcttttttcaaggtgcccagatttcatattgtttaaacaatttgtgctgttaatgcaatcatcacagggtcctgaggcgacattcatcctcagcttacgaagatgacgggattaagagattaaagataggcataggaaatcacaagagtattgattagggaagtgataagtgtccatgaaatcttcacaatttatgttcagaggtttcagtaaagacaggtgtaagaaattataaaagtattaatttggggaactaataaatgcccatgaaatcttcacaatttatattcttctgccatggcttcagccagtccctctgtttggggtccctgacttcccacaacagttaataataggagccaaaacaatgtattggaaaagaattagctccattgttaaaacacaacataaataagtcattttagtgtagtactgagtttactataataaacagaaaatagaacagaatagatgattgagaaacaaatttaagtgtatataagaacaaccgtcaggctatttttttttagttaacacataatagttatacatatctatgggacatagagtgatattttgatacatatacataatgtgtaatgatcaaatcagagtaattagcatattcattgtgagaaaacattttaaatggtccactttcaagacacaataaatgtaagtactggcaggcaaatggaacaaaccgcatggcttatgcacctagaaggtcacaataagcaaacagaatgtagatgaggggtcagcacataaaagggaataaagtttcgttattgggaaatcaaaacttaagcggggaaggggagagagtataaccttataagggggatattgaaacttaggcgatgtctgggaagattttaaccccatagtactcaaccatcaaggaactggggtagggacttgcatgctaggagataaattacctgttgtaactgccccatgtgtgcctgtctaccatgtgcccgatcttgcaacaccattattaagtctcactttcactgttcttcgtgcctctaagtcagttcttcgggtttggacaggtgagcgtgtttctcacatgcatcacctcaaacatttataatttctttgtgttagatagattcaaaatcctctctcctagcattttgaaaatatacaataaattattgttaactatattcaccctacaatactatagcacacttaaacttattcccccatctagctataatattgtagctgttaacaaacctctccctactgtcctctcccctctgcctttcccagcctctaataatcacagttctaatctctacttccataagctcaacttattttagctttcatatgtgtgaacatttatctttctgtgcctggcttatttcattttaattatgtaggcccatccatgttgtcttgaatgacaggatttcacttttatgactgaatactaatccaatgtgtagctacactatactgtctttatgcattcatctgtagttggatatttaggttgatgcagtatcagctattttgaatagtgctacaataaacatggagtgcatatatttcttctatatactaatttcctttttagcttttattttaggtttcttttaggttatatgcagttttcttatatagctaaattgcatgtcatgggattttggtgtacaaattatttcatcacccaggtaataggcatgctatgcaacaggtagtttttcaatcctctccctcctctcaacttccaccctcaatgtggccccaatgtctgttgtttccttctttcctttggataaagacttaatagtggaaaaaactgaatcatatggtagttccatctttttagtgtttttgagaaaggtccacactgtttttcatatggctttactaatttactttcccactaatagcatataagagttctcttttctcatctttattagtatttgcattaattttttcaatagccattctaactgaggagaaatgatatatcattgtggttttgatttgcatttcactgatgattagtgaggtttaatttctgggatacatgtgcagaacgtgcaggtttgttacataggtatacatgtgccatggtggtttgctgcacctatcaacccattatctaggttttaagccctgcgagcattaggtatttgtcctaatgctctccctcccttgcccactacccccaaaacaagggccaatgtgtgatgttaccctccctgtgtccatgtgttctcattgttcagctctcacttatgaatgacaacatgttatgtttggttttctgtccctgtgttagtttgctgaggatgatggtttccagcttcatccatgtccctgcaaagaacaagaactcattcttttttatggctgcatagtattctatgatgtacatatgccacattttctttatccagtctatcattgatgggcatttggattggttataagtctttgctatagtaaatagtgctgcaataaacataggtgtgcatgtgtctttacagtagaataatttataatccttttggtatatacccagtaatgggattgctgggtcaaatggtatttctggttctagatccttgaggagtagccacgctatcttccacaatagttgaactaatttacactcccaccagcgtgtaaaagcattcctatttctccacatcctctccagcatctgttgtttcctgaattcttaatgatcaccattctaactggcatgagatggtatctcattgtgattttgatttgcatttctctaatgaccagtgatgatgagccttttctcatatgtttgttagccacataaatgtcttcttttgagatgtgtctgttcatatcctctgcccattttttgatggggttttttgttttttttcttgtaaatttgttcaagtttgttgtagatcctggaaaccagatctttgtcagatggataggttgcaaaaattttctcccattctgtaggttgcctgttcactctgatgatagtttgttttgctgtgcagaagctctttagtttaattagatcccatttgtcaattttggcttttgttgcaattgcttttggtgttttagtcatgaagtctttgcccatgcctatgtcctgaatggtattgcctaggtcttcttctagggtttttatggttttgggttttacatttaagtcattaatccatcttgaattaatttttgtgtaaggtgtaaggaaggggtccagtttcagttttcctcatatggctagccagtattcccagcaccatttattaaatagggaatccttttcctattgcttgcttttgtcaggtttgtcgaagatcagatggttgtagttgtgggtgttgtttctgaggcctctgttctcttccattggtctatatacatgttttggtaccatagcatgctgttttagttactatagccttgtagtatactttgaagtcagatagcacgatgcctccagctttgttctttttgcttggtattgtcttggatatacaggctcttttttggttccatgtgaaatttaaagtagttttttctagttctgtgaagaaagtcaatggtagcttcatgggaatagcattgaatctgaaaattactttgggcagtatggtcattttcacgatattgattcttcctatccataagtatgtatggaatgtttttccatttgtttgtgtactcttttatttccttgagcagtggtttgcagttctccatgaagaggtccttcacatcccttgtaagttgtattcctaggtattttattctctttgtagtaattgtgaatgggagttcactcatgatttggcactctgcttgtctattattggtgaataggaatgctggtgatttttgcacaatgattttgtatcctgagactttgctgaagttgcttatcagcttaaagagatttttgggctaagatgatgctgttttctaaataaataatcatgtcatctgcaaatagagacaatttgacttcctctcttcctatttgaatgtgctttatttatttctcttgcctgattgccctggccagaacttctaatattatgttgaataggagtggtgagagagggcatccttgtcttgtgccagtttgcaaagggaatgcttctagcttttgtctattcagtatgatattggctatgggtttgtcagaaatagcgcttattgttttgtgatatgttccattaatatctagtttattgagaattttagcatgaagggtgttgaattttattgaaggcctttttggcatctattgagataattatgtggttctgttaatatgatggattacgtttattgatttgcatatgttgaaccagccttgcatcccagggatgaagccaacttaatcttggtggataagctttttgatgtgctgctggttttggtttgccagtattttactgaggattttcacatcaatgttcatcagggatattggcctgaaattttctttttttgttgtgactctgccaagttttggaatcaggatgattctggcttcataaaacaagttagggaggagtccctctttttctattgtttggaatagtttcagaaggaatggtaccagctcctctttgtagctctggtagaatttggctgtgaatctgtctggtcctggactttttttggttggtaggctattaactattgcctaaatttcaaaagttgttattggtctattcaaggatttgacttcttcctggtttagtcttgggagggtgtatgtgtccaggaatgtatccatttattctagattttctagtttatttgtctagaggtgtttatagtattctctgatggtagtttgtatttctgtgggatcagataaagggtgatatcccctttatcattttttattgtgtctatttgattcttctctcttttcttttttattaatctgactagtgttctatctattctgttaactttttcaaaaaaacaactcctggattcattgattttttgaagggttttttgagtctctatctccttcagttctgctctgatcttagttatttcttgccttctgctagcttttgaatttgtttgcccttgcttctccagttcttttaattgtgatgttaaggtgtcaattttagatctctcttgctttctgatctggccatttagtgctataaatttccttcttaacactgctttggctgtgtcccagctaaaaagattctggtatgttgcctctttgttctcattggtttcaaagaacttctttatttcggccttaatttcattatttacccagtagtcattcaggagcaggttgttgaatttccctgtagttgtgcagttttgagtgaggttcttaatcctgacttctaatttgattgcactgtggtctgagagactgttttttatgatttccaatcttttgcatttgctgaagagtgttttacttccaattatgtggttgatttcagaataagtactatgtgatgctgagaagaatgcatattctgttgatttggggtggagagttctgtagatgtctattagctctgcttggtcaagagctgagttcaagtcctgaatattcttgttaattttctgtctcattgatctgtctaatatggacagtgggctgttaaagtctccaactattattgtgtgggagtctaagtctctttttaggtcaggtgctcctgtattgggtgcatatatattttggatagttagctcttctcattgcattgatccctttaccattatgtaatgaccttatttgtcttttctgatctttgttggttttaagtctgtttggtcagagactaggattgcaatctctgctttttttttcttttcatttgcttggtaaatttttctccatacctttattttgagcctatatgtgtctttgcatgtgcaatgggtctcctgaatacagcacaccaatgggtcttgactctttatccaatttgccagtctgtttcttttaattggggcatttacctcatttacatttaaggctaatattgttctgtgtgaatttgattctgtcattatgatgctacctggttattttgcaccttagttgatgcagtttcttcatagtgttgatggtccctatattttggtatgtttttgtggtgactggtacctgtttttcctttccatatttagtgcttccttcaggagctcttgtaaggcaggcctggtgttgacaaaatccctcaccatttgcatgtctggaaaggattttatttctccttcacttatgaagcttagtttggctggatatgaaattctgggttgaagattcttttctttaagaatattgaatattgacacccactgtcttctggcttgtagggtttctgtagagagatccactgttagcctgatgggcttccctttgtaggcaacctgacctttctctctagctgcccttaacgtgtgtttctgcgtttcaaccttggagaatctaaagattatgtgtcttggagttattcttctcaaggagtatcatagtggtgttctctatatttcctgaacttgaatgttggcctgtcttgctgttctcctggataatatcctgaagtgtgttttccaacttggtttcattctccccatcacttttgggtagatcaatgaatcgtagatttggtcttttcacagtcccatatttcttggaggctttgttccttcctttttattcttttttctctaatcttgacttcacaccttattttagtaagttaatcttaaatctctgatatcctttcttccactattgatttggctattgatacttttgtatgcttcaggaagttctcgtgctgtgtttttcagctccatcaggtcatttatattcttctctaaactgaatattctagctagcagttcccataaccttttatcaaggttcttagcttccttgcattgggttagaacatgctcctttagctcagaggagtttgttactacctaccttctgaagcctacttctgtcagtttgtcaaacttattctctgtccagttttgtgctctcgctggagaggaattgggatcatttagagaagaggcattctggtttttggaattttcagcatttttgtgctggtttttcctcatctttgtggatttgtctacctttgatctttgaggctgatgacctttggactgggtttttgtggagggggggtccgttttgctgatgttgatgttattgctttctgttagtttttttctcatggttaggtctctcttttgcaagtctgttgcagtttgctggaggtccactccagaccctgtttgcctggtatcaccagcagaggctgcacaacagcaaggattgctgcctgctccttcctccaaaagttatgtcccaggggggcaccggcctgatgacagctggaactctctggtatgaggtgtcgctgttgggaggtctctcctagtcagggacccacttgagaaggcagtctgttccttagcagagctcgagcgttgtgctgggagaatcctccttgtcaggatccactgctctcttcagagccagcgggcaggaaagtttaaatctgctgaagctgtgcccaaagccgccccttgccccaggtgctctgtcccagtgggatgggagttttttttatctataagcccctgactggggctactgcctttctttcagagatgctctgcccagtgaggaggaatctagagaggcagtctggccatagctgctttgcagtgctgtgttgagttccatccagtccaaacttcccagcctccttagcaggagaaaaatcgcctactcaaagcctcactaatggtggacgcccgtctcccaactagactccattgtcccaggtcaacttcagactgctgtgctggcagtgagaatttcaagccagtggttcttagcttgctgggctgtgtgggagtgggacccattgagcaagaccacttggctccctggcttcagcctcctttccaggggagtgaacagttctgtctcgctggggttccaggtgccactagggtacaaaaaaaaaaatcctacagctagctcggtgtctccccaaacagctgcccagttttgtgcttgaaacccagggtcctggtggtgtaggcacaggagggaatatcctggtctgtggattgcaaaaaccgtgggaaaagcatagtatctgggctgaatagcacagtccttcagggctccccttggctgagggagggaggaccctggctccttgcacttcccaggtaagtcaacgcccccaccctgcttctccatgggctgtacccactgcctaatcagtcccaatgagatgaacagggtacctcagttggaaatgcagaaatcatcttctgtgttggtctcactgggagctacagaccagagctgttcctattcggtcattctgccagatctaagacatgttgagcattttttatatacttgttagccatttgtatgtcttcttttgagaaacgtctattcatatattttgcccattttttaaataagattgtttgtttgtttttgagttgagactcttgtatattctgaatattagtcctttgtcagttgaatagcttgcaaatacattatcccattacataagatgactctccattctgttggttttttcctttgctgcacaaaaaccttttagtttaacagtctcatttgtctatttttgcttttgttgagtgtgctattgaagttttacccatcaaattgttgcctggactgatgtccacaagtgttttccctatgtttttctgtgatagttttaaagctgggggtcttacatttaaatatttaatccattttgaattgatttttcatacagcacattaatatccacatttcccagcatcaattatgaacatacattccccaatgtatattgctggcctttgtgtcaaaaataaggtgactttaaatatgtaaatttatttctgaattctctattctgttccattggtctacgtgtctgttttttactgtcaggtcattttttataaaattaaaactcaactcatttcacataagtgacatgaaaggaaattcttcacggataaaagtttgaaatcttccaatgtgcaatcttgggctacataaaatgtgcaatcttgggtgacatgaaaggaaattcttcatggataaaagtttgaaatcttccaatgtgcaatcttgggctacatatttcagtgttcagtgctccattcttccactcctctccaggcctttgcttttatgctttgagtgcaagtcaatcttacccactagagtaagtccagtttagggcagtgcctgtgtctaattcatcttcatacacttctcagcacctagtacagtgctgtgcatgcagtgtatttgctctctatacacacacatgcatatggttgtttttctagcttgcaggtcttgcatccatttgatatgagactcagtgaccccagctgaatcactgaatccctcttgctatgcactctacgggcagctgcatagagctctttgtgtgaaaataagcttactatcaaaacattccacacctgaaattcagtctgttcattggatgctgatattgagactgctaggcatatatacaataattattgcatcatgtaataatactaaactgtgaattaatttgatctgtgaccatctactagaagaattccatagcctgcaaaccaaatgaaccgaaagtgaggaaatgatgcttcctcatccccaccatctaaatgaaaaattccctaaatattttttcccagctgtctgacataaaaacaaaaagcacaaaaactgtccccaacacattgcactaaacagaaaagagtggttttcttaatatctagtctatttcccagaaatgaagagcttgtccctgctttcactttcaatttggggcagttttggtagtttgagtctttctacgaatttgtccattatgtctaatttaatttgttggcatacagttgttgatagcattaccttaaaatcttttttatttttgtaaggtcagaagtaatgtcccctttttcattcttgattttggtaatttgagtctcctgttcttctgctgggttttttgttttgttttggccagtctaacaaaacaggttttttttgccaattttgttgatctcttctaagaacagcttttgattttattgattttctctacttttgtcttatattctctatctcattaatttctactctttatttccaaaattctttattattttcttctttctgctagctttgggtttagtttgctcttcattcaccagcgtcttaaggtaaaagattaggttattgatttgagttctaatattttcttactaatttctctagagtgtatcatatatgtaatttatgagaatgtatatcacatttatgctaaatcaattccaatgagaaaatttttactcttataaatctaaaaatactagttttctcacttttttgatactattaaatacgttaaatatatgttcaaacaatataatacattgttataattaattcacataattttatgtcttttaaagaagctgaaggggaaggtataaatgtatagagcttgttatgttaacttacagtttcaggttctcttaatgtattcctgggggttcaagttaacatctgctgtcatttctttattccaatgcagcttcgctcctactgtcctctcttgtcctgttcttaagtatatcacgtttctatatgttatgagcctgaaacacaattatatacatattgctttatacaactgtcttttaaaaattagttaaaaagagaaataagaagaaatatgcatttatacagtcttttataactatataattatcttactggtgctctttgtttgtccatgtggatgtgtattgccatctggagtcatctgctttctgcctgaaaaccttcttttattaatagtatttcttgtaaagtcagtcatctagtagtaaattttatttatgtttccaggcttgaatctccccccggcccacactctttttcaaataaagtcagtttctgtgggaaaagctttggagctctgattttatggactgcctctctctctctggaaaatatctctgagccatgaccccttcgaatgggcagaggtggtagcttctgctctttgccagttgcccctcccaacacggaaaaaccaccctacaagtgaaccagagtgagggtgacaggccagggtttctcattctgccattcctgagctaaagctgaaatcttcttgcaaaaattataactgagaatattattatgtgaaagagatctgacctgactctatcttacttctaacctccaagctgtccttgttcatccctgagcataggccaaactgacattggaaggaatttagtcagccttttcccaaaataaaaccccttcttccctgagaactagactaactttgcaagactaacaaatcagccatgagattagaaactgtggtctgagagtcatgcagctagaggccacaagattccagacctctccaattgccatccaggtcaataaactggctcatctggtcttgtggcccccagccaggaaccaactcatgcaagaggacaactttgatgccctgtgatttcatccctaacccagccaatcagcactccccactccccaacctcctacccaccaaattatcctcagaaacccccatacccacattatcagggagaatcttttgagtaataataaaacttgagaatcccatacagccagctctgcgtgaattaaacgctttctctactgcaattcccctgtcttgataaatcagctctacctaggcaacaggcaaggagaacctgttgggcagttatggagcctctgctctatgagtgggactgggaaagtttgggagcccttgacttctggtcacactcaccagaaatttagtctttacaactcactattggaggggatgaaaaattctggtggactggcactcctgataggatatgtcatccctgctcagaatgtgagagaagaggcagccccaccttctttccatagcccccagtagtggaccttttgtcaacccgaactgaaaatgaggatgaagaggcccaagggtcaagtgccacagattcttgttattcttaccggagttataggagctctccttgaatagatgtttcattgtgatgtatgcttcctgtggggaaaagcaagagagatcagattgtcactgtgtctgtgtagaaagaagtagacatgggagactccattttgttatgtactaagaaaaattcttctgccttgagattctgtgaccttacccccaaccccgtgctctctgaaacatgtgctgtgtcaaactcagggttaaatggattaagggcggtgcaagatgtgctttgttaaacagatgcttgaaggcagcacgctccttaagagtcatcaccactccctaatctcaagtacccagggacacaaaaactgcggaaggcctcagggacctctgcctaggaaagccaggtattgtccaaggtttccccccatgtgatagtctgaaatatggccttgtgggaagggaaagacctgaccgtcccccagcccgacacccgtaaagggtctgtgctgaggaggattagtataagaggaaggcatgcctcttgcagttgagacaagaggaaggcatctgtctcctgcccgtccctgggcaatggaatgtctcggtataaaacccgattgtatgttccatctactgagatagggaaaaaccaccttaaggctggaggtgggacatgcgggcagcaatactgctttgtaaagcattgagatgtttatgtgtatgcgtatctaaaagcacagcacttaatcctttaccttgtctatgatgcaaagacctttgttcacgtgtttgtctgctgaccctctccccacaattgtcttgtgaccctgacacatccccctctcggagaaacacccacgaatgatcaataaatactaagggaactcagaggctggcgggatcctccatatgctgaacgctggttccccggctccccttatttctttctctctactttgtctctgtgtctttttctttcctaagtctctcgttccaccttacgagaaacacccacaggtgtggaggggcaacccacccctacacttccaggacaatctgcagagattttaaatggttcaaataattttgacagatgtaagaatgttatgctctaaaaagtaaaagactttaaagtagttttaataataaaggagctacagtgttaaggaaggatgatagaaagagtttagataaaattattttacaaagtatgaatgagaaaagacactgtatctgcaatttatatacatctaatatataattttaatgtgtaagtgagaaatgcttggccaggcctggtggctcacacttgtaatcccagcactttgggaggccaaggtgggtggatcatctgaggtcgggagttcgagaccagcctgaccaccatggagaaaccccatctctactaaaaatacaaaattagccaggatagtggtacatgcctgtagtcccagctacttgggaggctgaggcaggagaattgattgaacccaggaggcggaggttgcagtgagccgagatcgtgccactgcactccagcctgggcaacaagagtgaaactccatctcaaaaaaaaaaaaaaaaaaaaaaagaaaaagaaaaagaaaaaaaaagaaatgctcacacaaggttgggtctggtggctcatgcctataatcccagcaatttgggaggccgaggcagggggatcatttgaaggaaggagttcaagaccaacctaagcaacaaagtgaaaccacatcactataaatatatttttaaatgaaatgttcactcaggctttttactattttatttgcttttgctgtaaaatagagataatgccacttattctgtatgctagaagtcattactgaattagacataaaacacaaacagctcttagaaaacaatctataaaaataaaatcacactataataaatttaaaaataaaaaacctataaataaaatatttctacaatttttcacttagtaaataagcagcatagtgaagtggttcaagaagagggtatgggatcatgagtgcttgggttcagattagttacagtgttatgattttagacaactaataaagtctttctgtgctcagtttctataaaaccatgaggaaatattatgagttttcagttgtgcgattcatgtaaagccatcagtactgagcctagaacatgagtacaacacatggagccccctcctggctgtgtgctgggcattaagtgccaggggttaggtgttcatgagtgtgttaaacatgtcctttccttatgtactgcacctctcaaagaataggcagctccattgagagtgtgtctattattttaggaaattgtagctgaaaattaacatgatgcctcctcattctaggtttctcaaattgactcaatccatgagacatgtatcattgtattcaaaacctaatgggcattttgttagacaacaaatggtctctaagatttccaacaacaacaaaaaaaatttgaagcttctggttgagaaatctttaaaccctcccactggcacactccactaattccatttatggtagtggagtcagtgatttgaacgaagtactttcagtttcatattactctaaatccattacaaatctgcttagcttctaaatatttcatcaatgaggaaatcccagccctacaacttcggaacagtgaaatattagtccagggatccagtgagagacacagaagtgctagaagccagtgctcgtgaactaaggagaaaaagaacaggtaagaacttttactacttctcatcaagcagctttctctctagctccaaaggatctcagctcagtgatatggaacctataaggttgtggcagggatgggaaggaatttataaaggtcagttcattttcttaaacatcatcagaaccaaattaggctgcagatgagcctgaagtgggacgcaggtcagatgaaatcctggtgttatcagggacagcatggccttaagtgccactacagtgcttgtgttgaattaggcaccagtagacaggggctaaactgagcatttgaaatgtactaggatagtctttctctttgttgacattatctatgttgactagggatatgattacatttccatcgtcagtgatggactgaatcctgcttctatgcagctaagaaatggaagagttacaaacgggttcttttcatggaaggaaagaacagcaaatgagaagcagagtaagcagcccactgacacggttaaagacaaagaaaaaactgaaactcagcctgaaagatgaagattcatgaaaacagtatactttttattacacttgtgaactttgtttcagaatggattactttctttagaaatagtccagactcactaatttcctagtgcccactgatccctgtcccttagaagtgaaattcaaccccactgcttcactgaagtgcttccaattttgtcttcttttagtagagagcagggccaaaagtgtttcctctttaattctcctgtaatgcatctctacagaaaatatctttgcttactttaacctctccatgcactcagactactttgatcctgccttctgcaaagtcttcccctgaatgccttgtcaagacactagcctcattcatcacctctggtctgacagctcctctctctctctctctctctctctctctctctctcacacacacacacacacacacacacacacacacacacacacattcccagccccttatcctcctctccactcctactattcctcctctttctatttctctttctcctaccctaccaaatggaaaacagaacaaaacagaaatcctaaagctgtatcgctggaaatatattttatttgaacaacttcctaggtagctctctttatctgcctcttgatcttttaatccttattatctggaggaaacattcagtatttgcaattttgcattcataccctcagtgacttagaagctatcttatcgtgactctaatgaagcttaagtttcagggcccttctcttggacatgacccttaggagcccttggaaggttccctagccatgtgtttcacatggttgtatagttttataaaatttgcaaaagtatgttacattgttaccacttccagaatggcaatgtgagaagctttgtcaatcctcattgcagtgaaataagcataatcatttgaagatggaggaaggaacacatttaaaaatctttggaaatttttctaagggtaaacatcaaactatgaatactgattcactgtgttggatgtttattcactgtgagaattaataagtgaatcaatattgaattccttacatacagccaggatgcaaataaatcctctaaatcctattctatcttccattaattgactagtgaaaatatctaataagaatccaaaaagaaagttttccacaataaactaaatgaaatatttgggtcgtgagagtagttgagtgttgataagtcactgtcatgctaacatttttcataatgagctactttgacaatacttccataactttctcaaatgatacagattttgcctcatctcttttgctgtcacacacaaaacttttggccatactggggaatcttatgattctcccttataattgcaaaacactagaaattctcatgtatttcacctcttctcttgcagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggtgagtggcatgagcaaagctctgccaagtcccttctgtccatctacacagtcagcctccattatgaagatgtgaggagagaaagagatgaggatgaatactgaaagctaactttccattcacagtcgggctccttatcttcacgctgttctaggggataagaatcaattcattaattattcccatgataccttagtttccatttcaaaagcacaaattatgcctctcctaaaaggagtaagacagtaataaaaataattaatgtacataataataactataataaactatacaatgtttattacaatttttatgcaataacagagttcacagtgatctttaaggttgaaaaaatgtttcaatctgtagtggatattattttttgttgttgtaaaaaaaataaaatttaacctcgtaaccatttttaagtgtacagctctgtagcattaatgaaattcacattgttatacagctgtcacctccatccatatccagaaatctttcatcttgcctaacagaaactgtattaactaaacaaaagctccacataaacccattgcctgccatcattctacattctatctctatgaatttgactactacagaaaccttatataagtggaatcattcaatatttgtccttttatgactggcttatttcaattcatatgtcttcaaggttcatcagtgtgttagcatgtgtcaaaactcttcctttttaaggcttagtaattgtacgtgtatactaatttgtttatctcttcatctgtcaatggacacttggatttcttccaccttttgtctattataaataatgctaataggaacatgggtgtctgaatatctgttcaagtccctgctttcacttcttttgggaatatacccagaaggggaattgctggctcatgcagtcattgcatgttaactttttttaagaaatcactataccattttccacagtgactgtaccgttttacattctcaacagaaatgcacaagggttctaatttctctacatcctcaccaacattttttattttcagtggttttttttttttatagtggccatacgaatggaagttaagtagtatctcgttgtggttttgattttgatttccgtaatgactagtgatgttgagcatcttttcacgtgcttattggccacttgtatatcttctttgggagaatgtctattcaagtccattgttcatttattaatctggttgtttatttctgttgctttgtaaatttttttatattttctagatatcaatcccttatcatatacatgtttagaaaccattttcttacattccgtgtgttgccttttttaactctgttgatagtgtccgttaatacacaaaagttttaaattttgctgaagtcccactaatctattttttcttttattgtctatagttttggtttcttattcaaaaaataatttccaaatccaatattataaaacttttaccctttattttcttctacaacttttatagtttcaactctaatgtttggttctttgatccattttgagttcatatttgtaagttataaggtaatagcccaactttttaaggagatatatcatttcctcaacatcatttgttaaagagactctcctttcttcattaaatgatcttgacacccatactggaaatcatttgaccatatatatcagagtttattcatgggctgtcttttctattctattggtttatatgtcagtctttataccagtaccacacatggttttgtaatacgtttcacaactcagaaactgtgagactccaactttgctcttcctttttatttttataattaggggatctctggaaatttcatatgaaatttatggtggatttttctatttatacaaagtaattggaatgttggtagggattatatcaaacctgtacatcactttgggtagtagtgacatcttaagaatattaagtcttccaatccataaacacaggatgtctttctaataacttatgtcatctataatttctttaaagggtgtttgaagttttcactctacaagtcttccacctgcttggttaagctgattcctaagtagtttattcttttgatgctgttaaattggattgtttccaaaatttccttttctattttttacactagcaactgatttctccatattgactttgcatgctgcaactttgatgaattgttttaatagttctaatagttttttgtgggatagttaatgttttctacaaattagatactatcatcagcagacagagataattttactttttcattaccaattaggatgcctcctttatgcttctcttgtctaattactctggataggacttgcagtgttctgtggaatgcaattgacaaaagtaggcatccttttcttgttcctgatgttataggaaaagctatgacacttcatcattaaatgtgaagtgagctgtgggttttcaatatatggcctttattatgttgaggtattgtctttctatttctactttgttgattatttttatcatgaaagcctcctgaatttttccatgcattggatattcaaatttcctatttctttgattgtaagtaagtaaggtgaatactgattgttgtttcagttctctctcttaaccttaaaatacgctaccttttccttcagttgctagaactgcctgttactaaatccccatctctggtctcctctctcccttgcaggcttctctctgggctccacggtgcagtctcacactaaaggaatctggatgtggtgtgtgccccaccccaagaagccaggccacatcctagttctgctggacaccgagggtctgggagatgtagagaaggtgagactcaaggatccagttgtggagtaagcccctcctctctgaatattttatgcagcggttaattgtttattaactattaactacaggctgtaatatgtgtgggttaacacagatgcataaagggagcacaaataatcccagtgtcataagtcttatcctgcacagaactttagttaagaatttgggtgctaaagccatgtgactttgtatttaaatttaaattctgtcactaattcagtagcctgagaaaattgacttattttcgcctcagcattctaatctttaaaatgtatggaaaagacctatgttggccatatagtattattttgaatatttaataagataatacattacaggtgtatattaattattcaataaaatagcaactaatagtaccaatcttatatgtgaattctgttattgaaaaaaagaagagaaaattttaaatttacattgtactcaggccttaaaatgcccaccaaccttgaattttaattttacaattatctgttgatgatcattagaagacctagtaagaatcatggtaacccaaaaacactcgtcgaaaaactacccaaaagccacatcctactgagaataatttttgtatttgtcttcctttaataggtcattagtgttaaaaaaaaaaaaaaaaaagaaaagaaaaaaaaaccctctaacatatgaacatagttttactactgttactctgaaaagtgctgcgatgatgaaacttgctcctgactccagtgtgtcttgacttccagggtgacaaccagaatgactcctggatcttcgccctggccgtcctcctgagcagcaccttcgtgtacaatagcataggaaccatcaaccagcaggctatggaccaactgtagtatccttttgtgacccagaacagcaccaaggtcagaggggacacctgtattcatacaccagctgcctgactgtgaatcctgatgaatcaagctcaaaaggagaaaacaaaaaataatgcaagtacagaggagagatcccatgtatccactttagaactgacactgacacttaggttaggagcaaaggaaaatggaaggtttgggtatgtgttgaactaacatgggatgaggtccctgttcattttgtcacatttccttagttagctactcagctatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaacagagagcttcaactgataaatgaggatgagaaaacacaagaaattatcatttttcagtttactattgctagttttccagcatttgcagttttctatgtcttcagctggctattcctagaaattaatacttgctgaatatccaaattaatagatgttattttaaattacatttgtcattgttctagaacaagtttcttgttctttcacctttgtgtatgctgtgattaggttaattttatctccctgcctagggtttgtgatcttctacttagccatagagtatggagtacaatggatatttatttaaagaacatagactaaaacatgaaccgtgtgctagtccaagcattggcaaactacagcccaagacaaatcatggcaaatcctgcctgccagctgtctttgtaaataaggtttttttggaataatgctatgcccattcatttacatattgtctaaagctgttgtcatgcttcaataacagagttgaatacttggaaaagagaccatccagcctgaagagcctaaaatatttactatttggccctttacagaaacacttatattaggcaattttataattttttaaatgtttttctaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtaagtccccttcctagtacttctgctcattgtttaagactagaggagcatagaataacttccacctagtttcagcattgaaaaatcccaatctactgctatatttgtgttaaattctagatggcaccaatgtttctaacatatattgttagtcacatttccagtctaggaaaaggccaaaggaaaaaagttctattgcttgaaattgccctagtgaactggacctgcactatgcaatagagtagcccctagacaagtgtgtctatgtaaacataaatgtaaataatttaaatagggaaaatttaaaagtcaattcacatgcctgtatttcaaggactaatatttacacgtacttagtgactagcacactgaaaagcacatatacaacattcccagcattacagaaagcgcttttgaacaatactgcaataaaataaactaaatggatgactcttttttattggaatagtgtcatttgtttcatacatattgatcaaatgcttactatgaatagactgaagatacagatataaatgaaatagatatggttcctgtcctaatgttggttggggttaaaatggatgcaaacattcaattaacacaagtctatgtaatctagtacaagaactctcaaatgttggtatgcatacatatcttctgaggatcttaccaaacacaaaagtctaattcaatagatctcggacagggtctgagagtctatttccagcaagcttccaagtgatgctgaggacattgatgctgtgaggaaaataggtggtatttgacatgctcagaattacatggaatagagactttctttaccaccagaaacattatcatttgttcttcatatgcaggtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaaccctccaggagctgctggacctgcacagggacagtgagagagaggccattgaagtcttcatcaggagttccttcaaagatgtggaccatctatttcaaaaggagttagcggtaatttttgtctcaaatgtatacggtttagggtcatagaagctaaagtaccacaaggaaagaaaactattatttattttgacggaagtaattcctcctagcttccataatggtgaaaacaacagatttgtgatcacatcagtcagaaggaccaactgtattattacagacccaaagttctaaaacattttttcctgaataattttccctttacttatgcatacaactgacaaccagagcttctaataaaattacctgcccactcttctcagactgatttgatattctagccaaacacaaagaaaattttcatcctacttatcttgagcaggcttccgttcagccacatttattccatatgaaatcattagtccaatatgcaaaaacagagttttcctctaacggttgacataaagctatcaatctcggtcctgaacctcacctccaaaaagaaagcgacttcagtagaaagtggggtcagaaggaagagtgtggtcctggtgaggagtctgtcaatttctccagcgtcattgacttttattttcagaagtcattcccgaaattctgaggtcaagctaacatcctttccctgttactctttttacttcctatttttacattaaaggcccagctagaaaaaaagcgggatgacttttgtaaacagaatcaggaagcatcatcagatcgttgctcagctttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggtaaccaagatttatctgtcaattatggaaagctgctgacctgcctcctacaaacaccaaggtgaccaagcttcactgcatacagatgtgcttttttgtttgcataacattcatgcttttattcaataacatatgcaaacaggctgttataccagatatgtcctaggtgctcatcaaagagagtgcagtcaattaactattaagttataaattcaattagcagatgaagcacaaagttattattgtcatcattacagctgggcttttcctgttgcaagagacaggaacccaatgatggctgcttaaacaaaaatgtaattcattgatttaggctgcaaactggctttacaggtcaggtgggtctaaggtttcaagtaacatcatgaactggctctctgtccagtgttcccccatccccacagttttctccctcccaccatccctctatctgagtcactctgatatttgctttctcaatgatggcttcattccccagcaggctcagcccatatgggaccacagcattaacagttccaaacttagagcccttaatctaaacaggacagagactctccttttcccagtatctatattagcctactaaaaatgactgctaagtaggatgttctgatcggcttgccaggagcatgtgtctgtcgctccgacagggaatttgaccaccaaggacaatagggccaagagaaagaattcccagaggagaaaggatggcaggaagacaaacaggaacacctgcttacagccatttcctacttctcactctgtgttctctgggtcctaaggctgaagagattctgcagacatacttgaaatccaaggagtctatgactgatgcaattctccagacagaccagactctcacagaaaaagaaaaggagattgaaggtgaggagtgagttaagagattagatggcctcaaaagctccaaaaattgaaataacttgactggataaacatgggaccctttaactagagcaagatccacaaaggtgtgtcttacttgccgaggtcatctctgagtagggcatatgcagtcagcaacaacgacaggtaagtgtataaggaagaatgaggcaacaagataaccccacacaaatttttcttctgccttttcctcctcagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggtatctaattgcatcaccttgaggtttctctgttttctctccattctccctgatcgcaaacttagtgtggcagagagaacatgaagcccagggtaaggaccctgcttgcttacttgtacttttcaattcctgtctgtccagcctgactggctactgccaagtctggtcactgaaagttttttatttgcagttgtgtaacattcagtcctttatcaatatatccttcatttcaaggaagctattatctgctaggcatcattaaaatatctgtatctcggtggggcattgtggctcacgcctgtaatcccagcactctgggaggccaaggcgggcggatcacgaggtcaggagattgaggccatcctggctaacacggtgaaatcccgtcactactaaaaatacaaaaaatttagctagatgtggtggcgggcacctgtagtcccagctactcaggaagctgaggcaggagaatggagtgaacccaggaggcagagcttgcagtgagctgagatcgcaccactgcactccagcctgggcaacagagcgagactccaaaaaaaaaaatctgtatctcttgcttaataacatatgtagcaagaactatatccttattacttagaagaagaaacaaaggttccaaaaagaataaataattaagttcacacagctagtaaatatatcagagctgtcttcatcacttagcggaatccacaatgattatttgtttctgtgacacctactatgaaattagatttaagaaacctttatgagcagaaaggctcctaaccctcacacctgtgtgatactctgctaattctgattatttttaatgtcctgctcccagtttgttttgagttgtgagctatgtgcagaaactcagtatggtcagtctggcactcagatttcttacctgtcttctgctacccctgacaccaaggtgtggcagcttagaccaaatttcctaatccatgattcatacaccttatgagattttgaggatactttgcttatttcggtgttatgtcatatacataatagggtaaggaacatggctgtgctttggtcaatgataggccaaagtatgacatttacgtcttgcgtgactcagagaaaattaaataacaaatcatttaatgtggaaaccagatagaatgtttcaatttgcctgatgctacactttactcagccttcgtttgtccctttttaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaactcttaacactcatacttgaaaactttctgagtttccccagaagagaatatgggattttttttgacatttttgactcatttaataatgctcttgtgtttacctagtatatgtagactttgtcttatgtgtgaaaagtcctaggaaagtggttgatgtttcttatagcaattaaaaattatttttgaactgaaaatacaatgtatttcactaggcttcttatttctgattttcttttttgcagttatttttatcagaaaataaggttttactctttatggcaatggctggtaatcttttctgtaaaataccagatagtaacgatttatggctttgcaggtcatacagtctctgtctgaattactcagctctgcatgtagtgcaaacacagccatagaaaatacataaaccaataggtgtggctatgttccaatcaatttttactttcaataacaggatggcacccataagccatagtttgcagaactctgttttacagaaacattggtcagagttttatatacctgcattgtgttactcacatgtataaaaatcatatggattagactatatatattacaatcttgaaaaaactatgcggttattcaaaataacacagtgagaaaaaagcaaggaagcagctaatgccattaaatccacattaataatcctgtctttcctaattgctttgaggccttttgttaccttgaactacctgtgatccaatcacacggcaaatgcctcctttcacaatagagcatggtgctgccaagcactgtttcttcacttgaactgaaactttatagaagaccaggtgagaacacagaatactagatgaaatgttcatgtagatatgctttatattttcttccaagctccattgctacaaaggtgtaaataaaatacatttttatgagttgaagtaacttcacagtagaaaagaataactctgccattaaaagcaaataatggtttctttgtaaaccaataaagtataagaaaatgaaaaatcagcaaaattaagttacttcctccccagtttggtagtattaatatttagaccatattctggccaggcgctgtggctcacgcctgtaatcccagcactttgggagaccgaggaggacggatcatgaggtcaggagatggagagcatcctggttaacacggtgaaaccctgtctctactaaaaatacaaaaaattagccgggcgttgtggcgggcgcctgtagtcccagctactctggaggctgaggcaggagaatggcgtgaacctaggaggcggagcttgcagtgagccgagatcgcgccactgtactccagcctgggcgacagagcgagactccgtctaaaaaaaaataaaaaattagaccacattccaaaccatctgacttggtttagtacttttctctaacatatgccagaacagaatcaagctctctccagggaggcatgttgctttcccgtccttaggccctccaatggcgtgcaagggtgcaggctatggcgagtgtggccgaacaatcaccaagctcctggatggcatgcttgggtgccagtggcaggtgacctgggcctgctgtcacacttcctgatgttgtgggcacacgcccgcagctacagttgaggcagcatgatccccaggccctgggcaccatgtttgcgtgacgggtggtgtgagagcctgtcctcaggacacagaactgcgtctgggcagaccagctccaggaccatgggaggcacatgcagatgcttggtggccctgcttcgggtggaaagttgagagggttgctgtcggtggcagtggccccgggcaagtggctttcagaaactgaggagtgtgcatttgggctccctttgtcctgggggcagtctccctggtgtggtgcactgcctgttccttactgcaccactggattcagcccacgggacaaagttgcagccctctgggtggaaatgaagagatgtccgcagggctccagggaagtggagatgctggggctgttgggccccagagcaagatacagtctgatgggggctgggctttcaaaatagtgctgcgcggcagctccttgagtcttgggagtgtcagttacctaaagcaatgcaggccgtttgcctgattgcaatggaaagccaaacaaggaagcacaagggttttgtagagggaaaggtttatttttattcaactaggaaggagatgggggaaagcatatctaaaaatttgtctctcagatctgggggttggggcaggttttatagacagagggtaatgaggtaagatctgactgcatcgtgccatgaggtgatgtcagggctggatctgatcagatcacagattaagccctgaggtgtctccttcttaaatcagccctgctccttggtccaagtacttaggttccaccgtggttgcatgcagagtgtgtctgggcatgctcaggtaacataacttgaaaccaggagtccgtggcaacagtaaaacaacgcattattttattacacaaacttgaaccacattgggctggttctgcattttcaaatcccccttttttcattgttcatttctcaatcttgagggagaatgggtgacagacactctggcacttcctgctgattagggcacagaccttggttagaggtataaaattatttagcacggtgttgtacgacttccctgatatcagggttatgtttcaaaaggagttgtttgattcaattttaggaaaatgcataaagtgttagcaacttaaacattatttcttccagagaacagaaagaatgctcaggtttaatagccaaagttcccacgcaggttcccaatcaggtctgttcattcaattgagaattaaaactccaaactcacttagttctgattggtcaacccagctgagttctaatgggtcaatacagctgagccctgattagcagaggcaggtgggctgaaaagccccaaaataataaggtatgtgttttgggtgaactcagaacatgtgtgtgtcccctcgttagcaaatggtcccttggctcaacttgaaatgcaggcccagttagccactcaggatgcatcttgaaagactggctcaaacttgttggcagacagcactgcattccatcacggcatggaagtgattagctacgtgcttcaggtttatctggtctcttctagggatcctggtggcagagcagtggccaattgagcaactagagccatttacttacaaaaggcactcaggtacctgttagattctaatcaaagtctcgtaggttatgttgattctggttcctgtctggagtaaatttaaaatttcctgggttaggtcagcatgatccaagcctcttgcagatatctgttaaaacaggctagaagagctgggcgcagtggctcacacctgtaatctcagcacactgggaggccgaagtgggcggatcacctgaggtcaggagtttgagaccagcctgagcaacatgaagaaaatgcatctctactaaaaatacaaaactagccgggtgtggtggtgcgtgcctgtaatcccagctactcgggaggctgaggcaggagaatcgcttgaaccaaggaggtggaggttgcagtgagccgagatcccaccattgcactccagcctgggcaacaagtgtgaaactccatctccaaacaaaacaaaacaaacaaacaaaaaaaacaggctagaacaattcaaaagagtacccaaatgattagcccaaatagaaggatcattaagatctgtaggatggaacacagaaggtatcctagactagagacaaaagccagctgaaaatatctggaaattgtaaattcaagccaggaagtccagccaggaggctttttgaaggtgtcccattcagagatttagctaactttaggatcttagatgtgtccaattcaatctaactagatgtatttacccaggtgcagcagcaaatgttagcaacagcacaaacatcaccctgtacagcaagaagacagtcgaaaacaatgtagttgtctaggaccacatgagcaagggagtttgggacttctgctgtgctctgatggtttggccagtggagcagtcattctattaacagtacaagatttctgaccatattctcattccaagcagggcatagtccaaactcggaccccagtaaccttcctgatctagctgcttcactagagttaatccttctgggtaaatcacatctttggtaatatccccagctataatctaagagattatcattggtgttcagttgtgtctccaagactctcaggtagctctttgggtagcagtggtgagactagctgaatagattaaaaattgggttattcatttctgtagccaaatctcctggtgaggataacttaagtactatttttgccttttgggagaaggaaatatgggcctgataggtttctaagaagtctcttcaggctgaagtgcttcgtcactatttctttatcccaccaaatattcccttatcagaccttgaaaccccatctctcccacatcctgtttgtcctatattcttaaaattcccacatgaaacaccttctttccgtgatgattgatggtgtgttgtttccatgacctaatccagactgattcaccaacattttttataagaataaaattctaatacagaatgattccaacattcccgaaagtgttcactgttctgtgcccctacacttttcccacagtatgagtactgggtaaaaacagatgagtgatttgactagaagatggtgtctataaagccatggtctgatgacattgatttagatcatttttattctatacagatacacaatgctatgtaacttcttcgtatattctctcatcctgaaaatatgttttataaatatgtatgaaatttcaaaacaggcctggcatggtgcctcatgcctataatgccagcactttgggaggccaacgcaggtggatcacttgaatctaggagtttgagaccagcctgggaaacatggcgagaccccatctctacagaaaaaaataaaaataaataaaaaaaattagtcagaggttgttgtgcacacctgtgttcccatctactcaagaggcttaggcaggaggatcacttgagctgcagaggcagaggttgcagggagctgagattgcacccctgcactccagcctgggtgacagacccagactctgtctcataaaaaaaaatcaaaacagaaattatgaaaaatattaatgatagctacataaaagatcacacattcacaccttattacaaattttatgctctggaaacctttttagaaagaacatatatttaaatatcatgtttacgaaatgtgttgatatttaacacttaatggaaagttttaccaaattttcagtgttcaaaataagataagacttctatgtacattatctcaattcagcctcacaaaacaatatgaattggatattgatgtgctcattgagaagatgatgaaataaggcatagaaagttcacaaactgaggagtggcagagatgctagcacctccctctaggggcaatgccctgcttttcctctattattcctcatgtgacagagctcgaagtgacgtagataacatacccttcttccttcttatctttgcttccaaatcatttgtcctctttctttagcttctaaatctcctggaaacccacaaaacaacaaaacacataaagtgaaacacatgtcatcaggctatattactcacgactcccttgctctaggtattctggatctcccaacccctttattcactgaatattttagcacctgactcttcttctctttaccactactcttgttattaacctttgggactttttgcatgtggtagacaagcatctaataccccagcctctcagctacttgacctctgagaaagtcttttctatcatctcacctcagcttcaaccttttctttaccagtaactaaacctccctccataatctcaatatcaagtgtcccacacaattagcccctctcatgacctgcctgttccatgctgatatgccgaattgtcgattctccattctcatcttatgttatgtctcagcaatatgacaaagataatcatcccttccttcttcaggcatttcatatttcgggctgcttatgtagcacacagtctttgtttttctctatctcattggccattctttttcaatttccttttctgaattcttcctacttcttaatttctaaatattatagctcttcagtttttgagcccatttttttctttaatccactgtcttggcttcagcaaatctctattcaacatgtccaaatttacggctctaacttcactgcctgtttagcattcccacactgatgtccaataaaaatctcaagttttacatatccaaagcaaaactcttgatttctcctgtgatcctaaacttcatcctcccacagtctcccctatcttggtaaatataattcctttaaccccatccttgatccctattttcctctctgtcctcaaaatcaattcaacagcaagtcctgttagctctaaattggaaatgcatctagagttgaatagaacctcaccctttctagtctaagtccatattgtcattcacctggaattccacactagactcctaatttactgtgttcacttttgcccttctagatctactccagtcttggtgacttttacttttttaaaaataaaatgaaaaacaacataaaaaaggaataatagctaaattataatcttacagtggatgatttttgagaagtacatctgttctcacactatcatgtaaggaacgaattcaaggaactaaattttggcaaataccctcagaatcttagtcatagcatcatccaaatttccatcttgctagcccatgtgctctatcgcttgcttactctctctctatgtgtctctctctttctcattagctcacacactctctcactctctctctctcctcccctttcttttttatctccctctctctctcatggcttgctcatactgatgaaggaagttatcatggcagaaatctcacatggcaaacaattgaggatgacctttagtcgacagccataaaggaacagaggactttagtctaacaagttaatgataaaatgaatcctgccaatgaccatgagactgagtttgaggagtggattcttccccagaaaagccttgagatgtctaaagcccaggaggcactttgattgcagcctgtgagaaaccaccaagaagacacagctaaaccttacctaaaagattcttgtgaactttagaaaatatgagacaatcagtgctgtttcaagtcactactttgggagcatatttcttatgcaatagcagatactaacacagaaatgttacctgacttggaacatcacagattgttattgtctgctttttgtctttatataaactgaaatatataccatggtttgttttttgtttgacttctttaactcaatattatgtgttaaaattcatgcaagcttttgggttctgtaataatatttcactatagataactaggagtggaattattaaacatatagtatgcatttttcaccttatagtagataatatcaaatagttttttaatacagttgtcatcatttatactctcaccagcaatgtgtaagaatttccaatgctgcacactctcatcttcacctggataggtcagccttttgaattgtagtcatcctagtgggtacatggagattttattcacagtctaatttgcttttccttgagaatgagagataattaacgaagttgagcccctgttcatgtccactgttcattaggatatcttctttgggatgagactgtttaagacttttcttctatttctagtgaattgtccttttttctttacttggagactttttcacatattccattcatgtgtgtatacatatttaattttttaaatctttagtctttttttaatctttgcctttcagtctcttcattgtatctttggataaatagcagtcctcaattttaatagttaaaggtattgattttttatttaaactgaatagttttgtatcacatttcccaacttggaaaacctgaaaataatgtctttgacttttttctaaaagtttgattgttttgtcttccacaactatatctataatccatctggaattgatcagtttttaatgtcaggagggtagaaaccacgtttaattactttttaacatgtgtatagtaaagccctaatgatggcagccatggcccatctagagtggctgctgccatgacactggcttcactggggaggtgtggccagggttgcatgctccatggagccggagggagccagaaacaggtggaaggccagcccgctcctgagttggcagggcaggagcctcatgctccctgggcgcagctgcagctgcccagccatggctccaagcctggacatccctgtgctcttgaggagtgggagcaggcatgagctccaggcatagctgcagccacccaagctgcagctgcagccacccaagccgcagctgcagccacccaagctgcagctgcacacccaggcatctctgcactcccaggggcccaggaagtccctcttgtcccagcaggcttggaaatgcctgctcctgtttcctggcctctctctgttcctgtgcctgctctgatctggagcaaaattgaggccaagactaggtactattgcaacctggccaggtgtgcacacacttagggcagccctgacacactagcccctgctgccttgtccccgtctagactttgtgcaccaccgagcaccagagggaggctgaggccgggctgagggcagctcaatgctggcttataggcacccctcagcagtaaaagcctgggttacataagcagcagcaggaggcagacaggctccagggtggaaacaggtaggcccttggtgaagccccaccttcaagccagggaaggcctgaagcctgggagctgggctgccagtcctgcagactagagtgggaacttatgttgccttttccaggcccacccatggccacccatggaccaatcagcacacacttcctccccgctgaagcccataaaaaccctgggctcagccagacttgaggagatgacagaatgacctgcctgtggagaggagctaccccctctgggttctcctctctgctgagagctgagcagacattgggactaccagctgcagataggagctacctactccagggtctcctctctgctgagagctgaacactcatcaggacatcccagttgaggagagaagctacccactgtgggtttcctctgagctgttctactgctcaaaaaagctcgtctttatcttgctcaccctccacttgtctaggtacctcattcttcctggacacaggacaaaaactagggacttgccaaatggcagagctgaaagagctgtaacacaaacaaggctgaaacaccccccttgctcaccatgttgtgggcaacaagaaggagagaagagagaaggagagaaggagagaagagagaaggagagaagagagaaggagagaagagagaaggagagaagagagaaggagagaagagctgtggccctttggggatcccagacctagaagttccccaagccagggctgtgataacctctttggggcttcacactttctggtgattccaagcttctgggcaccaccgcattccctggtgccagccatggaagctgcttatggttcgcctggtccagtttcagcctcgcagggagccagcgcccatgccagtgcctggagctgcccaccctgccacagccagcatgcctggctatgagcagtggctgggccccatgctcactcattcacacacccctccccactcagctcactcttggcaggcacgggatccaggagggtagcgtaagccaagcgcagcctgccagactgaaggggtgaaacaagcccagtgagcccaagaaaaactcaggcaaaggatccactggccacagaggtttccagctggtgaagtgataacccaagaatcccatgatactaacaccgtttattgaaaagattatcctttcactatagtttctataaatcaactcgttctatgtatgagtcttgcaattacattcaatctatagataaatttgtggagaaatgagattcataaaataatcagtcttccaatccctaatcatgacatgtcctaccatttattagcccttttaattctctcagaaatactgcatagttcatggtgtatagtccttgcatattttgttagacttatttctagatattgttagatgacttaagtaaactactttggagcataaatacacatgtagaaaagtgggcatcataaatatatagctctatgtatttgcacaaatgaaacatatccagaatgccagcactgaaagaaaattcagaatataacagttgccatgaagcccttgtcatgctcccaagcagagactaccaccacctcctaagctcatgaagattactatcctgttttggtactttatataaatgaaatcataaaatatgtattttttagtatccagtgccctttactcaatagtagattgcgtaaatataagattgagtaaatgcaagattggtcaatatttttgtgtttagctgtaggtcaattattctcattgttgtatagtatttatttattatatgactatatcataaatcatctattcaactattttttttgaggaagagtctcaccctgtcacccaggctggagtgaagtggcacaatctctgctcactgcaatctctgcctcccagtacaagcaattcttgtgcctcagtctcccaagtagctgggattacaggcgtgtgccatcacacccagctaatttttgtacttttagtagagacagagtttcactatgttgcccaggctggtcttgaactcctggcctccagagattcacctgccttgacctccctcccgaagtgctggaattacaggcatgtgccaccacattcagccccactcaactcttgatgaacatttgagtactttcacttttatgtctattacagtagtgttatgagcattcttgtgcatatcttttagttcacagatgttcagttcttcgtgtgtgtgtatttagaaatggatttctataaatgtatatgttcagctttagaagatactgtcagtttcatagcggtactaagttatatttacatgagtactatatgaacattctaggtgctccacaagctcatcaagcctcaatatagtttgccttttttccacttggcagatgtgtagtggtaacacattgtggtttttcatgactcatatatttaataattttttgactcagtagtgttatttacagaccacattcttataatcttattttacttttgttaagaaaaattatgttatctatgtatggatgtatctcttcatttttctcttcctctttatttttcccattctttcctttctctctccctctttccttcctccctttcctccctccctccttttcatcttcctcttttccttcctttctaagaaaaattttaagttcaggagtacatgtgcaggtttgttaaataggtaaacttgtgtcatggggggttttagtgcagattatttactcacccaggtattaaacctagtgcccattagttatttttcctgatactctccctccaccccaccctccactctctgatagggcccagtgtgtgtgttcccctctgtgttctcatcatttagcctccacttataagtgagaatatggggtaattggttttctgttcctgtgttagtttgctaaggataatggcctgcagcaatctcttaatattctttcccacataatcatttgtatgtgtgtgtatgtgtgtacttgaatagctatttaatatggatacaacatttgtgcttttgcattgaaacgtatggaggcaggccaggcatggtggctcaagcctgcaatcctagcaatatgggaggccatgggagatggattactagagcccaggagttcaagacatcttgggcaacatgccaaaaacccttctctacaaaaaatacaaaaattagccatgtgcctgtggtaccagctacctgggaggctgagataggaggatgattgagcccaggaagcagaggttgcagtgagctgagatcatgccactgtactatgcctaggtgacagagcaagacaaagaaggaaagaaagaaagaaagaaagaaagaaagaaagaaagaaagaaagaaagaaagaaagagagaaagaaagagagaaagagagaaagaaagaaagggaaagaggaagggagggagggaggaaggaaggggaagggaaaggggaaggggagaaggaaggaagaaaaagaaaagaaacatacttaggctgtttttagtgtttcagtttgtctaagatcatccctattttttgccaccacctcatctcttgttcatcttccagtgcttatatcaaagccaaaccaggagtcagtctccaggacattctgacttccacatgagacataataacaaacttagaacagtacaagaattctagcatgtgcctccattcccttccctgagaattcactttcagagctgactttatttgctaatgcatgatggactcatttgctctgctaaaatcaagtattggaacaaaaacaaaatactcactcaaatagctaaactgcatgccctcccaaaagaaagagtaggttaagcagacatttcccttatatttctatgacgtttgggtggttttccagggctagctgagaaaatgctgtgtcaccgactgatcccttccgatatgccttttccaatcatgatgaagaagacctctcagtttggggctggcagtttaatctgagatagagctggacatggtgcctcatctatccctcactcccaagtgtaagacaattgaaacagtacattcgagcgtaggagattttgttaaagatgtgggcgtggaaagtttgttccccaagatttctttgatctccgggaggctgagacaggagaatcacttgaacccaggaggcagacgttgtggtgagccgagatcgcgccattgcactccagcctgggcaacaagagcgaaactccgtctcaaaaaaaaaaagatttctttgatctcgtaacctggaggagaaccacaagccttcactccacaatagcccagcccagcccacttctaccttgctagttcccaacagtcctctcccatgttctatcctcttccctctactcactatctggtttttcaaaacaaacaaaatttctttcacaaagaaatttaacagtcattttttcttgcttaggtttctgctgatacttaaattcttggagtcccatctctgtttcaacagtcattttaaatctgcttacaaatacacatatttccctttctatcagaaattttgggacaagacactaatacatataactttttttggcatttttataatatgccagcccaataaccgttctgctacaagtaaaaaaggaaactgtataaaacctgtgagagttccaaatagtgcacagacacagttggtttggaaactctacagcaaaatagatgacacatacacacacaaaaaaaacagaggcatgcagcttaaattaaattatgtatttggaggactctgaggtttaggtaccaaggttttatatttttaatcaggctcttcattaggaaaaatagctaatgcatgctgggattaatacctaggtgatgggttgataggtgcagcaaaccaccatggcacagatttacctgtgtaacaaacctgcacatcctgcacatgtaccctggaacttaaaaataaaaattaaaaaaattaggctcttgttctgctagaatggaaaaggagtggatcttagaaacaagtctattatggggccaagcacagtggctcaacatctgtaatcccaacactttgggaggccaaggcaggaggatcacttaagtaccaaagtcccatttgtctatttttgcttttgttgggtgcattgctgaagtcttacccatagaatatttgcctaaaccaatgtcctgaagtgttcccccatgttttcctctagtattaatagttttatggttgcctggcaccatttatgaagagggtgtcctttcttcaatgtatgtttttggtctccttgtcaaaaataagttggctataatatgtggatttatttctgatttctctcttctgttctactggtctatgtgtctgttcttattgtcaagtcactttttagaaatctaaaatttaatccatttcacataagtgacatcagggtaaattcctcatgagcaaaagtttcaaatgttccaatttgtgatctgaggctacatattttagtgttcagtgcttttctcttcctattctctctaatcctttgattttataatttgggtgcaagtcactcttacccactggagtaagtcctactgagggcagtggttgtgtctaattagtcttcataccctcagcatccagcccagggctgtgcacacagagcgttgttctccttacacacacatgaatatggttcattattttcgtaacttgcaggtcatgcctccgttctatatgagactaagtaaccccagctgaatcaatggatctctgctgctgtgtaccctacagcatactgcctggagttctttatgtaaaaagcagcttaatataaaaatataccatacctgaaattcagagtcttctttatgtaaaaagcagctttatataaaaacataccatacctgaaattcagaatctgttcatgggattcttcatatttgggacaatctttgaaacactaagcatacatacataagttattgtataataatactaaattatgaattaatttgttctgtgaccatctattagaaggatacaaggattccatagactacaaaccaagtaaactggaaagtggaaatgttgcttctgtctacccaccatttaaaagaaaaagtccctagaaaatttttcaagcagtctcatgtaaaaaccaaatgcacaaaaactgttcccacctcatcgtaataaacagaaaagagcagttttcttaacatctaggctatctcccaaaaatgaagaactagtccctgcttccactttcaatctgacatgtgttcaaaataaaaacagtttcaagttgttctgaattgatatcagaaatccttcactcacaacaaaaagtggaagagagcctgagacttttcatttataagtactaatcagacttcacagttagaaagagtaaagagagagacatatagcaccagaatgtttcagtccaccttggcagaatatagaaccacctacgaacccaatttgatcctcttaaacacgccgattcatcatttgaagaaacctcaaatcaatcaactgtcagggccttgtggcctgataaactggtattaaaaagccattaaacagccgggcgcaatggttcacgcctgtagtcccagcactttgggaggctgagatgggcggatcacctgaggtcaggagtttgagaccagcctggccaacgtggtgaaacctcgtctctactagaaatacaaaaattatccaggcatggtggcacatgcttgtaatcccaactactcgggaggctgaggcaagagaatcgctggaacctaggaggcaaatgttgcagtgagtcgagattgtatcctgggctaccgagctagacaccgtctcaaaaaataaaaataaaaaaaagccattaaacatatttaaactgtatttactagtctttaaaatgcaaataatactacctacatcataagcctgtactgaagaatggaattaactaataacacctgtaaagaatttagcacaatgactaccatgtagtagataccaaatgcattttccttctatctaactcaggcttcatcgcctcaaggaagcctatatactacaagataaaaatgtggcggcactattcacaatagcaaagacttggaaccaacccaaatgtccaacaatgatagactggattaagaaaatgtggcacatatacaccatggaatactatgcagccataaaaaatgatgagttcatatcctttgtagggacgtggatgaaattggaaatcatgattctcagtaaactatcacaaggacaaaaaaccaaacactgcatgttctcactcatagataggaattgaacaatgagaacacatggacacaggaaggggaacatcacactctggggactgttgtggggttgggggagggggagggatcgcattaggagatatacctaatgctaaatgacgagttaaagggtgcagcacaccagcatggcacatgtatacatatgtaactaatctgcacattgtgcacatgtaccctaaaacttaaagtataataataaaaaaaattttttaataaaataaaataatcattatttactaaaaaaaaaagatagttatctaaatatatattctttttgagttgaaatgttaaaactgcttatttagaaaacatgtcattttatacctattaatggaggtaagattaaaaatactgattccacctggtgggggaggaggtgaaagacgtgataaacacttgaaggagtgggagggactgcatatatttacagaggaaaattctataacatatctcaaaaatcttgaaaatgagcataacgaaccaacatgttcacttccacagttttgatttattcaattaacaaatacttattaaaggctcattatgtgtcaggcactgatttgaggtgctagagaggattaagcagttagacaaaaaatatctgccttcaagggacaaaacattctagcaagtaataaacaaaaatgtaaaacatacagaatatcaaataaccacaactgtcatgaagaaaagtgaagcagcgataagggagcgaaagagctgtcaatttagaatatagcaatttgacacaggggaacagaaatagcatcaatgaggtggcagttcagggaagacctaaagtagtaaggggggaagtcgcctggatatctggagaaacagcataagtagcaaaaggaacagcaggtgtataggcctaagatatgaacatgctcagcatgtttgagagaggccaggagggacaggttacagagtgggtataccaatcccataaaccctgtaatctcttatgcagatacaggtttattacctaatacaacatgctataagcctgagatgagtccaggcctcctttgaactgcccagcactgccacaactgagatgagaagagagtttgacagaatgagtcagtgcatcacatgcatctgatacagttcaccccttcaccactctgatcactgtgccctacattaaactcaatccgttgtcaattcttcatgttagtgaccagctgcaatttataaaggacctaacacacaggagttaacagcacacgccccagacttcactcctgcaacttgtctcaaggccataattgatattcatcatctctctcttctaccatccattccagattttcctctcctggtcattgccaaaagcagttatcccatttagacttttttttaacttgagctgtgtgcttaaagcactccttctataagactaacacaaaaagaaaacataacttgaaagaaacagaattattcaacaacttcaagaaactcaccttattctctggtgaaaaattgaatgatttccgtaatacaagacataatctgaaattaaaaaaagaaaaacgagagagctacatggaatgagtaccatacgacacagtctatttacttataaatgatttctaaaaagtgcacgcgaagaagttccattccaagatggccaaataggaacagctccagtctacgtctcccagcgtgatcagtgcagaagatgggtgatttctgcatttccaacttagatacatggttcatctcactgggactggttggacaatgggtgcagcccacagagggcgagctgaagcagggctgggtattgcctcacctgggaagcgcaaggggccagggggtttccctttcctagccaaggaaagctgtgactggctgtacctggaaaaaatgggaaactcccacccaaatactgccttttccaatggtcttagcaaacggtacaccaggagattatatcccgcagctgattccgtgggtcctatgcccatggaggcttgctcactgctagtgcagcagtctgagattgacctgcaaggcagcagcctggcaggaggaggggcatccaccattgctgaggcttgagtaggtaaacaaagttgctggggaagctcaaactgggtggagcccaccacagctcaacaaggcctgctgcctctgaacaaaagtcagcaggaacttttgcagacttaaactttcctgtctgacagctctgaagagagcagttgttctcccagcatggtgtttgaactctgagaacggacagactgcctcctcaagtgggtccctgacccccgtgtaccctaactgggagacacctcccagtaggggctgactgacacctcatacagccaggtgcccctctgggaagaagcttccagaggaaggatcaggcagcagtatttagtgttctgcaatatttgctgttctgcagcctccactggtgacacccaggcaaacagtgtctggagtggacctccagcaaacttcaacagacctgcagctgagggacctgactgttagaaggaaaactatcaaacagaaaggaatagcgtcaacatcaaccaaaaaaaaaaaaaaaaaaaaaaaaaaaaaaggacatccacaccaaaaccccatctgtaggtcaccaacatcaaagaccaaaggtagataaaaccacaaagatggggagaaaccagagcagaaaaatggaaaattctaaaaaccagagcacctcttctcttccagaggatcacagctcctcgccagcaagagaacaaagctggacggagaattactttgacaagctgacagaagtaggcttcagaaggttggtaataacaaacttctctgagctaaaggaggatgttcgaacccattgcaaggaagctaaaacccttgaaaaaagattagacgaatggctaactagaataaacagtgtagagaagaccttagatgacctgatggagctgaaaatcatggcacgagaactacgtaacacatgcacaagcttcaacagctgatttgatcaagtggaagaaaaggtatcagtgattgaagatcaaattaatgaaataaagtgggcagagaagtttagagaaaaaagagtaaaaagaaatgaacaatgcctccaagaaatatgggactatgtgaaaagatcaaatctatgtttgattggcgtacctgaaagtgacagggagaatggaaccaagttggaaaacactcttcaggatattatccaggagaacttccccaacctagcaaggcaggccaacattcaaattcaggaactacagagaccaccacaaagatactccttgagaagagcaactccaagacatgtaattgtcagattcaccaaggttgaatgaaggaaaaatgttaagcacagccagagagaaaggtcaggctacccacaaagggaagcccatcagactaacagcagatctctcagcagaaactctacaagccagaagagagtgggggccaatattcaacattcttaaagaaaagaattttcaacccagaatttcatatccagtcaaactaagcttcatgagtgaaggagaaataaaattctttacagacaagcaaatgctgagagattttgtcaccaccaggcctgccttacaagagctcctgaaggaagtactaaacatggaaaggaagagctagtaccagccactgcaaaaacatgccaaattgtaaagaccatcaatgctaggaagaaactgcgtcaactaactagcaaaataaccagctaatatcataatgacagggtcaaattcacacagaacaatattaaccttaaatgtaaatgggttaaatgccccaattagatgacacagactggcaaattggataaagagccaagacccatcagtgtcttgtattcaggagacccatctcccatgcagagacacacataggctcaaaataaagggatggaggaagatctaccaagcagatagaaagcaaaaaaaaagcaggggttgcaatccgcatctctgataaaagactttaaaccaacaaagatcaaaagagacgaagaaggccattacataatggtaaagggatcaattcaaaaagaagagctaactatcctaaacatatatgcacccaatacaggagcacccagattcataaagcaagtccttagagacctacaaagagacttagactcccacacaataataatggaagactttaacgtcccactgtcaatattagacagatcaatgagacagaatgttaacaaggatatccaggacttgaactcagctctgcaccaagcggacctaatagacatctacagaactctttaccccaaatcaacagaatatacattcttctcagcaccacatcccacttattccaaaattgaccacataattggaagtaaagcactcctcagcaaatgtaaaagaacagaaatcacaacaaactgtctctcagaccacattgcaatcaaattacaactcaggatcaagaaactcactcaaaaccgcacaactacatggaaactgaacaacctgctcctgaaagactactgggtaaataacaaaatgaaagcagaaataaagatgttctttgaaaccaatgagaacaaagacacaacggaccagaatctctgggacacatttaaagcagtgcatagaggcaaatttatagcactaaatgcccacaagagaaagcaggaaatatctaaaattgaaaccctaacatcacaattagaagaactagagaagtaagagcaaacacattcaaaagctagcagaaggcaaaaaatataagatcagagcagaactgaaggagatagagacacaagaaacccttcaaaaaatcaatgaatccaggagctggttttttgaaaagatcaacaaaattgatagacccctagcaagactaataaagaagaaaagagagaagaatcaaatagacgcaataaaaaatgataaaggagatatcaccaccgatcccacagaaatacaaactaccatcagagaatattataagcacccctagaccaataaactagaaaatctagaagaaatggatacattcctggacacatacaccctcccaagactaaacaggaagaagttgaatctctgaatagaccaataacaggctctgaaattgaggcaacaattaatagcctaccaaccaaaaaaagtcacggaccagaaggattcacaaccgaattccaccagaggtactaagaggagctggtaccattccttctgaaactatgccaattaatagaaaaagagggaatcctccctaactctttctatgaggccagcatcattctgataccaacgcctggcagagacacaacaaaaaaagagaattttagaccaatatccctgatgaacatcgatgcgaaaatcctcaataaaatgctggcaaaccgaatacagcaacacatcaaaaagcttatcctccatgatcaagccaacttcatccctgggatgcaaggctgtttcaaaatacggcaatcaataaacataatcgatcacataaagagaaccaacaacaaaaaccacatgatcatctcaatagatgcagaaaaggccttcaacaaaattcaacagcccttcatgctaaaaactctcaataaactaggtattgatggaacgtacctaaaaatagtaagaactatttatgacaaacccacagcgaatatcatactgaatgggcaaaaactggaagcattccctttgaaaactggcacaaggcagggatgccctctctcaccactcctattcaacatagtgttggaagttctggccacagctaccaggcaagataaagaaataaagggtattcaatcaggaaaagaggaagtcaaattgtccctgtttgcagataacatgattgcatatttagaaaaccccatcatttcagcccaaaatctccttaagctgataagcaacttcagcaaagtctcaggatacaaaaatcaatgtacaaaaatcacaagcattcctatacaccaagaacggacaaacagagagctaaatcgtgaatgatctcccattcacaattgctacaaagataataaaatacctaggaatacaacttacaaggggatgtgaaggacctcttcaaggagaactacaaaccactgctcaatgaaataaaagaggatacaaacaaatggaagaacatttcatgctcatggataggaagaatcaatatcatgaaaatggccatactgcccaaggtaatttatagattccatgccatccccatcaagctaccaatgattttcttcacagaattggaaaaaactactttaaattacacatggaaccaaaaaagagcccacattgccaaggcaatcctaagcaaaaagaacaaagctggaggcatcatgccacctgaattcaaactatactacaagcctacagtaaccaaaacagcatggtactggtaccaaaacagagatacagaccaatggaacagaacagaggcctcagaaataacaccacacatctagaactatctgatctttgacaaacctgacaaaaagaagaaatggggaaaggattccctatttattccctattaataaatggtgctgggaaaactggctagccatgtgtacaaagctgaagctggatcccttccttacatcttatacaaaaattaattcaagatggattaaagacttaaatgttagacctaaaatcataaacgccctagaagaaaacctgggcaataccattcaggacataggcatggacaaggacttcatgactaaaacaccaaaagcaacggcaacaaaagccaaaattgacaaatgggatctaattaaactaaagagcttctgcacagcagaagaaacttccatcagagtgaacaggcaacctacagaatgggagaccatttttgcaatctacccatctgacaaatggctaatacccagaatctacaaagaacttaaacaaatttacaagaaaaaaacaaacaaccacatcaaaaagtgggcaaaggatatgtcttattttgagagaagtctcaaaagaagacatttttgcagccgacacatgaaaaaatgctcatcatcactagtcatcagagaaatgcaaatcaaaaccacaatgagataccatctcacaccagttagaaaggcgttcactaaaaagtcaggaaacagcagttgctggagaggattggagaaataggaatgcttttacactgttggtgggagtgtaaactagataaaccattgtggaagacagtatggtgattcctcaaggatctagaactagaaataccatttgacccagccatccccttactgggtatatacctaaaggattataaatcatgctactataaagacacatgcacatatgtgtttattgcggcactattcacaatagcaaagacttggaaccaaccaaaatgtccatctatgatagactggattatgaaaatgtggcacatatacaccatggaatactttgcagccataaaaaaggatgagttcatgtcctttgcagggatatggatgaagctggaaaccatcattctaagcaaactatcacaaggacagaaaatctaacactgcattttctcactcataggtgggaattgaacagtgagaacactgggacatggggtggggaacattacacaccagggcctgtcgtggggtggggggcagggggagggaaagcattaggagaaacacctaatgtaaatgacaagttaatgggtgcagcaaaccaacatggcacatgtatacctatgtaacaaacctgcacattgtgcacatgtaccctctaacttaaagtataatttaaaaagtgcatgcaatcctttatctttacttttcataatagctatattgtcatatgatatagttatactactgtccacaaatactgtccaatagaatgttgcaaacatccagaacgagtatattccactttctcacagaaagattgttttcaggtggcaagaaatgaaaacatttacaaactttcagggttttctataataccttcaactcataataatcgttaattgattagtatttgtccaatctcatgaaaaacttacaatactggactagtatttgggggtctggtttttttccaaatatttttatattttttgttttgattaattcattctactctattttgaatacagatgacacatttgtctttttttgattttggcttttttccagatagtcatgtaaaaatgaatcaaattcagcaaatagtttcatgattctcatgaaatatccattattccaggaatgtcactttcaatcataacctcatgtagaccaagcctcaattaaaatacaataattgccactattcattcaaaatgataacaaatgttcttcaacactttggtaagtgcttttatttgatttacattgaattaaaaaaactcaagccttcatatgctccgtggagtctttaacatattttgagagttcttctatattcactcagttggaaaaccatgccttgtaaataaatctgttcttgtaaatattatttaccaactaaacaccatatgcagacttttagttctgggatatgccaaccaagatctcataatagtttgaacattttaaaatttgtgaatagtgtttattatctcagggacaaatgcacgagtaggtagtcccaacaccgagtgctccagtccctcaccttaaagagcttcaagaatgacaccaaaggattccaccaatcctgaatcaaccttctatcatttcccagtaaagtagatgggcagagaaattcagatattaactactaatatttgcttcttaaggacacatatccatgttacacttgcaagaacaggtctaaagagtctgttacatattgttttccctccaagaaggagacacagaattccagctgttaactatgcagccataaaaaggaacgagatcatgtcctttgcagggtcatggatggagatggaagttggaagccattatcctcagcaaactaacacagaaacacaaaaccaaacaccctgtgttctcacttataagtgggagctgaataatgagaacacatggacacatggtgaggaacatacacactggggcctgttggggtgggattttgggaagggacagcattacgaagagtagctaaggtatgctgggcttaatacctaggtgatgggatgatctgtgcagcaaaccaccatggcacacatttacctgtgtaacaaacctgcacatcctgcacatgtacccctgaacttaagagttgaagtataaaaaaataaataaataaaaaactagaaaaaaagtctatggcctaagaaggactttacacaaatatactgtggctctgtaaaataatttctcttttttaagaaacacacactgaagtttttaggtataaaaagccattatgtctgtcactaacccttgaatagttcagacagaaagaaaataaatttaaaatgataacatatggggaactgaggggaagactgtacagaaactttgtactattttgccacttttctgaagtctaaaattatatcaaaataaaacttcataggacattataaagttgagaatgttcccttttgttctcagtgtgttgactgtgtttatcaggaagcggtatcaaattttatcaaatgcttttcctgtgtatattgagatgattatatggtttttgtccttcattctgttgacatggtgttttatattaattgattttcacatgttaaaccatacttgctttcatgggataaatcccacttcatataagtttggtatacttttgtgggatttggtttgctagtattttattgaggatttttgcatcctttttcataaaacgtagtggtctacactttaattatgatgtctttgggtttcatagcattgtaatattgcctcaaactgaatgggaaattgtgctcttctatttttggtcaaggttgtaagaaacttgtataaattattctttacctgtttagtagaagtagccagtgaagtcatttggggttatgcttttcttgtggtagttttatgattaataattgatatggtttggctctgtgtccccccccaaatctcaccttaaattgtaataatccccaagtgttaagggcaggaccaggtggagatcattgaatcacagggtagttgcttccatgctgttctcatgacagtgagtgagttctcataagatctgatggtttcataaggggcttccccatttgctctgctctcattctctctcccgccttatgccgtgattgtaagtttcctgaggcctccccagccatgcagaactctgagtcaattaaacctcttttctttacaaattacccagtctcaggtattttatcatagcagcatgaaaatcgatgaatacataattcaatctctttacttgttacttttactcgatgatctatttcttcttgagatagttttggtagtttgtgtctttctaggaatttacctattttgtataatttaatttgtggacatactgttgttcatagtattacttacaatcttttttatttctgtaaagtcagtagtgatgcctcctgtttccttctcaattttagttatttgagtcttctgctgtttttcaggattgttttgttttgttttgtttcattttggccagtctaactaaaagctttgtcaattttgttgatcttttctaaaaacagcttttggttttattgactttctctacttttttcttctattctttatttcattggtttctactctgttaatttccaaaacttttcattttcttctttctgcttgcttcagatttagtttggttttttaccagtgtctcaatgtaaaagactaggttattgatttgagacccattattttcttagtaattgttctaggcattatcatatacataactcaccaaaggatgcctgaaatttatgccaaattaattcctgtgagatactgaattattatactaataactctataactattggctcttccctcttttggtgctattattattacatatattacatctatatatgttacaaactcaataatacactgttatgattactaattcatagtattttatgtcttttaaggaagcagaagaaaaaggtatacatttatagagcttttcatttttattttcttacttacaagttctccttatttctagaggttcaaattaacatctgctattgtttcttcattccaatatacctttgctcccaccttttccccttgtgtcattcttgttaagtgtaatacatttctatatgttataggccttgaaatacacttatatacatactcttttatacaataaaatacttattttttaaaataagttacaaggagaaaggaaaaaatatacatttatgctgtcttttataattacataactcccttactatttgtccaggtggatttgtattaccatttgaaaaggtcacttgctttctgcttgaaatcagcttttagtattgctcatagagtagatcagctagcaataattttcttcaagtttctatgcttgaatttttccacatgttgtttcaaccaaagtcggtattttggggaatagctttcaagccctttgattttatggatggcctcttttcctgggcaaaacctctgagccatggccccttccactggacaggggtgggagcctctggtcttctttgcttgtctctctcagcatggaaactccactctacacatgaaccacagtgaagagatcccgtgttcttaggctgacaagcctgggttagaccttccactgtatgaatggggcaggggaggttgaaagcccttgacttctggtcacactcaccaggaatttagtttctacaacttggtgttggacggaatgagaaatgctcatagactgcccctcctaatgggatattttatccctgactggaagatgaaagaagagggaaaacaggcttcttggccatacccagctgtagtggaacgtttgacaatctgaattgaagatggggaagaagcaggttgtggaacaagtaccatcgactcttgctattgctaccataattgtaggggtcttcttgaatagatgttttgttgtttgatatatgtttttacaacaatttgcagagattttaaatggttcaaatgattatgacaaaagtaacaatgatatactctgaaaaaataggttaaaagattttgaccaggcgtagtggcccatgcctgtaatcccaacactttcggaggctgaggtgggtggatcacttgaggtcaggagtgtgacaccagcctggccaacatgataaaaccccatctctactaaaaaacacaaaaactagccaggcctggtggcatgtgcctgtaatccccgctacctgggaggctgaggcaggagaatcactggaaccctggaggcagaggctgcagtgagccaagattgcaacactgcactccagccttcagcctaggggacagagtgagactccgtctcaaaaaaaaaaaaaaaatactctaaagtagttttaataatgatgaagctacagtgttcaggaagaataggaagagtttgaataaaactattttataaaatatgagtaagatagaacaatatatttcatttcatatatacataatgtataattttttatgtgtgtgtaactaaattaacaaataaatgctcacaagggttttttacaatttgtttttactgtaaaatagagttaataccacctattctgcatgtaagtagtcatgaatgaaatagatacataacatatgacgctcttagaaaacaatttatgaaaaatcaaattataatatactaaataaaaagaggaaaaacatctataaattaaatatttttacaattattcactcaccaaacagaggcagcacagtaaggtggttcaagaagagagtttgggatcaggaatccctgggttcagattagttatagtgctatgagtttagacaactgataaagtctttctgtgccttggtttctataaaatcatagggaaatacttgttatgagatttaagtagtgtaattcatgtaaagcagtcagcactgagcctggaacttgagtacaatgcatggagccccctcctgactgtgtgctgggcattaagtgccagggactaggtgttcatgagtgtgtaaaacatgctctttcctcacctactgcacctctaaaagaataggcagctccattgtgaattgtctcctgttataggaaattatatctaagaattaatgtgatgcctcctaattctacaattctcaaacagatctccaatcttaaaatatattccatttttttcaatacctaatggacatgtttttaaaacaataaatggtctctaagatctcttccaacaaaaaaactttgaaacttgactttaaaccctcctactagcagaatccagaaattgcatttatggttactgagtcacttccttgaaagaagtactttcagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacaggtaagaactcctattgcttcctctccagctctgaagtacctcagctcagggacgtggagcctataacgttgtggcaaggatgggaaggaatttataagtcagttcattttcttaaaaatgaccaggaccaaattaggctgcagctgagcctgatgtgagacacaggtcagataaaatcatggtgttatcagaagtaccatggctctaagtgccactacagtgcttgtgttgaattaggcaccagcagacagcaactaaactgagagtttgaaatgcactaggatagtctttctctttgttgacattgtctgtgttgactagggacatgattacatttccattgtcagtgatggagcttgctgaatcctgctcctatgcagctaagaaatggaaagagctacaaatgggttcttttcaccagaaggaaagaacagcaaaggtaatgcagagtactagcagcccactgacacggttatagacaaagaaaaaactgaaacccagcatcaaagaggaacattcatgaaaacagtatactttttattacacatttgaactttgtttcagattgtttctctagaaataatccaggctaaagagcttcctctccttttttttcttcttttttttttttgagagagagagagggcggtggcctagtttttcctctggagaatttacaggagaatttcctgtaatgcatcactactaaagccggtatctttgcttactttaacctctcccacgcactcagacgacttagatcccaccttctgaaaactcctcccctgaattccttggcaaaacactagcttcactcatcaccttgtctgacatctcccttgctggcactttctctctctctctctctctctctctctctctctctctctctctcatctttccagccctttctcctcgtcctcctcacttctatttctcctcttcccatttctctttctcctactctacaaaatggaaaaacagaacaaaacagaaaacctaaagctgtattgctggaaatttattttcttttcacatcttcccatgtagctctctttatgtgcttcctggtctttcagtccttatttcatggggttttttgttgttgctgttgtttgtttggtttggtttttttggggtgtgtgtgtgtgtgtgtgtgtgtgtgtgtgtgtgtgtgcgcgcgcgcgcatgcgtgtttcttagcaacattcagtattggcagttttgcatttatacccacactgagttagaggctaccttatcatgacgctaatgaagcttaagtttcagggcccctctcttgcacgtgccccttcaaagcccttggaaaggtccctagccatgtgtttcacatggttatgtagttgtatagaatttgcaaaagtatgttacattggttccacttccagaatggcactgtgagaagttttgtggatcctcattacagtgaaataagcataaccagttgaaaatggaggaaggaacacatttataaatctctggaaattgtcctaagggcatatgtcaaacaatgaaacatttactcatgggggtctttattcatcataagaattcatgaataaacaaatcaatatttaatttcttacatatagccaggatgtaaaaaaaattctctatatcctattttatcttccatttattgtctagtgtaaattttttaatgagaatccaagggaagcttttccataataaattaaatgaaagttctaggttgcaagagtagttgactgttgataagttactgtcataccaatatttaatttgatgataatacttccataattttttaaaatgatacacattttccctcatctctctcactgacacacacaaaacttttggccatcctggggaattctgtgactctatcctctaaatgcaaaagactggaaattctaattcattccaactcttcccttgcagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggtgagtggcatgagcaaagctctgccaagtcccttctgtcccccaacacagtcagcatccattatgaggatgtgaggagagaaagctggcactgggaataagctaactttccattcacagttgggctccttatcttcactcttctaggggataagcatcagctcacagctgttctgaaggtagtgagttatctcaattgactgttcaccatgagttacagttgaactccttgttctactctttctcctcacccttctcactactgactgcacttgactagtctttttttttcttgagacaaggtcttgctctttccccaggctggagtacagtggcaagatctcagctcaccacagtcttgacttcctgggctcaagcaatcctctcacctcagcctcctgagtaggtaggactacagatgcatgccaccacacccagctaattttgtatttttggtagacacagggtttcatcatgttgcccatgcaggtctcaagctcctgggctcaagagatcgcctgcccatgttcacatagtaacagcaagtttacactgatctttaaggttgaaaaaatgtttcagtctgtattggattttcttgtttattgttttaaaaaatatataaacataaaatttatccttgtaaccattattaagtatgtagttctgtggtattaattaaattcaaattgttgtgcaaccatcactaccatctatttccagaactttttaatcttccccaaaagaaactctgtgccaattaaacaaaagccccacctacacccatctcctgccacaattctacattccatctctattaatttgactactctaggaatgttatataagtggagtcattcaatatttgtcctttggtgactggcttattctaattcacataatgtcttcaaggttcagtgtggtagcatgtgtcaaaatttttcctttttggctgggcactcatggctgtaatcccagcactttgggaggccaatgcaggcagatcacctgaggtcgggagttcaagactagcctgaccaacatggagaaaccccgtctttactaaaaatacaaaattagctgggcatggtggcacatgcctgtaatcccagctactcaggaggctggggcaggagaatcacttgaatctgggaaacagaggttgcggtgagccaagatcgtgcctttgcactccagcctgggcatagagcgaaactccatctcaaaaataaataaagaaataaaaaattcttccttttcaaggctaagtaattatatgtgtatactaatttatctgttcgcttgtcagttgacacttgggttgcttacaccttttggctattacaaataatgctgataggatcatgggtgtctgaatatctgttcgagtccctgctttcactccttttcagtatacacccagaagtggaactgatggctcatatagtcattccatgttaaattttttaaggaattgctgtatcattttccacagtgactgcaccatttagcattcccaacagaaatgcacaagggttctaatttctcttcatattcaccaacatttgttatttattgcgggatctggccagcagcctgcaatgcaacggggctctctctttgttcccaggcagaccggcaggtcgagaaataatagatacacacaagatagtgaaagctgggtccaggggggtcacagccttctggtcccgtggtgctgccaatgcactggatatgccagcatttattattaagtttagtgagggtgggggaaggttagtgagggatttagggtcgtttgattatgaggtgagatggtcacatggggatgaagtaattctttaacataacatctgtatgcagaagtacagtatacagagataagaatttacaatatagtgtgtgcatcagtaatttctaacagagccttaaaacagaaatgcagtctttcataacctatgattagcaagatattaatcagcagtaacagttgcagcaaaagctggttacaaacaatccatagaaacaagacgtgaagctagacaaccggttagaccagaaattctcagaagggagtatgccttaaccctaaagaggcctagaagagccatggcaagatgaatgcgtttatggccctatcttatccacatggacaggtgccccctctctccacaagggtctcattccattcccagagctatgaacatctgcttttctgggataggaatcttggtgatgtgaaacctccctgactgcacatccattcataggctctctgcagggggaagcacatcacgtcccgttggctcattctggcagtccaacctggcactgtctttgcacaatcctgcatgcaattttgtatttacaataatcaggagcatttcatcttttattccatagcaatagtttcacggggtctccctacagttattttaattttttttttttttgagacacagtctcactctgtcacccaggctggagtgcagtggcacgaccccagctcactgcaacctccacctcccgggttcaagcgattctcctacctcagcctcccaagtaggtgagattacaggcacctgccaccatgcatggctcagttttgtatttttagtgtaaatggggtttctccatatttgccaggccggtctcaaactcctgacctcaggtgatccacctgcctcagcctcccaaagtgctgggatttcaggcttgagccactgcacccagcccttttcaattttttttgatagtcaccatactaatggatgtgaagtagtatctcactatggctttaatttgcattttcctaatgactagtaatgttgagcatcttttcaggtgcttattggccattctttagagaaatgtctattcaagttctttctttactttttaatctgtttgtgttgcattgtaggaattctttatatttgctagacatcaattccttatcagatacacgtttagcaaatgttttcttccattccatgtgttgcctttttattctgttgatagtgtcatttgatgcacaaaagtttttcattttgatgaagtcaaagttatctgtttttccttttactgtctgtttttcccctttgttttctcccatgagttttatagttttagctctaatggttagttctttgatccattttgagttacgttttggattgtgtaagctaacagtccaactttttttttttttttggcatgtgagcatgtgaatatccagttttcccaatgtcatttgttgtagagactcctctttctgcgttgaatgattttagcatccatgttgaaaattttttgactatagatgtgagagttcatttctaggctctctactttactccattagttgataacagtgtttaagccaataccaaactgtgttgattatcctgattttgtagtaagtttcagaactcagaaactgtgagcctctgactttcttcttcctttttgagattattttgacaatttggggatctcttgaaatttcatatgaaagttagtgtggatatttttgatgtttttatttataaaaaaatcattggaattttgatagggattgcattgaatctgtatgtcacttttacaggatgtctttctaattatttaactcttccttaatttcttttaagaatgtttggccaagcacagtggttcacacctgtaatcccagcactttgagaagctgaggccagcagatcacttgagctcaagaatttgagaccaacttggacaacacggggaaaccccatctctacaaaatatacaaaaattagacaggcctggtgtcacgtgcctgtagtctcagctactcgggaggctgaggtgggagtattgcttgagcctgggaggtcaagactacagtgatcagtgatcacagtctagcctggatgacaccgtgagactctgtctccaaaaaaaaaaaattttgtaattttcattatacaagtcattcccctctatggttacgttttttgggttttttgtttgtttgttttgtgacagtcttgctgtgtcaccagcctggagtgcagtggcacaatctcggctcactgcaacctccacctcctgggttcaggcaattctcatgcctcagccacccgagtagctgggattacaggtgcccgccaccacacccagctaattttgtgtgtgtgtgtgtgtgtagttttagtagagacagggtttcaccacattggccagatggtctcgatctgctgaccttgtgatcacctgcctcagcctcccaaagtgctgggattacaggcgtgagccactgtgcctggccaattttattctgaagtagtttgcccttttggtggtatgttaaatgggattgctttcaaaatttcctttgtggattgttctttgctactgtatacaaatgcaacagatttctgcatgttaattttgtatgctgcaactttgctgaattctttttattagttctaacagttctgtgtaatatttaaagttttctgcagagatcatatcatcagtaaatagagattattttacatcttcctttccaatttagatgctttctgtttccttttctcacctaattactctggataggacctctagtactttgtggaaaagaagtggcaaaagtgggcatcttttccttgttcccatattagaggaaaattttcagtcttcaccattgagtatgaagcaggctgtggatttttcatgtatgtcctttgttttgttgaggtaatttttttctgtttctctatccctcttttttttttttttttttttttaagacaagagtctcgctctgttgcccaggctggagtgcagtggtgctatctcagctcactgcaacctccgcctcctgggttcaagtgattctccttcctcagtttttttctatttctaatttgttgattgtttttatcatgaaaggtcctgaatccatttatgtactggatattcaaatttttctatttttctgattataagtaacgtaagtactgattgtggttttggttatctctcttaacattaatcatgatgctacatttgcctcaatttcctgaagtacctgctattaaacctccagcccttcttatcccatctctcctttacaggcttctctctgggctccacagtgaaatctcacaccaaaggaatctggatgtggtgtgtgcctcaccccaaaaagccagaacacaccttagtcctgcttgacactgagggcctgggagatgtaaagaaggtaagggtcaaagattcaattttgaaataagcccctcatctctgaatattttaagcaccatttagttttttcttaaagaagagtttgcatttaactataatttgtcttttcatttctgtgtacatgtcataaggccaaacttagcaaccagaagtgagaaaaatattcataagacagaatcctagcaaagcatggtggtcaacacacagtattctactaaccataggttgtaagctatgtgagttaacacagatgcataaagggagcacaaataaatccaatgtcacgagtcctatcctgcaaagaacttataattcagtagcctgagcaagtttaaattatacttcaggccttagaatgcccattaaccttgaatgtttattttgcaattgtctgccaatgatcataagaggacctggtgagaatcagtgtataccaaaaaacactaatcaaaaaactatacacattccacagctgagtaacaatcattttgtttggatttgggttcttttcataggtcattagtcttaaaagaaaactctaacttatgatatacttttactactgtcactctggaaagtgctgtgatgatgaaacttgctcctgactccagtgtgtcttgacttccagggtgacaaccagaatgactcctggatcttcaccctggccgtcctcctgagcagcactctcgtgtacaatagcatgggaaccatcaaccagcaggctatggaccaactgtagtatccttttgtgacccagaacagcaccaaggtcagaggggacacctgtattcataaaccagctgcctgactgtgaatcctgatgaatcaagctcaaaaggagaaaacaaaaaataatgcaagtacagaggagagatcccatgtatccactttagaattgacacttaggttaggatcaaaggaaaatggaaggtttgggaatgtgttgaactaatatgggatgaggttcctgttcattttgtcacatttccttagttagctactcagctatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaacagagacgtaccattgataaatgaggacgacaaaacactagaaattatcattttttagtttactattgatagttttctcacatttacagttttctatatctctagcttgctattcttaagaattaatgcttgctattagcaatagaaaaggttttttgaaaaaaggaaaaaaggaatgaatgcttgctgaatatctaaattaatagattagattttaaattatattctcctgtgttctaaaataagtttctttttctttcattttttcctattttacaatttaggtaaattttatctccttatgtagggttcgtgattctgtatttacctgtaaaatatgaaggacaatggatatttacttaaagaacatagattgaacatgaacagtgtactagtccaaatgctggcgaactgcagcctaagacaaatgatggccaattctgcctgccagctgtctttctaagtgaggttttttgggaagaatgctatgcccattcatttacatattgtctaaagctgttgtcatgctccaataacaaagttgagtacttggaaaagagaccacctagcctgcagagcctaaaatatttactatttgacgctttacggaaacacttatattaggcaaatttctttattatgtttctctaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgtaagtccccttcgtagtacttccactcattgttaaaactaaaggatggccaggcatgatggttcatgcctgtaatcccagcactttgggaggccgaggagggcagatcacttgaggccaggagtttgagaccaacctagcccacatggcaaaaccatgtctctactaaaaatacaaaaataaatgaggcatggtggcacatacctgtaatcccagctacttgggaggctgaggcaggagaattgcttgaacctgggaggcagaggttgcagtgagacgagatcacgccactgcactccagcctgggtgacagaggaaaaaaaaaatatgaaaggagcatagaataactccacctagtatcagcattgaaaaatcccaatctactgctacatttgtgctaaattctagatgacaccaacatttctaatagattttgttggtcaaccttcttggtgggaaaagataggaaaagcaaaggaaaaaagttttattacttaaaattgccacagtaaactgggcctgcactgtacagtacagtagccactagacaagtggggctatctaaatgtaaatgtaaattaattaaaataaggaaaaattaaaggtcaattcacatggctatatttcaaaggcttatatttacatgtacttagtggctagcatactgaacagcacatacagaacacttccaccattacagaaagttttcttggacaatgctgtgctaaaataaaccaaacggagggctccttttgattaggagagtatcatttgttccataagtattgatcaaatgctactgtgaataagctgaggatacagtcatatatggaatagctatgggttcctttcctgatggtgcttggggttgaaatggatgcaaacattcaactaacacaggactaggtcatctagaacaaggattctcaaatgttgatatgcatacatatcatctagggatcttacccaaagaaaaaactctaattcagtagatctgggacagaggctaacaataggcatttccagcaagcttccagatgattctgaggaccttgatgctgtgaggaaaataggtggaaattgacatgttcagaattacacagaatagagagttttctttagtacaagaaacattatcatttcttctttgtatgtaggtctagagagcctagtgctgacctatatcaatgctatcagcagaggggatctgccctgcatggagaacgcagtcctggccttggcccagatagagaactcagccgcagtgcaaaaggctattgcccactatgaccagcagatgggccagaaggtgcagctgcccgcagaaaccctccaggagctgctggacctgcacagggttagtgagagggaggccactgaagtctatatgaagaactctttcaaggatgtggaccatctgtttcaaaagaaattagcggtaatttttctatcacatttacatggatttggattttggaaggcaaagtactactaagaaatgaaattggtatttattttgagacaaataattattctagattttaaaatggtgacaactagttcttggtaatcataataatcagacaaaaacaattttattacttcagactcaaagtttaaaaacattgcttatcaataaatggtcttccctttattaaattcatataactgacaatcagggcttctaatcaaattacatgcccactcttctcagactgatttgatattctagccaaatgcaaagaaaattttcatcttagttatcttgagcaggcttctgttcagccacatttattccatatgaaatcattagtccaatatgcaaaagcagagctttcctctaacagttgacataaagctgtcaatctcagccctgaacctcacctctaaagagaaagcgatttcagtagaaagtggggtcaggagtaagagcgtggtcctgctgaggagtctgtcagtttctccggcatcattgactgtttattttcggaagtctttcccaaaattctgaggtcaagctaacatcctttccctgttactctttttacttcctatttttacattaaaggcccagctagacaaaaagcgggatgacttttgtaaacagaatcaagaagcatcatcagatcgttgctcagctttacttcaggtcattttcagtcctctagaagaagaagtgaaggcgggaatttattcgaaaccagggggctattgtctctttattcagaagctacaagacctggagaaaaagtactatgaggaaccaaggaaggggatacaggtaaccaagattcatctgtcgattatggaaacctgctgacctacctcctacgaacaccaaagtgaccaagcttcactgcacacagatgtgcttttttgtctgtataacattcatgctttcattcaataacatatgcagggagactgttatatcaggtatgtcccaggtgctcatcaaagagagtgcagtcggcgggtgcggtggctcaagcctgtaatcctaacactttgagggcagaggcaggcagattgcttgagctcaggagtttaagaccagcctgagcaacatggtgaaacatgtctctagtaagaatataaaaattagctgggcactgttgcacatgcctgtagtcccagctactcagaaggctgaggcaggagaattgcttgagcccgggaggttcagtgagccaagattgcacctcagcactctggcctgggcaacagagccagaccctgtctttcaaatactagttaactaggccgggcgcagtggctcacgcctgtaatcccagcactttgggaggctgaggcaggcagatcacaaggtcaggagatcaagaccatcctggccaacatggtgaaaccccgtctctactaaaaatacaaaaattagctgagcgtggtggcaggcgcctgtaattccagctactcaggaggctgaggcaggagaatcacttgaacccaggaggcggaggttgcagtgtgccaagatcacgccactgcactccagcctggcaatagagcaagactctgtctcaaaaaaaaaaaaaaaattagttaattaattagagagtgcagtcaattaactattgagttataaattcaattatcagattaaccaccacgttgttgtcatgatcattacagctggatttttttctgttccaagagacagaaacccaatgatggttgcttaaaaaaaatggtaattcatcgttttaggtttcaaactggatttaaaggacatctggatccaagatttcaaataatgtcatgatctgtctctctgcctgatatcctccctgcatccccacagttctctccctctcttcctccctctatctgaatcactctgatttgctctctcaaggagggcttcattctccagtcagctcagcccatatggaaccacagcatcaaatttagagccctcaatttgaaaaggacagggaatcttatttcccagtatctgtatcatcctcctaaataagactctgctaagtagggtcatctgattggccagcttggagcatgtatctggccctgtgatagggaatcttgaccaccaggcacaccagggccaagaggaagaattctcagaagaaaagatggtgggcagaagaacaggaaaacctgcttacagccatttcctacttctcactctgtgttctctgggtcctaaggctgaagagattctgcagacatacttgaaatccaaggagtctgtgaccgatgcaattctacagacagaccagattctcacagaaaaggaaaaggagattgaaggtgaggagcaagtcaaaggatcagattatcctaaagcttttcaaattttaaataatttttcaaattttaaaattttaaataatttgactggataaacctaagttccataaactaaagcaagacatgtcttacttgttgaggtcatctctgagtagggcatatgcagtcagcagcaacaatggagggtaagtgtataactaagaatgaggcaacaagataactccacacaaatgtttcttcttcctccacagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggtatccaaatgcatcaccttgtggttcgtttttctgttttctctctgttcttcctgatcacaaacttagtatggcagagcgaacataaagcccaggggaaggattttgcttgctcacttgtactttcttgtttctgtctgtctgacttgaaatggccactgcctacatgtggtcactaaaagtttatttgcagggtgtcacattcagtcccgttttagtgtatccttccacttacggctgtcatatgctaggcatcataaaaatgccttatctatatctcttgcttaataccatatgaagcgagaactttatccctattacttaggagaggaaacagaggttcagaaaatattaaataacttttatagtgtcacacagctagtaaatatctgacccatcttcatcacttagtggaatccatagtaatattttttctatcccatctagtatgactttggctctaagagaacttttatgagcagaaggactccctaaccctcacacctgtagggcagtctaccactcctgcctgttttctgtgccctactcacagtttgtgttgagttgggagctatgtgcagaaattctatatggtaagtctggcactcggatttccttgcctatcttctgctacccctgccaacagggagtagagacttagatcaaatttcctgatctaagattcatatacctaatcagattttgagagtaacttatctctgtattatgtgtatataataataatatgtgtgtaggtaggtgtgttaaaaagtctataatgcatagggaagatttgaagtcaaatatattgttaagatttcccacaaaggttttgtataattaatagggggaaaaaaacaagaccttcatcaatagagcagaaggcatatgctaaaactcttttggctatagaaaacccaggagaaataatcacacagcccaaatgcccagaaaaactataattaaaatcaagggtagagaaaatttcaagaaaaaaactaagtactaaataaatcaatgcatgtggaaactagatagcttacagagatttacttaatgctacacttatttagcctccatttgtccctttttaggaacaggcccgagtactaaaggagagatgccaaggtgaaagtacccaacttcaaaatgagatacaaaagctacagaagaccctgaaaaaaaaaaccaagagatatatgtcgcataagctaaagatctaaacaacagagcttttctgtcatcctaacccaaggcataactgaaacaattttagaatttggaacaagtgtcactatatttgataataattagatcttgcatcataacactaaaagtttacaagaacatgcagttcaatgatcaaaatcatgttttttccttaaaaagattgtaaattgtgcaacaaagatgcatttacctctgtaccaacagaggagggatcatgagttgccgccactcagaagtttattcttccagacgaccagtggatactgaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatggataattctcactgatggatctcaagctaaagcaaaccatcttatacagagatctagaatcttatattttccataggaaggtaaagaaatcattagcaagagtaggaattgaatcataaacaaattggctaatgaagaaatcttttctttcttgttcaattcatctagattataaccttaatgtgacacctgagacctttagacagttgaccctgaattaaatagtcacatggtaacaattatgcactgtgtaattttagtaatgtataacatgcaatgatgcactttaactgaagatagagactatgttagaaaattgaactaa

SEQ ID NO: 14139 - DNA, 323820 bp, Human
  misc_feature (1)...(323820): n = A,T,C or G
tgatctttcctgattctgttctctcatcttcctatgctgatgcttattcttcctttagaaggttcctacccagtgcttgctgttattagagcctaagagttaagagctggggcctgatggtggcatttactgtgtttaaatgcccaatctctttcattagcagtgaaaacttggggtgagtttttagacctctgtttcttcatctataaaatgggcatgaggctacctacacaggtattgtacaaataaatgatgcaggtgcatttcttagcatggtacctggcacattcaaaatagtgaataaacattagccttaaaaattattttagctaattaattaatatatgtgaaagtgcataggaaatcacaaagcatttgacctccaagttgttcctattttggggcttcattgtacatggtcagatattttttacaaatcccagtccttgtagctgtcactcaagtccacatgatatacagtcctggtgagggaagtgaagagtctgtggataaaatggcctattcatatggcaaagcaaaatggagtccaaagtctattatttctttcttactaaagacaaagttgactttccttttcctggatcatctcctgttggacaggagtcctggccagggcagtaagtcaactggtaacggccaaagcactcaagtttgtaggttgtactgtacatcttagtaggtctgtgtctttatgacttaatcccagaagtcttatctttttcatctgtaaaacagggctcatggccactttacaggtttggagtgaagatagatggataaaaatctgtaaagttccttcaaaaactgtattctgtggcggctagtggctgctgctttgcatttaacactactatcctgaacacagctgatctctctacaggttatttcagcagaagccctggtctaggagagtctatgaagttccagcttacaccagacatgaccagcatccagaaagacctgaaagaagcttgaatcctctcactagaatccctgcaaaatgactcatgtaattgctctgtgtaagtatccttagtctttattgtacacccacacgattctgatgctatagactcctgtggaatgcagggaaagagagaagggggcccattttaaatgcctaggattgaaaagagaccaccgtttcacttgtaaaggtagacagggactgtcaaatacctggtcaaaatacctgccagtcactccagatcctcccttgtttgtctatctgtcattccttccattaggagagagaaagcttttttttttttttcctttaaatttcctaggagggatttctagggtctttccctcaggaattagttgtaggaataattgggccagtggagtgcaggagatatatccagcgcagcccatgcactcctagaaaaagtgacctagatcaagcagctggtggattgaggactattgtggggaccccctgccacctactgacttacagctgaacccacattcccagcagcttcagcctgggggctgggggagcgggcagaccgagctcagaaaggcaggggagggtaaagaggactgtggggttgcccctttcaggaccaagtgccacgtgtcacacacccccacctccacctttctgcacacacagaaaggaggataaggtgaggatgggaggaagggggaacaggtagggaggtcggctgtggaactccaagctagctcggtgggtattagcatagagcttgctgcctgtgtgagtgtgagggggagagcgagagagagcaagggagggagagagaggcaggctgcgaggggagaggagagggagtgggggagccagcgctccagctagcatgaggacgggcttcttttcccgtgctcagttaatctggctgtcagttggtgttaacgctgcagtttaagtgttcggattccaagggaaacagacaaacctcacgaaaggaaggaagcaagcaagcaaggaaggaactgcaggaggaaaagaacaggcagaacagcgagaagaataaagggaaagggggggaaacaccaaatctatgattggacctgggcttctttttcgccaatgcaaaaaggaatatgcagcacatttttgccttcttctgcaccggtttcctaggcgcggtagtaggtgccaatttccccaacaatatccagatcggtgagtgagggggcagcctggggagggactttctgggtctggccagggatttttttggggataggggttgtgtaccccctccccggtactgactgttttgcttggctccctaaagctgtgctgcggtaacagaagggagacttgggcttacagccagaggagggggcttctcctgatcggatgaggggcagaggggaagtgttcacacacgcacacataccctactcgcactccaggcaagagcatgtgaaatggaggaaccatcgctttggaggaaaaaaaaaatcaggctggaaagggtggtgggtgtttaaggagttaactctattgcttggtagatggtgcttgattccatttttaatgtaagtatgtatggtgtgtgtgttttcacgtgtgtgattatatattacatatgcacatatatatgtaattgaaggaggcagtgctttctctgctgggggacagaaaagagaccctcgagaagaaggagtgaggggtgctgggtatattgcagccactgaaataatgccagaaggcccccactccaaggcgggtaggctccctctcctgttctggactcctccagctgccttctctttgctgtctgccatgctgcgctggtggtctccactcccccgatcctggaacttcctcgcctgccttttctccgttccttccttgccccctcctcttagatttcctatccacagaggtctaccttttacacacacaaacacacacacgtacacatgctcctttctcctcctgttggctctccattatccttgttactgggctccatcctctcaacttggaggcaggtttcaacatgctgcatgctttttttgttccccatttccccttcttagttgttacacttctcaaaggccccgccaccctccctgtatttctgaggggactgacagatattgctactcctgataatcatgagggaaagcaaaacaaacagaagcaataacaccaatcacaaagcatgtccacaagggcttggggcttccgtgtgaccagcatgtcagtgtcgtttgtgtcccggaatgaagcaagctgctgtgtttggaagcatcttcgttggtttggtttctagtctctctcccctggtagggagatagctccactagggaaagttcgcattgctgggagtttgtgctcttttgtgagtgtgtgtttgaggggggatgtggtgcaattgatattttgtcgggcatacatgtgctgcagtacccatctctttcagcctctccagctagctggcggcttggagtggccatggagtaacttgctttgtttcctgacacctgttaagctacatcctgaagtgtgtacgtatctgtgtgttagtgcctaacacgcaaaacttcctgccttcaggggagacacttcccttgtagcccagcccgtagccttctactcctcaacctcccatcctttctctttcattcattgcagaggaggagaaaggggacagggaagtgtttggggtgtggtcatctggggggaagggggagcatcataatcaagaattttttttgttttcattctttaaaatgggagcacttgtacatgtggaaatcactggctcttacatgtggcattgtttacatttgtgcttatatactacctatcctttgtggcttggaagtgtttgtctagtatatttgtgtatatagtaaatggtataaatgcatgaggatgtttcatgtatgtgctatgttttctcatgtatctctgcatatttttaaaattatatttagccctaacttggttgttcaactgataaagccattgctactgttttcaaaaaaaaaagagattgaagcattaaattgtagaacaaaatgctgaaaatatcactgccatcaggtagtacttgattctatttgtgtgatctgtaacaaaaggcttgcaatccatttattggttcttaaaaacagacacccactctacaagaagttagaagtgcattatgtttggactgtgattactgtcagatttgagataaacttctatgtaaacatcattatagttcagtctctagaaatggctgattttaattcacagaaatgtaattgatttacatgttgacagtaaatacaaaggtaagccatggactcttgtttctcggaacaggcatcccatcaggcacctttactataccttttactagaatagaatgtttgtatcctcttgagatgcctaagatcccacatctttgaagcacaaggttccaccatgcaaacacacaatggcaatcccttatgtaacaagtcattcctaggtaactgggatcatgtgtggtgaaagagtaagcaaaacattgtttgcagaaaagcaagagtttttagagaaaatgaataataaaccttaggggcaatagaatagttaaattgcatgcaggtcttgctaggccaaagactaaaaactgtccatgtaaacagttatagtagtggagaagcccacagggtcccagagctagatttcaatcaccctgcagcactgattagtacctacttcccgtaaggctctctggtgagagatgaggctgatgtaagaaaaattagacatgactagagggtgagggggcttatgtgtatgtttatataagagaatagcagctcctaggtggtttgcacaagggaggaagaagagaaatggcacaagtctcctgttttctctgactttagctgagttgaggggtacacaatcaaatgtttgagcaaagtaatagatattagaggcccatgtcacaaaaaagctcatctgtaggagtttaagtttcagtgtccagttaagcctatttgaactctcatctctaccactcaaggctacagctagtgagtttggcatggggagaagaaaaggactcatctggagtgagtcgtgaggaactaaaacctgtctctagcccatataccatgttgcattttcttttctcatagggggattatttccaaaccagcagtcacaggaacatgctgcttttagatttgctttgtcgcaactcacagagcccccgaagctgctcccccagattgatattgtgaacatcagcgacagctttgagatgacctatagatgtaagtaattgcttctatttctgagatgtctttctgcgctagaccaatgaaaggagggcctgtgggtaggtggtggtgttgcaaaaatgacttcagttgccattcgtctttgtaagagaaagccctccaagaaaaatttctagaggcttctgagtgattccagcagttggcattttagcccctgcaatgcttcatgtaatggatttgctttttcactgtcagctaactttaatgccagcacgatgggtgcttgggttgactgcatcttccctaccttgcagaggttttctggcacagctgagagagttttacacatacgaatcttctgagaggcatagaattaagggtcctgagtttgtgaaaatgtggtttaaagtgcttaaggcatttcctatctacatgttaaatggacagaatgtagcttgataagaaataatagctgagaagttgtacacatctggttcttcattttcggaagtgaccaataattaaaacttggtgccttggtcattttaaaaatagcttgaggaaattggttgtttaaggcacagtttgtaggatggtcattgagcatcaaacagaacaaaggtggcctcaagaagaagggatagataaatctctgacatctgaattgaatgcattgtaaaatgtgggcaacaaacaccattctgagttttcctggcaactaggaatgaaaaggaagcctgtgctcacatgattggcttttcatgacagatgaaagcataaaaattaatcaggaaacatattttcccttcagggattaagctcaagtaaaaatttatggcagggaaatgtgagctgaattcacaagaacaatttgagaccccaaactggattgaattggcacgatagtcttggtgtgtcactattgacttggtgacttctgctgagctgtctctggtggaagtcatggaccatatttcctttgtgtctttctcatagtcccactggtgagttctcaatgatttgaataggctatgctttgaagtctcaaaatgagaagtcagaattctttctatcccaaagaccactcctaaaataatgttgttacaaattccaagaactataattatagcagatttcatttattgagaacttactgtgcatcagaactatgataaatactttatagtcatttatagtcacattcattaccatgtattaagcactgactacagcccatgtaatgcactaattgctttttatgtgttagctcatttaatcctcacaggagctttgcagagtactagacattatcttccttttagagatgagaaaactgaggctacaacagattatataacttgcccaaggttactcaggaagcaaatggtggttttgagacctgaaggtccatgttcctggatactgtgacagatacactgattcttatggtaccctaatcaactagtgggattacccaagaaatgaaagggaattttcagggtcttgtaaggcagaggtctaataaagtacctaaggagaaaaacttacagtgtttcaaactgtagctatgatttgcacaggactggtccattgaataaataaaatagcaattcttcattttggtaatgctgaggttgaaaatcttatctactgtgttactcactacccttaaaaaaatagctgaagtttaattgctgaattttagttctatgaaactatctttctgggaatctagaataatactgagtagctattttgctattagataacctttctttactttttaatgtggctttgattagggtctttggaaggggcatttggttgggggcatcagtgtacctataaatgtttaaacgcatatacatgtgctaatttatttcctggagcagggctccatagcttttgtcatactttatagcttttgtattacttgcatagagaatcaagaataaatagctggtgtgtgtattcactcatgctgctgagaaatatctacagcaggttttggttgaaagagatgtgaactgctctcctagtagtgtcaagatgttgactggcacagcaagaaaataaaagacaaaaataggagaaaaggttctaaggcaaaaggtggtgcttctgtcttgttatctcagcaacctaagacttgatctctaatagggttaatgactgtttattagggagacagaaatatgatacagacaatgttgttcattttggtcaacaggcctggagtggatgaatctgagttcttgaacttgatgctgccatccatgaactagtgtacaggtttccatgaattcctgtcttgttcgttcagttaattctttaagtgtttcttcaaagctataaactgaaatagatattggaaatacagagatgataaaatgcccttgctctcaggtagcttacagtctagtgggaaacattgttatggggattatctgagaagcaataatcttattttgtgcttagactttgtgtttcttttctttagctcccagatcccaaagggggtactgggcaagttaggtggaaatggtggcctggctggaggagcctctcttaaatttcatgtaaggctaggaatactttagggctgtgttcactgtggtccattggtttgggaaaactttacatctgtcccaattttaattgagtaaaaaatgtcagtgggagcaaagcagttttaggaagaatgtactcattactgatacatggaaaagcaagaaaagcatcttattcagactaattttctgtgctgtgttttttgaaatctgaattagtagttgccttaaattaactgcccaataagtcttagatctagaaaatgaccaaattttatttgtttttttttcataatttttgctgtcatttgattttttccctttgcattttgctattcattgtccctccaccagagggtggagaagggaagggagaggaagtgtaatgggacctgttcatgctagacatgttagcagcaggggactaaaaatgaggagaggtggttatatggtagggaaggtggggaagatagaagaggactatggctactactactggccaaggtgagagtttggtgccttcttcgtgttcaatctttcttgcttccctggtctgccattgttaaagagtaaagccattgaatcagcaacccaatgccttgggatctcctttaagcacttttccaagcttacaggggtagagtttggggagattgtgcatagagaagatatttactgatcagctacccagcttattttggtgcctttgtggtaagtgtaaataaaggaataaatgaaatgctgattgagattattactattagaggtctgagtagcatagttgcagcttaattcttaccttttaatttattcacctatttattcattcattcattcagcaagtacatactgaatgcctacttcatgccaaacactgggccagacgctaggaatataggggccaggaaagaaggcacagcctctttccttgtggagctaacagtttagcccagaggttcacaaacttcagtgcacttaaaattcactcagggagcttgtttaaagcaagactcatgatgaactttttacttcttgaatcaagatattcaagagtaggccctggaggaattctatagcaattattatggggattacactttaagaatctctttaatctaaaaagtcttccatccctttagtaagcatttttgagccctcaaccaaacctaggcatgacataaagtgctacaaatgcagacaacagtaagttgcattccccaccctggagtactttatccatagtaagacattttctatcctgtaaagagaaaattaaaatgtaatgttgtaagtgctatagcagcaatttgtatggagtattgaagattccttgaagagtggagtttgtctctaggaggtggtgattgaattgagcctcaacgataaatagggttatctatctgcagaaggggtcaccaaatatagccatccacaagccagttccagcacagagactgagttctgggcccatacactgtgtaagaaccatggaatttcacattagaacttggacatcttgtcttgactaatatttttaaatattaaaatatctggcaacactagggcccaggtctatgcagcctcaatttgctgagatgggacagagtaaaccccatctacatggcctctttcccaatcagcccattcttcccattttctttacctgctggctttggcaagcattgagtttgcaagccctgattgatagcactgcaatgttgtctgtgttgtgtctttataggttagcttcaccaccagaatataaactgctgtcagaaagaccatgtatatctatagtttagtgttgagaacacttggaaatgcctctaatacaaatgaataaatgtctgtaggagtcagggaattacacagcataaaaatgttcagagcctcaatgacaataggtgaaaggtagcaaccctaactacagtgggatgccctctgtcatggacctactggggaagcccaggggcttcctaacaagacattaggcactggcaacagagagatggccttagctcttgcctgaacatggctcatcaacttcagagttgcaacacagatttgtttttcttgacctacacaatgctttttcatatttggcataaaaatccagatttctggcatctttaaaaaaaaaacttagggcattaagcaaccctaggcccacattcctgcttaacttctattttctagagctgagaagtgctgccctttttaaatacataaactcccaagttaaccaaagtttccattacttcctgtttgattgctagagtaatcaaattatgttgtttgggcaggcctgtaagtaggccaatctactcatacctgatttatatcgtcagcattcatcattttattattttgttctaataatatctattacttaccctgtcaaaaataataaaagacacaaaagatgtataactcctactctcaaaaaaattagtgtgtatacagtaatgaagagaatggtggctgatggtgggataaacaagaattattttgaagacctactatgtgccaaatactttgcagatgttgtcttaagttttataactatcttgaaaggtgattatccccatttcattgatgatggtactgagactgagagagattgtgtcttctttatattatgcaacaaataaaaacctaagctagtatttaaagccagtttggggggctccaaaactcaatgagcattctccttttaaagatctatgaatatggccaggggcagtggctcacacttgtaatcccagcactttggaaggccgaggtgggcagatcatgaggtcaggagattgacaccatcctggctaatacagtgaaaccccatctctactaaaaatacaaaaacttagctgggcgtggtggcacgcacctgtagtcccagctactcaggaggctgaggcaggagaattgcttgaactcaggaggcagaggttgcattgagccaagatcacgccactgcactccagcctggcaacagagcgagaatttgtctcaaaaaaaaaaaaaaaaaaaaaaaaaaaactatgaatatatggacagagaaaagtaccatagcagtgaaatagcccaacggtagaagtgtcacagtggaatttatgattcaagcttaagagctaagtcttccaaggcagaagctatgactgtggatgatgaaaacttcttggggaaggtggaactttagcaggcattaaagggtggagcagattttggttgtggagtgggaggagggtattttgagtgggtaaagtcacaatattcctcctcgcctcccctcaaccactgctgcatatgcttgttaccatgtggtggagatttgggagtttgcctcctgcaccacactatgttctcagctccatggcagatgtctacatttctctggttaatgttacagtctgaagttggctcctcaatcttcacccgtgcccttacattaaggcacacaagtgttgacatttgtctgtggttgactcttggctcttattataatattgataatcatcagcttttatggatagaaaaatccttgtaaacatttctttccctgactagtttgaagatcctgctgggatgagtgagcttactgctctcctctcagccactcaggataaagtgatcatatagcacatttggaaaactggtaagcttcatgtatttgttcattcattcattcatccgaaacccttttattatcaccttctatggggatatgtactgtcactgccccactccatacctttgtagacagcattagttgattacagaattttttcccactgaatctacacgtggcctcaaattggtgacagctgatgcaagagatgaaatccatttttcattacaaggcattgcactagaaattgagaaaaataaaatgcattaggcattgattttcctcttaaggggctcaggttcttataaaggaaataggcataaaccaaatctgcctctctttctctctctctctctctctctctctccccctcttacatacacacacacacacacacacacacacacacacacacacacacacattcagaggaaggaaggaaaacctttagttggagggatttaggtttcataaaacaaggacatttgagttgaatttggaaagataggtaggatgtagatgggaaaatatatatgtatatatttgtatacacacacacacaccccacacaccttcctgtaatggcaggtttgatgcagtaaatagcatactgagttgagatttgaagacatggattcaaatgctggactaccttcttgaatcgtttaggtataaccttggagaaacatcccctcccccaagcttatttataaaatgaagctcatggtctctgagagtccttctggggctgtatttctatgctggcagcatatggaaaacaccagagatatatgattaatagaagttctctacctttggctagcaagaggatccctaaacaagctaagtgtctaaggaaagctctagacttcccttccaccaacttgcacattcagggcgcattctgtatgcaaatgctgaagcattatgcctactttggggcctcagatgaattcattcaatatttaacaaatatttatggagtgcttactattgtgaacaaaactagaaagcagccctgtgctcatggagctcaccagctaataaaggaggctgccattagatgatcacatgaatgagtgtataggttgtaataaacaatctgaaagaaagggccatgattctatgaaagcatatacaaaggaaccagctcgtgcaggaggatgaataggtgcttgagctgaggactgaaggctttggtgatgcagtgatgggaacaggaggagtgtttgagaagcttcctgggcagaggcctggccaggccttgtaggctctgttatggattttgatctttagctcaaacactaaagaacccatggaagggttttaagcagagaagtgccgtgtttagatttctgttttctcatcagaaatcagatgcttgatagtactttgccaaattcacatttgctgaagacgtctggcttgtgtttcaatggccttgtttctttacttccatctccagtttgggatggagtctggcagatgggcaggaggatggggacagaggccaggggaaagggaagctgatgacttggtttaggggtgcgttgtcatggtatgtggctctctgtgtgcccatgggcattcctggagattggaggctgatccagtgcagtgcctggagaactggtgaggctgtgtggaggcagggattcattcagagtcctcatttattttaacaaggaagacatacatagcactgaagctcagcctctgttccaatcagacaactcagtggtcttcaaattcacactgccatttccttcacttacacttacaaactgctccttccatactgctctgctgaaattctgtccttctggtcagccctagctcttattttaccttcttcactgagccttttttctctttcatattcacatgctcttctgcccttcagctgtttttaccatctccctagcaatggtcacgcttatccccaggttttactcaccttgtcacttgaacacgtgtcttacctgcccaactggactaagcaatgtgaggtcaatgaccttgtttactttagcttcccatcacagtctccaccacagtatagtgttcagtggtgctagatgaatgaaagaatagatggcagtgacaagaataagcctgaatcattgctgcttagggtaatgcttttgatattatgagttttgagagttccaacaggctgtgctgtaaatacctatggatggttattactgtgtagctccaaagttatgggggtgaaaatcaggtgtaagtccaattgaaagctcattttagctcccgctggactattgtcatgaggggtcctaaataaggtataaggttccatcttctaaataaagaatttctgattcaagccctgggtttgccattgatgtatgagccttgtatgcatcttacgactttggtgtgtcccagcctgctgtccagaaagcacaggggagcccagggccatgggaggtccaggttgaggaggcaggcaaaactggggcaaatgaggcagttggaggctaatgaaattgataccctatggttaggcgtgtttccatgtgttcattgtttggaacctctaggatgaaaataaagtttgagaatagcctttagtttgtctacaaaagtaatatatacattacagaaagctataggaacagagacagcaaacacaataaaacttgtataattatagtactaaggatacattttccatccttttttgaacctaacaatttaaacattaatagatttatcttactgtcttataacatgattttttgcatattacaacctttaggctacttttattattgcacattcatttttaatggtttcataaaagcccactgtacatatgtaccctaatttatttaagctgtctccttttatgggatatctagtttatttccctttttttcttaaaaacagtgctgtgatatttctctcaataaaattttaatcatttgtacatattttgttgtgattttaagggaactataaacccagtagaacaatttccaatgaaattgaataaaatttctagtatgtgcagaacttgagataacttgtttaatgtgagttctgacattgacttgctgtgtaaccttgaaaagcttttatatccagtttagtttccagatgtataatatggggtgctaatacctgattctcaaacttattagaacaggcaagtgccattatttgtatgaaagagctttgaaaaatcaaacatgctaggcaaacgcagggtaatataattaaccaggcttcttatctattagcataaatgcacataagtaaaatgtaactaattaatttttagtgttttcctaggaaggtgttcattacccataaatgaatctattttatggatagggaaaattgaaatcttaaggctaagtttatccaagatctaaatatatagctatgctaagtctgaaagcatttcttttcatttatgattcaatccatgaaaatggacgaaatatgtggatcataagagtttctttggcttaagaaattattgtttatagaaataagggggaaagcccatttgagcagtaagcagtcaggactgtttgtggcaagtgacagaaacccaactaactggatagttttaacttcaggtatagccaaattcaagggcttgattgatgtcatcaggactgagacatgccctctagatttttatgcttagcttttctctaaactggctttactctcaggcatagatatgtcatatatcagatcccagcactggcagccttcacctgcccagctacaagtccagtggaaaggaaacttctcttttctcatcagttccacaaaagtcctgggcctgatgtcattggataaaacttaggacacatgctcatttctgaatatgacacagtggccaggatattgtagtcttttgcttgacatgggcctagtgaaatcatcatttttagagcttggggtagtgagaagaaccaaaagattgtggatttaagccagcccaccaaaaccatacggacatgggggaggaataattccctcaaagggaatcaggatgctattaccaaaagaatggagattgaatgcttgagaggcaaaatagatatatatatatatttttgtctattaagcatatatatatatacactatctatatatagatgtaaatgtatttattgtctattttatgtatttattgtaaataaatacatttactctctctatatatatattctatctatatatagatgtcccccattgcacatcttttcagaaaagaaaattcagacaggctggagctgaaccaatgcagacaaaaagtcaacatgctaaagtcagaagagccaccaatgagacaagcacatacaagggattctggtgggtaagtcaagatcagaagtcaggacaggcaaaaggtctgaaattcaggcttctgagttaatcaaagctgtaggggtctttggtaatccttgtccagccacgagcaaacctgtgttcacagaacagttagaaagtgctagccattcacccacatagaagcgactgggaggtggtctctccaggccactctgataataagttgaggttgtcggctgtaaaatgtttggtgatcctgaggcaccaatactctgtcccagtgaccaggacatttcctgctctactcaaacactcaagctattgtgcacaaactctttaacagtcccagttggaatcttggctgcaaatctgatgagcccacaccaccagatggtaggttctcctaattggttccatcccctctagtttttggcaggaacgaaaccttccctatacctgaagaggggacagggagagccaggatcaaatgaaggaggctttaacctctgttaaacaagcagagatctcaagctggctcctgtccaaggcaaacagggcagtatggttcttttacataggtcatggatttacaggggactgatatcctaagactaacactgatgaggcacaagactgtaatgattgaaaagtggtttagctacaaaggtcaactgatttgggggaaggtgcacttgtttattcaataattgatatttgtggagcatcgtggtagatgagattattatttggcaattatttctctctccctcaaactccttgggaaaaaaatataacttcctgcttcattaatgtcacatttggtcatttgacatgctctggcaacttagatattagtagatatgtttgaagcagagattatgagaagaacatgccccagagagcctgctcgtctcataggaaaggtaaatacagtaagtagaagtgtcccagtcaacccacagcccacagactaaagtttgaagcagagctatcccagctgacctgaaaatctgtgagcattgtaggaaatgctcaatgttatataccactgaaattggaaatggtttgttttgcagcaatagctggccaatagaagcaaccagcgtgtgttccacactttgctaggcactgagggaacattggaaatgacagacatagtcctggtctccatggagcactattgtagctaggaagatagacaatgaatacatttacaaataaaatatatatagagagatcattactagggtcataaagaaaataggatgtagtgacatcaccactatggtagagaagaacacctttaaagtaagtggtcaaagaaggcatttcaaaggaggtgacttctgagctcagatataaaagttggaagagagccaaatgagagtaaattcccctgtggaatgtcgaaatccagccccatgggcaacttggattgagaatcttggtctaggcagaggagaatgaggtgccctggaaaaatctcctgcaaactaggtcactcacttgtcttagggcagatactagcttctctctaccacatcacatgtgcaagtcaagggctggcagatcacttgctgccaagactagatggtctcaggcattggaagccactgagcatagcaaggcagagagggggaggtatgctagggcattcctaaccatgaggtgatggaattggctatacttcttggcttggctccagaatactcaagagttgttgcttattaggatggcaagaagggtgtgtgtgtgtgtgtgtgtgtgtgtgtgtgtgtgtgtgtgtgttcatacatatattcattctttcacagaggaggaaaatgaactagatggcttctagatccctttccaagtgtgtgattataaaaaggatgctgagatttaaattatgtgtgaaggaaatgttaaattgaagaacttcatcttagctctgtgccaagctccatttgttaattgaggtggttaattagaaaggagtctcccttgagcaagcaggataagctccagcatccctaatctatctggtaaaggctatagaggtgtcacacctacaagggagaacaaagaacatctaatgcaagccctctgtttaatcttcactccagacactgaaaagcaagaatgttgggggacaggaagctcacagcgcccgcatggaatttagactccaagtagtttattagctttgggaaaattatttaacttacactgcacttactagctcttcttccttactccaagatcactctgaatactttaaaatatggttggacatggtggctcacacctgtaatcccagcactttgggaggccaaggcgggcagatcacttgaggccaggagttcgagatcagtcgggccaacatggcaaaaccctgcctctactaaaaaatacaaaaaatagctggcatggtggcacacacctggaatctcagctacttgggaggctgaggcacgagaattacttgaatatgggaggtggaggttgcagtgagccaagatcaagccactgcactccagcctgggagaaagagtgagactccttctcaaaaaataataataataaataaataaaagatggtttctatgttgatgtaatgaaccaagtattctagggttatggaagaatttctcatcagcaaatccagctacttatgtctttgtttcttgcagcctagggctgatggaagtcttcacaccccttccaagaacccccacaaacattccaccacccccacatacccctgcaagaatgaagctttctggggctatgttctcctcaacaccaccacaggggtcctctctcactccttctgctccttttttctcactagcgtctaccctttccccaggattccagcctatacattctgagttcaacatatcaaaaccagaacttggcatccttcctgccaaactcattgctcttttctcactttatttctgttcaatcattcagccttaaaatgtgggtgtctggtttcaacttctccatataatcaatattatgtgttgatttcaccaccactatgactcgagtctatccccattttcttcttttcccactggattatggcttttgccttctgactgtcatcttcatgatataatccacttacaggtggcggatcaatttattgaagactatttctgatcatcaagcttcttgtctcaaaaaaatatcagtggcttcccatcttattttaagttcaaactcagactaaaatatgagtctctccataatgggtctctgcctgccttccttttgagacttacctaaaccctacactctatgttccagccaaactagactacctagtgttgccacaaacatgcctctcagtctttcactgctttggtcatactactgattccatctgaaatagtctctaccacattgagcacccactctctactaaaccctggagataccgcagaaaacaaaaccagcaaactccctgtacccttggggtttacgtcctgggaaacaaatacatataatgatttcaaatactagttaaatgatacaaacatagccaaatagagtcatgggacagagagtgagctgtagtgctacattagatgggtggtcagggaggacaggcatcacctgaagagatgatattttaactgagccttgttgcaatccatagaactttctgcagtgttgggagacattctatatctgtgctgtctaatatgtaggcactagcaacatctgcccctattacacattagaaatgtagtgagcatgactgaggaaccaaatctttcatgtaatttaatttttattaattgtaatttaaaaagtcacatgtggctagtgactgtcatattagacagtgctaatctagattctagaatatttcagacaagaaaaaaaaaacagtaagcataaaggctttaaatgagagtgagtgtatattcaaagaacagaaagaaggccagtggagctaaagcatgctgaggaaagagacagggtattttgtaagtcatgataaggaattgacatggagtttaaatgcaataaaatcactaatggattttaagcttgggagtgtagtgatctgatttaattttcaaaagattactgtggctcctctgtggaggaaggagaagtgataaattgacatgaaaacagtatgtgtcagtcagtttttgctgcataacaaataacatcaaaatctcagtggtttataacaaaagcttttttaaaaaacaatcacatctgcaggttgcaggctgcagtctgtaggtcaaccatgattctgattacactgtaggataggttaggctaaactccaggagggttcaggtctgcccgatgtgtctttgtttgggtattgagggtcaaggggcagcagctacaaaaagacctgctctccttttccaggagcacaagaggctaagctttatcatgcaaatatatttaaagcttctgctcatgtcatgttctctaatattccattggttcaagcaaggtatgcagctaaacctaatgctcatggggcagaaaacacactctgtcttctaaaaggaattacaaagtcatatgacaaaaggcatagatgtgtaattttataacaatatccaatgtaacacagaggggactggggaggttcctacaatagtctggatgacagatggtggtggcttggaaaaggtgttagtagaagagatgaaagaggtaagattcataaagtattttgaagaaagtatgcacaggatttagtgagagaatgaaagtaaagtatggggtaaagaaaacagaccattttccaaagtgcttctcagatgctaccacagccctgtgaagctgcttctccctccctcaattgcagctgatttccttttctcttatctcactggctctcttttttgtgctgcttttattggcccatttcaactttctaccttctgttcttgagaggttttatctattgttaagactctgaggttttgagggcaagagaataaaattatttgtatttgcaacccaactgcctagggaataggctcaataaatatttccagggcaatacaatggttaagagcaaggactttggagatatcatcctcattttggatcttgtgtgatctttataattgacttaacctctcaaagccttggtttttatttataaagtggcagtaatcatacactccttttacagttgtgcagattgaaggagatcaacttggaaagtgcttagcataaggcctggcatagagtaagtacccgataaatgagagctattattgtttgttcaatttaattgtttgtgatgacaagcttctttggaaatgccctccagagtcttcatcagaaaattcaatgttcttgttgaaatgaggggcacagagaataaaaacactctggatgggattttgtaatttagtaaggagatctctagatctaaagtctctttgatctgaaaatgacagcaacaacaaaaccccaaaatagagccactttgctacttgtttccttttaccatctgccaagatggttctttttagttctcgaggtcttgcttggagtcagctgccttaaaataataaaataaaatttaaatctggtcctgcacttatttgggagcgagaagacaaactgctttaactaaatatatagctagttgctgctggagtgaaatatagggcaatgttgactaaagtgtttgaggaatgaactgctctgggaaagtgaattttaggataaaactgaggattaatcagaacctgactttttttttggtaacatttgtaattgagacagtttccgacatgtacttttcaagctttcttgccttagtgagatgactttgttgatcctagtttaaagttgccttgatcataagtatcctgtaaatccagcgggcattgtgaacagagattgtctgcgattgcagatgagaacagaaaggttgggggtgaaatcgctgaaaaagagtgcatgaaagaggtgaaaagttaacatgatgagtttggatatctgcaggagggtttctccggagctctgcaagatacatttggaaaaataggctgggttcagactagagaaggctttgaaggtcaggaataagtatttgagagacaaaataatatgtttaagttgcattgttgatattccaaaggtcttgtttataagcaaataaaggatgattttatttagcaagtactagaataatcctcagcaaacataaagttacctgacatcaaatgatgcagaatatccacatttctacacaatgaactctacagggttcatttttaaagtgttttaggagctcatttagtcagtgcttcccattagaactgtgatgttctgaggatattaataggttatttggggagcattgggggtgatgagggaaggttgcatggttataaatttagtcatgctgattaagcaaagtataaggggtgctgtgttttaggattttgaagaccctttaaaatgctaatgtgtcttgttaatttctaaaaaagaggatacagtatgtattttccaaacttagtccctctgtagcccacagaacaggcgggtctgattgcttggtgagtgacagatcaatgaccacaaccaaggagtattttaaaaagggattttattacttgcaacaagtaaggatggctgacactgagcatagttcccaaagcagtgcctccccaaataaaggtgaacccagggcttttattgacctggttggctgaatcattgtatgtagaggtgaagtaaaggcagtgcaggtgcaggtgcagtcacagatcatgcttttatacttgtggcatgtataggaaatgttgaataagctcatctctggatggggattttagtacgttaataaagggagttcaccaaagttcatctccaactcaggcatctcaaccagtttttgttttttgggcttcttcctggaattttttttgaaacaagaactcaaggtgcaacagttacaagtgtgtaatttctcattgtgtgtacccaacaatctggggaccctgagttataactctttttgctgaatttgtgaataatgtcttgtgatgtttaatcctgttttacatatggtgaaactaaggctgagagcatacacagggatttatctgcagtcaggtagcagccaggtcacgatgctaacacagaacttttgaccgtcacccaaggcctcctactcttccaggctccctgtcaatttttggagccagtcctctaaacagttttacccagaacaaggaattgccggtgatttcagaaagaactggcagactcgggggaggcacttgccaaattggctcaggctggccttgctgccatgcttcttttcctcgttcctgcaaagccagttctaggtaacctacctgcagatgtctaccctgaaataacacccagcctctgttacactgctgttacacacaaacaaacaaagcaaatctgctgcaaaaagaggcaggttgaaataaattatttttagtgcaacatataacgtcaatgtcaaaaatacgaaagaggcaggttgcatagggaggctgaggaggagatgctgagattcagtgtggaaggtgacaagataagaggaggaaagtttgccctggccctgaggcagcaaaattaattttgccccaggcctttaactgagggaaccaaatctatttattacagaaattataaagagatttggtgactgaccccactttaccttgagtgattggactttacacgcaggtaataggaataatagtgtcatatttatagagcatgttcaggtggttgaggatatggaaagcctttccagtaaggaatggttggaggctctgagaaggaaaaacttagacttggatttcatcatcaaacttctaaacaaacatatttggaaaggtactgcattttctatggcccaagaggccaaaacacagacaagtgagtacaacatttggtctggcagattttgactccacacgacagagcccattctaagtgtgtggactggctagcagtggcgagggttccctttctctagtctgcaaacctcccaatcaacatggctgttagaaacctggtccttttgcagaattgctttaccacttctaccttgatgacccagtgcctgtgataccaccgttagaaagtcatctaattgcgtttaaacttgttctctccagcatccgttgaatagcaaagacaaatccttctgaccatagttctaattctgtgggctggcactatggatttaattgtgccctcccaaaatccgtttgttaaagccctaacctccagcatgatggtagtgggtttagctgtcgtcatgaggatgtcatcctcataatggattaatactctataagagacaccagaatacttgctctttctctttttctgtgcacatgcaccaaagtaaggtcatgagaacacacagcaagatggcggccattggcaagtcaggaagagaacctcaccatagtggcaccatgatctcgcacttccagtttccagaactgtgaaaaaagaaatttttgttgtttaagtcaccattccatagtatttggttatggcatcctgagctgactaacaccactggtaattaaggtgtttcttccatgaaaaatgaaatgatggtcaataggaagcaaacagaagcttaagcagaagggcagaaaggagtgcatttgggaaccagagggagtcctatagagactagacctgggattttgacagttctgctgagggctggccctgtgcccagcctccttccacttctcttcatctcactagaccaagaaaatatgcacatctgttatccacaaatactctgaattcccccgccaacgcagatccccgggaaaacctaacacaagcagaacagtggaggagatgcacggggtatttggtgtttctcaggaaaaaggcttgattttttgacaccctctatcttggtctcttaatttgtcctgagtcagtgagccacagtgaagtccagagaaaaaaatggaaataggagaatcgggcttaaacctcagttttgtcgctgattaacctgtgatcttgggcaacccactgatctgttctttgtttcagtttccctccatgaccctgagtactttaatagcctctattctcccatgtatctctgttgaacagatcataaagagtagtgattatgaatccagactttactgttactgtcaaatatcacattaatttcctcagccactttacacctgtgcaacctgaggcaaaattttgtaatatctctgtttcagtttttatagctgtcaaatggggttaataacaatccctatcacaagcagtctttacaggcatggaatgaaaaattgcttgtgaaatgctgagtgtaaggcctattatattcagtaactattacctctattttggttcaacaccattttgcagtctcccccaaacaccctgctgcaacacacctctaagccttggctatgctggcctaaaaaacttctagacacccttgatgacccaaatgaaaatcttctgaacccaaggaatgctttcctggctgtgtaggtggcaagcatcacactctcaagggagtaaaactgtgcctttctgcaaccattattgcccataacccatcatgttgtgatgcgttttttacaagattgtcttttgttgtctatgcttttggggttatatgcaagaaatcattatccagaccaatgtcacatggtttttcccctatgtttttctccagtcgttttacaatttcaggacttacatttaagtatttaattcattttgagttgattcttgtgtaagggatgagaaaacggtccaattcaattcttctgcatgtgaatagccagcttttccggcaccatttattgaagagactatccttttccccttgtgtgctcttggcacctttgtagaaaatcagttgatcatagacttgtaggtttatttctcagctgtctatcctattccattggtctacatatctgcttttatgctagtaccatgctgttttgattagtatagctttgcaatatattttgaaatcagatcatgtgatgcctgcagctttgtttttgcttaaaattgctttggctgtttgggatttttttgtagttccatacaaattttgggatttttttctatttctgtgaagaatgatgttggaattttgacagagattgcatttaacaagaaaattaataaccctattaaaaatgggcaaaagacttgaatggacattcctcaaaagaaagcatacaataatggacaacagatatataaaaaaatgttccacatcattaatcatcaggaaaatgcaaattaaaaccacagcataatatcacctcagacctcttagaatggtattatcaaaaagatgaaaaaaagcaaatgctggtaaggatgtgaaaagaaaaggaaacccttgtatactgttggaaatcatgtaaattattgccctcagtttacaaaacaatatgaaggtttctcaaaaaattaaaagcagaattatcatgattcaaccaattgaatcatggtaaacatctaaagttctgggtatatatctaaagaaattgaaataaatatgtcaaagaaatatctgcactctcatgttcattgcagcattatttacaatagttaagatatggaaacaacctaaatgcccatcaacagatgctaggataaaaaaatgtggtattgctacataatgaaatactactgagactttaaaaaaagaagaaaattctgttatctgtgacaacatgaatataactagaggacatcatgctaagttaaataatccaaccacagaatgacaaatattgcatgatctcattcatatgtgaaatctaaaagcatcaaactcgtagaagtaaagagtagaatggtggttgcagaggctggggacttggggcatatgttggtcaaagggcacaaggtttcagttagacagaaggaataagttctggtgagatattgcacaacaaagtgactgtagttaataatatattatgtatttcaaaatttctaaaagactggattttaaatgttctcaccacaaagaaatgacaagtatgtgaggttatgaatacgttaattagcctgatttgttcatgccacaatgtatatgtctatcaaaagatcacactgtaacacagaaatagatattatttgtcaattaaaaacaaattttttaaaaaggctatttttcttgctgaatcccacatgtctctggggctagggtagatgtcttttttaaccagattgtgtccagcttagtccggtgttcaataagcattaagtgtctgaagggtggtcaatggacaaacagatgaagggttgcatagattaatagaagtctaccatatctaggctgggagtggtggctcacacctgtaatcccagcactttgggaggccaaggtgggcggatcatgaggtcaggagattgagaccatcctggctaacacggtgaaaccctgtctctactaaaaatacaaaaaatcagcctgacgtggtggcgggcgcctgtaatcccagctgctcagaaggctaaggcaggagaatcacttgaacctgggaggcagagatttcagtgagccaagatcacaccactgcactccagcctgggcaaccgagtgagactctgtctcaaaaaaataaaaataagaaatctaccatatctacttctcaggcataaatatgataactatttcctttaatttcccattggataaataactgtttataaacatctagttgccagacccatgcttggagtctcagggctaaaagaaatgctccccatttgctctatgtgctagtcacatcaatcccacttgatccccacagcaccctttgggggaaagagagtagttgataatctgattttaccaatgaacaaaggctcagaaaagactagttgatcctaaaaacaccacacagcattctaatgttgtaaaaatacctggatttgagtcccctgtacactgatgccttgtggtgtggcattggctcagatgcttccctcctctgggatgtggactggcctctgaggtctctttaacctctggaatcatgtgagctggagcacctgttggctggggagacaaaaggctgctgcgtccagatctcccttcacgaggaagaaatgtgtctgcacttttcatatcaaagcacttgggcagcatgggggcgtattgtgatgaggctgatggatcctccctgaactggtgcctcagcgttcccatgccaactgagggaaggaaaagaaaaaaaggaaaaacaaaaatcaaacacgaaaactgagcttgatctagagctgaagaaaaatattctactgatggcaacattcatggccgtattatgaagaaaaacaaattcataaaaacctcagcttggccttaatggttggatcttaagatgagtgacaaatgacgaaatattgggtatgagagagaggcaggaggtgggaggagagcaggccctgcaatcagaatcacttatttgtaacatccattcacgaatacattgccctcagccacgcaggaaacccacacaggcctagaggatgctctctgcttttttcgtggtcctgccattcccaccagtacccagaggcccgaaccagcgaggagaaaacattcactctttctctgaatattcaattgaacttgttttcagtttcctgacagcatccagatccccagagtgcctgcatggctttattttttcatccaccgcctgctgactggtccctctcttaatacccctcctcccccagggcttgcttcttcctgttttgtggggagcagaacatttgagcttccaggggtagtaaccactagtgctggtaagcacagctttggaaatcaggggagggaccctcaaagaaccatggaaagtcccctgggccctcagaaagggagggatcaaattaagtaagggaaacagacatgagatatgggcagatgggaagctaagtagctgtggcagctccttataaagagatcacagctggagatgcgttcactaatcccacagaataatcctctgtttctctttcctgaacccccacatctagttcatcagcaagtctgtcagtgctagttacaaaatatattttgaatccacacacttttttcaaaaaaaatctctaccataaccccgtatccctcacactgtgatctttttcccatatcactacattaacctcctaacctgtcttcttgcctccttccagacaatgttccacctggaggctaaagtgactttttaaacgtattgagctgaacattccattcctctgcttaagtaaatgtagactcccttccttggcctacaaggccctccatgaacctgtccctccctaaccttacctcttgcccctctctcatgtaactggatttcagccttccaggccttccttcagttccttaaacaggccaagctgccagggcctttgcactggctgttccctttgcctgggatgccgttaaatctcatcatggctggctctagttcactattcaggtcccaattcccacgttactttctcagagagtgttccctgaacacttaatctaaagtaaatttctaattgccctctcttccagcacttcaacatccttcaaagcattttttttaaatagcccacaggtgctactaaactttgaagctttttttttataattagtacccattttgcctacttacttgtattatctgatgtctttttttacctgctcagtgtaagcgccacaagaaaaggatctgcttcttgttccttgtatcctgtgtctagtctggggttagcacagactaagtgcttagtagacatttatcaagtaaccacataaatgaatgaatttctgaagtggctatttctttctacctggatttgagctcagccctggggatacagacatgaaaaatacacagccactactctgaagctgctcatggcctaatgagggaaactgagaagtcagtagtttcaggattaaaagccagtagtttcaggattaaaagtatgataatgtatattattaatcatgtgtatacatgtacaataatagtaatagtggccaaacttgagccattatgtgctcagcactgtacaaatattatgcaagtattttttttcatataattgccacaataaacttatgagttagtattatcacatttaaactacataaaaatgcatttggcagatgcagaaatggagatactgcgaggttcaaataactgggccatggggacagttagtaagtggctgagtgaattcagcctggcatcgtgctccatgtcagagccagtgctctgaagcactagatcagtgattctcaaaagatgaccgtcctggactggtagagtcagcatcacatggcagcctgttagaaatgccagttcaaggccaggcacggtggcttacgcctgtaatcccagcactttgggaggccgaggtgggcagatcacaaggtcaggagatcgagaccatcctggctaacaccgtgaaaccccgtctctaccaaaaatacaaaaaattagccgggcatgatggcacgcacctgtagtccagctcctcaggaggctgaggcaggagaatcgctggaatcgggaggtggcagctgcagtgagccaagatcacgccactgcactccagcctggacgacagagcgagactccatctcaaaaaaaaaggaaagaaaagaaatgccaattcgagggtctcaggccggacctcctgaatcagaaactttggagttggggctcagcactctgttttaacaggccccgcagatgattctgaagatgctcaccaaagtttgacaaccactacctattgaatgacttaattttatgggatactagatcagactagatcagagtctgaagtttttctgtaactcagttctcatcttaacgctgtgagtgtagattgctctcaatccacggctgaagaagccagattgtgactgaataaagccagttaccctgcctgaccctggctccaggacctgcagcatgtaaaacatcatccaggagtgcagcccctgtgaagacagctgacctgaagggcatggagtctgtgaccccatccaccttgagaagcatgcttcaaccagcaaaggaaagacagtcctagacaaggaaacatcatcaagtctctctgtaggaatacttcatatcagaccatattgccatgtgttgaagattattatataatgataataattagtacaatagtaataccatacattttgattacatttttgacattttcaaggcatgtttatattctaataatctattttccctcttgataattttattttctcccttaaaaatctctccagttacacaaagtagagtaggagtgaaaggattgttaatctgttaatctgcctgtccaggggagaggcaaagtaaagagatgtatctgtgatttcatggcctgttaggttcgtagtaacaatagctaatgtgtgttagggagcttaagtgggccaggctctttgctagatatgtcagtgcttattaatttaataaaacctctagacccaaggcttccagactcccaactggtctccttcagcaagcagcgtttcttttctttcacctcactctgaattcttcagactctctagtcattcatttattttattcattcaacttttatttagcttatacatcctacagagaaggtgaagggcacagaggtgaatgtgctggcccacaaattgctagctctctcaggggaatccagaacaatgcagtgccacccacagtggagccttgaaggacaaaggcaaattatttaccaaatcaaaagttgccagattcaagattctctgcagttctttgaggtttgagcttggtgcataagaagaaagggggattttgttctaatgaaagacaggacacaagggcctacctacaaaaattgctgcaataaatgaggacatcattaaaattgtctttgtgggggcccatggatatggaagtgagtagggaagatgtatacaagcaatggaaggaataaaagacagaagacttcctagatctagtgctagaggctccatagttctgttccttacaaatgctgtaactttgggccagcctcccaacctattcaaccttctgcttccttctccatgaaataagaacctggatttcttactcacctgattcacagggaacctctgaaaatcaaacgtaagaattagtaatagtaataataacaatataaatagctaacatctattgagcaattatatttcttactttcactggcttatttcatttaatcatgaaagcatttccatgaagcagataatgttttaggccccagtttatagattataaaaacagaggtttagtaaattactaagttcacccacccttaacaagcagtggaacaaggatttgaattcagatctgtctgatctttgaacctattactattaaatcactaccccagaattcaaaaacaaatgaggaaaactctgcgagtcatgctgatgaaatgagcggaatcaaaagagggaacaaaagtgagggcctggggtcagaggctgttagcttggcatgaaggatggaaagcatttccagataccatgtcctgagtgagcacaatgcttaggctatgcagcagaccctggacagtggaccaaggtttaagagtcagtgtgaactttcaggaagaagagtttatgcagagtaacacatgccataaacagaagaaagtatcagggaccagagaaacagagtaagaggcagagctggagtcaggcagctgcagattccaatggcctctgactttctgctgtagctgcaaaggtacattttatttaactccatgcccagccctgtggcagtctgggagccctttgacagaactacagcttccacatctggctcagtggggaaggagaaatagatcttcccgggcaaaaagaagcagctcagtcttgctgccttcccttgagtctggacagaaccatcctcggtggtgagcttcccagagccttttgggagtggctcaggggaccaatttgcttccttgaagaattttgaatagcttcagatgtagctctggtggttgaagctaaggacaataatgaaaataatatgatagctgacattcattgaactctaatcaggggcttgttttaaggcatattttaggctctatgcactgttgtgtgtcttgctgctctcattacaccaaagatattatagcacacccacatctcacattgaatctgatttatgtgtgagttgagtggcattgctgcacactagttggtgcaatgacatgttttatagatatttaaatatttattaatttgattttacagtttgcttttaatatttcagagtcaatatatttatttttctggtcagacatactttttaggcccacccttcaaaagactgtaggacccagacactgagttttctcatgccacctggagaaagtgatcctgtaattattgtgttgggagctgagtgctcccacacattgcctgtggataagtgtaagactctggaattaaactgccttaggtttgaatcctgaacccactactttctagctgtgtaatctttggcaagtgccatatcctatttgtgcctcagttttctcatttgcaagatggttattgtaaggactgaatcagagaacacataaacagtttaaaatactacctgtaacctgtatcatggcatgtaaagttgttattattgatatttaaaatgtcccagtgaggtagccactatagttattcccattttgaaaatgaagtcaatttgatgaatggtggagagggacattgaactcaggtggtctgaccgtagagctcatattcataatgagtaagagtttgtatcagtcaagttaggccaggttataccacagtaacaaatgacccccaaacttccatgggctaatataacatgagtttatttcttggtcatgctgcaagtccaacacaaaatggtgggggagtggggagaggcattgctcctcatgcttccttagggacccaagctgaaagagggaccatcctaacatgatcacagtgtcaaaggaacttatgtaataagccacaccctggctctaaagccttattcccaaggtcacggacatcatttccacacacagttcattggatcaagcaagttgatggccaggcttaactttaaaggaggtagaaaagtgaaatcttaccatgtaactgcaaaattgggaatagccaaatgttatctcagaggaaggttttgaggatcaaattaattaatctatgaaattatcaaaaatagggcctagaacatagaaaaatcttctttaatgttaggtatgaattcttattaattaatgaattgcctcttgtagcagctctcctgtataaatatcttccacctgattctcttgttcctgatatctctctctctctctctctctctctctctctcaatgatccatcttgcagacctgatccattttattattagacctctctcttatcatgtcatctctcttgttctcccttgtctgattgggtaagttcagagtcctaagcaagatatctgagggcaatccgtaattcacttctaacctactctggaattttttctcccacttttctctaaggctgtgttctaactggaaggactcattcactgttcccaaattagactggcacattcctaccccatcccttgatattcttcattcttattgtataatctcccttctcaaatgcctcttgcctttctgcaattttatatccctcattatgcagtttaccacttcctccaagaagcctcatttttcaccacagcctgaaatgatttcattcagggctgaacttccacagtactactcatttggctgaactttactactcatttgaccctgaactcagactgctttgaacatttttttttttatttatgcttatgttgttactgttgtggaaagaacacagagcacagcatcagactcatattgatctaaatttcaggtctgtcattgactggccttgacaccctgtgcaggtcagccatgttctcgagctccttgcccctttcctgtgacatgaaagtgattatacctatttcataagaatgctgcgaggatagaattgaaaacaagttatagtgacctacatataggagatgactgtcctcatcatagctgtgtccctagtatcaagaacagtacctggcaaataatagtcagctcaatgactatttgttgactgaatgaattattagtaatcaccagccactcttactgcatgctagttttctccaaaagctgtaagttccttgaagacagctttgaaaagtaaagttctttggagtcttaggcaacggttctcaagcttaattatacaggagaagcaaggaatgttattgaaatgctagtagttggaatctggatgtactgaatcagaattcctggcacagggccaggcgcagtggctcacgcctgtaatcccagcactttgggacgctgaggcaggcagatcacaaggtcaagacatagagatcagcctgaccaacatggtgaaatccctgtctccactaaaaatacaaaaattagctgggcgtggtggggctcacctgtagtcccagctactcaggaggctgaggcaggagaattgcttgaaccttggaggcggaggttgcagtgagccaaggtcacgccactgcactccagcctggaaacagagtgagactcagtttaaaaaaacaaaaagaattcttggcacagagtctaaacatctgtatgataacaaacttcccaaatgatagagtctgaagattatgctttgagaaatcttattttggaagagctcctcttgactggatacaaatcttttcctggtagggctttgtaagacaactcatctataaggatgaataaactttctatccttctggactagctttcctgcatagctaactcatttaattccaggctagatcacttctaaaaaatcaatgcattagaattgaattaatttgtgttcacttaattgatatagtgtgtgcttttctaaatggcactaggtttgaaagtgaagctggtcacacttttttacagtaggcttctctaataacacttgattctgtctttgtacccagtgtcttctgtatagtattagctcagggatttgtacgttgttggccaacaaactttgttgatgcattgaaaaatacagtttcctaattgcaactccagtgaacctgtaatatagtaagatcctacaggtctctgtaggaaatattgctactgaaagtcaaagatcactcattaagtccatctcatagttgattgtagtccagtggaaatatttgctatatttggcagaactgtctttgtataaatagtgaacagatacattccatcttagcactgccagcttaggatctcttaaggattcgactatttacttaactgaggtacagcccatgggacacacatcacctattgaattccaggtcttagcagtttattagaagtgtaaacaatgcttccattcaaaaaagtcaactcatccaattgttaagacgatttatcttttttctttcatttcagcctagtgcagtgattctcagctgggagtgattttgcccctttcccttcctgggggacatgtggcaatgtctggagacacttttaagtgtcacaactcaggactggagaactactattgacatttaggtaaaagcaatggatgtgctaaccatcctgtaatgcacagaacaaacccctacaacaaataattatctgggctaaaatgtcaataatgctgaggttaagaaacctcattctattttttgtactcattaactatccccctcaaaacatctcatgtaccccataaatatatatacctactatgtaccacaaaattaaaaataaaaaagagtataaaattaaaaaaaaaaaccacctagtctagttctttttttggccaagtgctgggcactggttccctctgctatttcattgtgtggaacctggatgggctactcagagtgttccttgttcagaatcaacttcagctggcttactcttagtgggaaggcaaaacttgggagataagggtcatctcaatttctcctttctttaagcactagtggttagccctgtagctggaatacaaaccacaaccctctctcctgattcactataagaacctggcttggacttctcaagatagttttccctcctcatttccctggcttggttggaacacactccactcagtaagttggagagtctctgtgggtatacaactggcactttgattgccgcaactttgttatctgtgatcatggtatataataatcaggatgaaagtcaagtttcctattagtaatttagcaacagtcactcaacactgtaaaagaaaactactcctgtggaaattaaacagagtcattttcttgtggtgaaaaggtcctgggtttgcctcagtgggtctagatttcagccttggctactaaacttgctcatgggcctctgtttctttatctgtatgatgggaataataatttctgccctgattacattaatgatggagaggatctataagatggctcctaagttctgtaaaatgtaccgcagttgctccccaaaagtgaaacttgggattgggaaaacttctacacaatcccagtctatgaattaacacttaggaatcactgcattattatttgaagaagtatatttataactgcagcatatcagcaaaatgaggccaatatagtaaagcaaaatgtatattttaaaggactcatattctaagcttatactctttttttgttcaaataccttttctattatgcaatgttatggtgatagattgcagaatgtttggttgtgttttaaaacaacttacatgaaaatatcaaacattaacaacctgtatcagtcccagaaatgtctttaaatatttttctgatctttgaaactgaatccaaaggaactctgcaaagtctcctcagcaggaatgttatcatggatgatacattgtgaataaagttgtgtgaatgtaaactggatgcatttggtatgttaaaaatactgttcacatgctttattaattcatgcacaatcatctgcaggaggcagatcctatttgcccgggatcacactgaaacacaaagagggtgaatatgtgcacagggcagcaaagcaaaaagatcagcagctttggactcaggcaaagctgatgtccctgctgagctcagccacttatcagcttcatgactctatgctaaattttaagagcctcagtttcttcatctgcaaaaatggaaatagtaatactaccccacagggttgtttgtgtgactaagtgagccaatatagggaagaggctagatagagagactagcacttggtgggtgctcagggttgtttgtttcattcatttaaattatttccagtatcccctagtgtgtaaatagtgaatctgtgacatggaggctcttccaaatttaatccagtgccatatgccttcgtgatgctgatcataatcttgagaacacaatcctgaactccgcaatcttgaatactgaaatcgcaaaaattcaaaatccctaaagtctaaaatttccaatagctaaattcctgaaaaacacaattttgaaagattaaaattgcaaatcttgaaatcttgcaaatcaaatcctggggaagggattagtgtatttttggttgtacacaggataggtgcatcgtgttagttacatcatattaggcagaactcttatcctgttattgtcttcatttggaaattaattatggtttaaggagatgcatattggagctgacaaggggcagacatgtgggcttaattttaggtgtacacttgactggattaaggaatatctaaaacctggtaaaacattacttttggtgtgtctgtgagtgtgtttccagaggagtgtgtgacctaagtggattaggcggggaagatctgccctcagtggtggcaggcacccttcaatcagcagagggcacaggaagaacaaatacagaagtcaaattggtctctctggcagctggctggcttttcttctactgcactggacatcagaaatattccaaaaagtgtagtttcacaatgttcactttctccataagcatcatgtgtgtacatgaaaacatggaaacttccttaataaatgtagagatgtctttttgtatatcttcgttggtgaaatggaacatttcttgagatctcagttctgtgagcaattgcaagtgtggtgatgacccattgcagttcttgatcaatttcgtcaaaagatttaggttgtccatcatgtatttcagatgattgcagtagtaaagcttagtgcacacaattaccaaccatagttatatacatttgtaaattttactttttgacttattactttatgagtacagttcatttgcacatctttgttgtaaccatgaaactgccattagtacacctgagtgtttatgcttgcgaaaatgtgtatgttattattgaatattttattgtatagagtggactatgtgtgttctttgcatttttatttttctcaaaacatatagacattattttatgtttctcaaataaaagaaacattgcccttttaaaatgtgaataaatgtcttttaaattttctttttattattttttccagaatatgtttttgggtttttgatcttttgagatttcaacatttgggattatggtgtttgggattgtgtctttcaggattatagccaaacccatttcttctctgcctctgaacatctgcaaacccactattctagtcctcacttttaagggtacaggctcagaggactaaactgaggttctcaagcttttatgtgcatcagactcacctggaaaacttgttaaaacacagcttgcaaggccaaccccagaatttctgatttgggaggtctggtgtgaggacaagaatttgcatttctaccaagttccaggtgatgctgatgctgctggtccagggaccaccttttgagaatcactgagctaaatgtttctttctcttttcagcaacatttcactcctgtggttcctgactgttgttggcagttttcccacaattttccaaaactggtcttcatccagtgtctcctctcatagtagacatcacattcatccagaaaataaggcattctcctatatgccttcttctctcttcctccacgttccttctgtcttcaggcattgtctcactggtccctggcccagtctgtcaatcagctgacatcactgcccccacttgctttgaatcatgcctcctcccttaatgtctatgtgtccttgcataggttggttaccagagtagatatacaaagaatgaatgagtctccccatctttccgacctcaagaacttgattagtggtatcctgactggaacaatggaatatggccttttgtctgcaaacagaaacaattatagcaggttttctcactagggtcatgtttgcctattttatgttaataagagctgttgtattgacttagctgtctttattctagtcacttctgcttcacaataagaggctatctgtgcttgcgttccagggggtgagttactgtcttatattgtctgacagggctgtcccttgaggaatatctttccccaatgccagttcttgtagaggggccaggaggtcagaacttaagctaacaaatgattatctttctcagcagaattaccagaggacctcagactcctgggttcctccttaagggactcaggttcagatctttggcccagaacacactgtaacctctgagttcaggctttagatgaggcacctgtcaattcctatgggacctcaacccagtctcaaatacttggtcaaaaggtgagttgaaacttaaaacagtaccagcccctggacagtataagttggtctcatcacatcgaagtattcatgatgagcatcataaaatcttctgagagttggttttgatgaacagataaggaagaataccaacaccctaaaagttgagggcaattcaagtccagatgagaagaaacgtgcaggattgcagacttggaatcccaaagaggcacttagtaatggttataaactctgagggttattcgtaactgatgcctggccttggggtaaatggatatcctgaggctttgggcagaacagttgcaaactccccaaccttctgcttttcttggaggtgatgtttgtatgaaaagagcagttttctggaattcacacaataaaatgagccctctcatttcaggccctctgctgggtaatcttgggcaatatgcttcccctctctgagccttattaccctgttccctcattttcgaagcagattctaacctccgatctgcttctgtggtggcctcactgggatattctgaagctcaagtgctgctgctgctaataataataataccaattactatagcaacagcaacaactctaactgtgagcacttgtgctgtgcccagctctgcggatggtctcatgtgttccatcagcccgttcttacagaagttctggtaggtagttactatcattatacccatcccataggcaaaaaaactcagccacagaaaggttaaatagcttgtctcaggtcacatagctaatagtggtagagtctgtactggaacccagcactgtcctgcatttaactgctatggtacactgctctgtagatgttaaaattacttttggtgaactttaagtaactatcaatggaagatgatttctttgccatgcgacagtttgctctccaagctttaagcggatcaccaaggagtctaactcctctggccctgactgcctccatcttggtttcttgccctgcatgggttcatcttttctttgtttcccctctctggcattatgaaaatgagaagcagctgtgagccctgcagattgcaaatgggattgtgagtgttgctatctctctaacaactaattcattacccagtggcagatagtttccgctgtgctgttacaatctatttgacttccaggtgccacatggaataaaaaacaatttgttcaacagttgggcctgggtgtttgcattcagacaggcatgctttacctccctatgtccttgagggctgccctctctggtaaggagccttctttctgggcaggaaaagctcactgcacaggtgatagacactgaaggatatgtctggacttggaagtaacttgatctaaccagccatacctttcagaaaatattccaaaaatagttactgaacacctatgatgtgccagttactgtgccaggagctggctatgcagtgacagtaagatagacgcaagctctgctcttaaaataagcacatctgcagataactaatagcagtaacttcagataataataaaggtcagggggaaaataagactgggtgatgtgacagagagctgttggtctggacagggacagagagggatggttgaagaagagatacatgagctaagatgagaatggtaagtgagagttggctgtgggataatagtggggaaaaatattctaggcagagggaacttcaagtacaaaagtttttaggtgggtacaagttgagatggttcaagtaatagaaaggaagcccacatgggggttgggaggtggtgagccctagaggtagagtgctaggagaggtggttgtagggtcagtcagggacaaatgatgcagggccttctagaccatgggccttcctggggatcttctctttcagccctctacgggcccagccaaccaaggcaggaactgccttctgtgtattcatcatatctctgaagtccaaccccaaacctctccaaggccaagtctgtgtctttttctttctaaatatcctcacccaaatcttacacagttcttgacacatagcagattctcaggatagcctgatgacttcaaggtataagttaaggaagatattgcagaccacagatatattttatttataaccaaggaagagcttatatttagcaaaagtctgcacttcctcagtaggtactaagctccctgttactagaggtacataagcagaagatggaagatcagttggtgggaatgtattgaatagaggtagtagtcatggtgttttgcaatagagatagcagtagtggtcacaatgataaaaatagtaatattcctatgtattaaacagtcaatatatgccagaccctagatgtatattatctcatttaagcttcctaaaacaacctcataaggaaataccattattatttccacttccagtcacagagactgaaacctctcacatttaaggactgtgcacctggggtcaggtagtgagtaagtggtagggtccacttgaaaacccatacttccagtccatacttgaaaaccctctctagggaaacttaatgattggagtccatattttgacttcatgtatcttggctttttatttctatccagagctttattgcagggtgtagggggtgtcactcttttacagcctttacagcccttttacatatattaggtaataatatagaattgaattctaaaatagctgaaagtatgttttttcctccagcaaaatcattccccaaagatcatccccaaactgatgagtatcttgttcctgtgagcattactgtactgatctttctcccgtcatgtagtactttgttatttgagtcatttcagctcttcaaggtactcaagagtaggtgctgttgccttacactgtttaagcattctcatagacctctgaatttcttcagacctcacactcactccttgttgtgatttaatatctgtcttcccaacagggactcaagctatatccccagtacctagcaaatggcaagtggcagacacccaatagacaggctgaatgaatgaatgctaagttctgtctatcatcttcataccatggctgctcccatttagttggaacgtgtgctcttcagtttccacaaaccccacagcagtgtcttggactcctcaacattgaggatgtcatgtatgtgtcatttattattatccttgcttttgtgacacccaccaggctcactggatcacattgtcaccctagcccctgtgggcatctggatttgggaaccttaacctgaggatcttggtaaaacctcctggtgtttccggtttgggaagtaggctgtagagtcaatacctgcggtcaaacatcagccctacatcctcactaattgtgtgaccttgagcaagcccctttacttcatctagctaataaaaaataaataaataaataaaacagtcacctctgcataggtgtatggcaaggactgagtcaagaaatttttaagaacacttagcccaggacctagaagattctagtaagggtttagtaaatgttaattatggttgttagtaacatcatcaaatttttaaaatattatcacactgactttttgtgaatctagacttgctagctctggtgtgcatccaatgatacaaacccccatattcaacattcctctttgaaaggtttcacagaatgttgtctgagctgaccttaaagataccttgcagctccaaagttctgtgactttcaccaggagtctcaaggcaaatgcacagaagggtcaggcaagtatcgtgaatggaggctggaccagggagcccatgcattcttccaaaggcatttcaattcagtcttgttaaagcactgagttgcacaaaagaaacgtcactgttggccagcctcggttcttcggctagctccttcaacccaagtgtatcatctaggatggaggaggcttctgagggactgagggaggacaaatcttggaaagagaggtacaaggaagagatgggatttggataaggcaaggaagagccaggaggctttggatgaactgacctctagatacattcatttttatgccaaaagtccatttcccactctttaaaccccttcacctcttctcaagaaacttgtgtctcagcttcagagagccatggcctcatttaaaatgttgtgaaagaaggtgatggaagcatcaggttcctaggctggtgaatttttatttttatttctccattgacacagtttaacctttgcttttggcagctagcatattgctcaaataaagtgaagagaagggtgtgggggagaaggcaagagatatttggctagaaggttatgagaatcacaatagctgtcatatgagtgccgagcattcttctaagcacatcccatgcataatctcatttaatgctcacaatagtcctctgaagtctaatgtctatttagaaaagggaagcttatctgaggtttagcatagaataactcacccatggtcacctatgtgaaaaaagtgcagagctaagaatggaattgaaatctgtcaaactccagagtgtagagactgaccaagtagaccccccacttccaggccaatgcatttcggcacttgatttgtggcaaggagtcctctcagggttttggggctatgctggtgcttgctatgctgcctcggaaatgtcacctaacctagaaatagtgtttattctgttacaaagcaagttggaagaaaagaaaacactccttttttcttttttctgtgcctcctctccttactttcccctgaaacttaagttccaaggagtgcaattagcaggtcagcttgtcttgctgaacagtcaggttactttccctcagtatttgatgccaagtgaatgttgagctgaaaggctggctgataaatgcccctctggggagaaggaactgtgaaatagcctggatctattggcagatactagggccaaaaagtccttagaaactcaacctgaaaaaaatgtctagggaaagcaaaacggccaactaaggtagtaaacacttcagaaaaccttgataatagcaatttggaaaatcttgcatgtacagtttcatttcataaacccctccagtcatgggatggatacagatgtcttgcctgaaaatgtaactggtaaatttacagataataatgtattggtagttgctcacagaaagacagtatcacgttgtggagtaagtgcttgactgagactaaaaggtcttggtatgagcctcagggtcatcattaccagctgtgtgaccctgaagaagtcaggcattttcttggccatctatgaagttggattttaactccccaaccctaatccaccagccattcttaatcaaggagtcagataaatgtctggcccctgtgggattcatatcactgtcttcagagaaaagggcatatttgaaaaagtgtattctacacggtaaccttctagagaggcacaggcctttttttgttttgttttgttttgttttgttttgttttatttttgaggtggagtctctgttgcccaggctggagtgcagtggcacaatcttggttcattataacttttacctcctgggttcaagcaattctcctgccacagcctcctgagtagctcggattacaggcatgcatcaccatgcctggcaaagttctgtatctttagtagagacagggcttccccatgttggccaggctggtcttgaactcctgacctcaagcgatctgcccgtctcggcctcccaaaatgctgggattgcaggcatgagccaccgcacccagcccaacacaggccatttttaatgggttgttaggataaggtgggtaaatagatgtgaacgtgccatgtaaatttagaatgtcaaacacgtacagactaatgctatttacccaccatccaccaccattgtttatccagttgtttattcaattgcaaatggcttcttagcctgttggagaaatgatctgaggtggtcagaggtatggcccatatctgtcaaataaagcaacctcctggcacatatgataggccaaaaccctatcacttgggatttgtgaacaacattctccagtcagctgaacaagcaggtgctagaaaagagtgtaaataattcaacttgtttcaggacatgtgtttaggtgagtaacgtgaatgtgaacagtttttatcttttatttcttggtctcaagttggcactattaggcatccattcctaacataaaatagtgtctatgaatggcagctggtcattagatgtacatatccaaatccaagatcagtacaattttcacctccaccttgtcttacctcttgcactccctaactcagtggcagtgccacaatccacctaatcacccagaaagagaccaagagacttttgattctttttcccttatccatgtctttgatctgccaccaagttctggagctgttacctctactgtctccctctaatctgtcacgctgtcaatggtggcaggaaataccgacagcagctcctaactggcttctgccaccactgcttacccactgccaaatccatcccaattcttgctgtcagaatcgtccttttaaaacaaatcatctactgtggcactccttgttccacacctggggaaatccagcctccgtagtgtgatattgaaggctcagcagactctgaccctgtcccatctcaattgtccttccacacccctcccctaaattatgccacaaattcttgtctgtgttctaaacaatagccagatttccctcatttccctcctgtttctgccctctgaccaaactcaatttgccagcaatgctctccggtttttttctttcttcatccctgtctcctctcaagacttttaatcgtccctcagggccaagtttagatctaatccctaccaataagctttcctcaatctcccacccctacctccacaagaattagccttcccccattatatcccttatcattctgccgtacattagcaagatttgtatgcatgactgttagactgacagctcctttgggggaaagggccttcttgtgctcatctgtccatctcctttctctcttcttcctcttgcctcctccctcctaacctcctccagcccagcatctaagtgcagtacatttcacataagagacaccccagcaaagtgtgttgaatagaatccattaatttgcattccatttctttggaaatagcttttggaatccattgggcagatagtgaaaatttcaactaacatgatggtggagaaaaaccttaacttttgtgctcatgttaaatttagaaacattttgtttcattctatcacctctgctaacctcttaactaacttgaggttatggagaaagggcagaagacttatttttctacttctttaatatttccggtcaattctctcttctccatcagtattgccagtgccttcgttgagacaggtcatctttgtggttaaagtttgaagtccctgagataagactatctgggttttaatactagttatgctaacagacagaccttgggtgagttagttactctttctgggcctcagtttcctcaaccataaaatgaaaatattaatgctacccattttgtagagagagattccacaggcctagttggtggccagggaaccctgggataataaaagcaatcggacatcttgggaaccaggtaatctcctaacattccaaagatacctgctgtcccctctcaacgccatacagtgtgtgccagtagattataaactgcataaggaaagagatgatgtctgctctcctccatatccctggctcctgacacataagaggatcataaacgcactttgcaaagcaaatgccagctctggaattctgcagcagcctggagaccagaccctgcacatcaaggcccagtggaaaactaatgatttctcccccgcagacctgcctagcgaagggccccgtggagcttggctggtgagagcattcttcattctccgcatgtccctggctctccctctctctccccacctccgcagcctcccagtcaagctattgtgcatctcctgctctctgtgtctcgctgcctgggtccctttctgcgctgctgcctaagcattgtctgtgatgtctttagtgtgaaaggtgattcacagaaataaattgcattgtgttttaggtccatagcaatctacctctgtaatcatgtctgtaagggacttcataatagtgtgagggccttggtgtcagaaccagggtctccagtggcttcaagatagataagtgctgcaaccaaatgcacattcagccagtgaagttgcaagttagaggtgaagatggaggtgctgctgctatgaagcaaccatactctcagcccttttatctgcaggttgataaaaatcaatcaaaacatgagatgtggttttttgtttgtttttaataaccactggaaaactaagacttgtttaatagagtctcagccaacagcttgtgctcttaccagccctgtgattagacgaaagggaaagttcaaagtgtcacctagaagggggaggcaccaaagaagaagaggcagggaggtgatacagtgaaaggcaaggaggagctgggctggaatctgagaaacctgagactgatttgttctaatcatcatcctatgtgatggtggaagataagaaccacagattctggaaggaaattgatggcatagactcaacaacagtgggatgaatatttatacacaataaaaggggggcaagctggttctcccaaaatatttagaaatgatgggaagtagggggaattgtgctcccttgatcacattattcagaagtgactgcattcttatggcatttttaacagtttattgagatataatttatatgccatagagtttacttatttaaagtgtatatctcatgacattttaaggtgatatattgttaagtctatgacaaaaagatttaaaggaagcaatgtgaaacaaagaccacaagatgagtagagaggctgtcaaaggtggaggggtgtttttttaatgtgtctgcttccccagcaactggtagatctgccctcatcccacctcccaccacccaaggtctggctatgcctgcaggttcactacatgaagtaagaataggtggctcttagtcagctcacaggacactcacacagctaaatgctaggaatccctctgggaggtctactgcaatcttggaggtttagaatttgttccgcttgaactttcagattatgagtcccactgcacagccacccacccaccctttttgtgtgacacttgcgttagcacaacatgtccctatttctccctctaattaggtctttaccaattgatttagaggccatgttcagtttccataagcaatcaggtacatcctacaggtgcgttcatatggtatcatttgtcctcattcctctggatggttatgatcctcaaaactaccttacctgtaacctatactaaaatatcttaatcctagcatgtgtaattccaatgaagtccttcctcttgaaaactactcttggttctgttcttgaattattttctgtcaatatcttccttggaatgacactggctgggtttgtgaactaatcaaacctcatgaaggggtaactagctggccagggctgagagaatgattaaattaggtcactgtttcctaaacacaacccttctcctatcttcatgtatttatcatatctgtgcatttacttatattttcctttaacaaacatattttaattaaagttatttaaaaaggaaacatatcaactattgcaaatagaaaaaccagtatcactattaataggtagaagctataaaattaaaacaaagcattgttattatattctagccatatgccattgcattcatagcgttctgagcctgattcttgcctctttttgtttaaaataaaagggaaatggcaaggtatggagataaataatttaccaaacagattttctttttcacttaatagcaggaataaaaggaaatttaaaatgaatgtgcatacgcattgtgagtctgttgtttaatgccattctcacattgggaaattccactcaccatacctgggttctagtctttactgagcaattaaattgctatatggctagctcaccttcttgtacctcaatttgtacatatgtagaatgaggttggtgagttgaaatacagaattcctttaaacccaagtttctcaatgttgctcacgggcaagctgcacctgaattttctgtgtaggtatacttgttgaaaaatgttaatttctaagctccatccaagatattctgaaaaagaatttctggaaatttttcctgtttttatcatttgtccagttgaccatgggatattataagattcaaaccatcaccttaaagcctgtatgataaactgaagagtagaactgaactgtgaataggaatcaagaggtctccgtttcagcagcaacttacagtgtaagcttgcgctcagctaaccactctcatttctccatttgagcagtcaggtcacattcggaaggctccaagtcccttccaattctacaaatacagtgttgggttgctttgttcaaagttttctctgaaaatctgtgctgaggccaggtgcttggtaaggttgaaggtagagatggccaaatgacagctgtggtctgtggggtgcattgtcccctctggaaagccagccagtgcacgtggagacgagccagagctgcctctgcctgccttgccttaacagcatatatcctccagcagggccagccagatcgggcaagcatctgcagaaaggcttagcgagatctcttgcaaagtcagcttaggccctgctggagagacaagaaggaagacttctatgaatgctaagtgggtagaaaggaaactacagcagggtctggcttggattaactcttcatatcctggatgccctggattgagatctgagtctatgacatgtgtgtctttttcaaactgcctcctaatgaaacacatatatccatcatccagagactaaaaactaagtctcaacctgaacttcatggccccccagagcactcctagcctgtcctctctgcctcaactcccatggttggccaactggttcattgatcaactgattaattcatccaccaattatttttgagacaaccactctgggccagaccctatgttagttactgagaatatacttgtgaccaagatgaacaaggtctcttttctcatgaaatttaagggaaaaaataaacaaataaacgggacaatcgcagatgggggaaagtgctttagagggaaagaataaggtaaagcgataaagactagcaaaggggaggcctgtcaaaagaggggacatatgagacccaaaaaaggagaaaaacccagtcctacaaatattgtggtaatgttccaggcaaagggaagaatctatacaagcctctgaggcaacaaaaggcttgagtagctttgggaattgaatgaacgttggtgtggctggagctaagtaagataaagtaagaatgatatgagatgatgtaggagaggcaggcagtacccaaaacctgcaggacccgggaggtcacaattcccatttccaggctcttctcttcagcctaactgcaatacattttttcttgagcatacctctactttcccactgccttcattttgcatgtgcctaatgcttttgtctggcataacttggcccctaatcacagtataagcaaattcttcctccattctttcgtacccagctcaaacattacctccttcacagagcttgtcctaaataccacatttatgctgagtagacatgagcttttccttcttctgaccactcaacttcccctgagcttcatttactctttctcttttgttctcattcccaagattaactttcagtctaaaagttccttgtgggaagaggaaaggacctaatatttgaaggacactatttgtgccaggtgacatgctaggagcttcatatatcccatttcattcatgactatagtcttgtaaattaggtgttattagcctcattttagaggtaagaaaccagtgttaaattacttgaactacagcacaaaactacatgatgcaggtattaactctaaattccctcagtatacctagcattgccccttgctcatcattagtactaatttctcgaagtgactatacactctggcaacttctaatcctcatttaagaccaagaaaaggccggacactgtggctcacgcctgtaatcccagcactttgggaggtcaaagcaggcggatcaagaggtcaagagattgagaccatcctggccaacatagtgaaaccccatctctactaaaaatacaaaaattagctggacatggtggcccacacctgtagtctcagctgcttgagaggctgaggcaggagaatcgcttgaacatgggaggtggaggttgcagtgagctgagatcacgccactgcacaccagccgggtgacagaacgagatcctgtttcaaaaaaaaaaaaaaaaaaaaaacaagaaaagtgttgccaggtatggggcacatacctagaactgtggccattcatcctgcaacttgaactttgggcatcaccttgatccctgatacctacttctcttcatcccaatctgctctgtccttctgggccagcctgttcttcctgatgataaataagtattgaacctgagcctattataccccaggcctcagctgaagtgtctatcccaaagtgcttgatgttcagagagtagctctaaccaaactttccccatccagaaggatatccaaagacaaactcattgtctataacaccaagagatagaacccctataagtcaaacttctatgcctcccctacattctccactttgtagagagatattcaaatcctctcttttcctgttaattactgagcagctgtggaatcagcatggatcacaattctgccttccttttgaaggaataacatgcaagcaggagttgccacattgtgatcatggacttacttcagatgtataataaatgacatcccatgagaatggcttgacagcagctgatggcacttggcaaagcattctttatttgccataggatgaaattatcactttactaagagtaagtgtttacaagcaactggagatcaggaactagagaaaataattccatgtcccagattgaaggtttacagcagatatacagtggagtgaactagcaatcacagagtctagtctttgctctgccatttgctagctatgaagccttggctaacttcatttcattttctatgattcatctcatggtacctcctcctagaagatttccttaaccacttcctcttctcccagtctggccaggtggccctcctatgtccttccatagtgcctttttttttcatttatcacattatattataatagttatataaacactttcgtctctcactaaattatgtgagtaaagtatagtgattaagaacaagaatgttataatcagacagatatgggttggaaccagggtttggctgtcatctagctatctgataaaaatacacttcttagagcattgttataaggattaagcatacataaagcaattagcatagagtatgggtcataactagtaaatgttttgccttttatttttgcctttatagccacagtggctaacgcaatacctagcacacatggtaggagggttggtgatggtgatggagatgtgatggaggtggtggtgatcctggtgatacctgagtggaggtaatggtggcaatgttggaatggtgacaatgttgtaatcccagtggtaatattataatggtggcagttgtggtggtggtggtgatgatgatgatagtaacaaatgaggatgataagaatcaacagctaacatttgtagagagtttactattgtatatacaaggcatggtactaagtacttgcatatatctaatttcatccttttgacttcttttagatatggccagtactccacatctttcaagtgggtgaactgaggtttcagaagttgagtaatttcctgagagcctacatttagtaaactaagacaaagtcagaatttgatacaggccatatgatgtcatcatatatatgtaaagtgctcaactgttggttacttgaatgaggaaggaaagaaggaagaaagagaaggagtgagggagggaggaatttacttgttttctaatcttaagattccttttctgaaaatagagataattctagcatttatggaaatcaaatgagattaaaaaaagtcaaagctctttgaaaactgtcaagtcttctctatgtacgagggctaaaccatcagaggcagcttcataattactcattcattcattcaatagatatttggttttctgttttaggcactagaatatagtgggcaaaacaaactaaagtgcctgccctcagtgagctttcagtcgagtctagtgacagacaagcaaatgccaggtgaaatatatagtcctgtgggaaaaaataaagcatggagggggtgagggaatatgtgtgtatgttgggggtggggtcactctttaaatagggtggtgagggaaggcctctgataaggtgatatctgagcagggcctgaaaaaggtaagccagggagtcacacagaatctgggaaaaaagtgttttatatcccacaggggagtttaaaagtcaaatgaggaatgatatcactgtgataagaatgctaggaatgggattatgcaggaaccccaaggcctgctgccagtgactatgcagtcaagtcagtcttttccttggtaacctcctctggtggggtctctgaaggctcagtcaaggtgtgatgtcccaggggagatactattatctgaaagcatggttcctctggcaacaggcaatgggtctgagggagatatcttctattctccattcaaccatccatgagcatgatgacactaggcaggtcatctgtgctcatggcatcaccccttccagctgggaaagacaaaggaaagtcagggaggttctccccacatcaaatggaaaagtcctgctccaccagggtctataatgaaatggtttatttaagtctataatgacctaagataaagttaatttactttattcagatttacagacattaccaaattacataggattgcaaacacaggagaagataaaataaattaccaaccagattgaagagcttagagaaataggtaaatagtcatgggaagagatttaatttagataaaccaaaggcaggatatctggaaaatgccaaggtcagggaaaagccgagaggaaaagatagctagtaagatggaagagacatggaaaggattcagaaaatgacgttggtgatagtgagtgtggccagtattatgataaagatagaggaaatgggaaagatattactgaaaaatatggcttctccttagaatcccaaaataaatgaggtaatttgtggaaagcagtgccagactggattctgtggtcttagttccaagtctgctaggaactgcctctgcaacttgggaaagctttttgatttttttctaacctttagcttcctcttctgttatgacatacaatacggttctaagtctaaatgtttctagttctcttgtgtttaaggaaggcgccatgtgctctgaggagaccctgaatccatccctggtcctcctggctgaccttaatagaaacattgaaagatggagattcatgacaagtagtcaaacggaaaggcattcattttggagatggatcaagggtccaggctcatcggagacactgaaaaagttgaaaggttgcaaaattgagggagaacgacagttatgatagttcagtataactgggttttgccagaggttgtagaaaaaagttaaagattgatttgaaatggttgaggggtatgtacaatgcagaaggaggggtgagttaaataagacaatttataggctggatgtcttcagggactggggggaagtttgggtatctttaagatggcatggcagtctgacatacaggaatagttgtatccactgcaaatcataaccttctatgcatttcagggtcggcttaaggatatttgcaaagaacatactggagggagaacatcagacttgtcctagttgcttgggtcccgggttagttcaccactacagcaatgtgggagctaactgcatgctaagcttggcatgcagggattggcaaaccttttctgtaaaaacccagatagtaaatgttttagattttgtgagccatacggtctctgtcacaattactcaactttgctgctggagagtgaaggcagcaactgattggtccctcttataattgaagctcctgagatggcattctcctgaatgataatatttaaatgaaggccatagctgtattccaataaaactttatttacaaacagatagctgaatttggcccacacaccatagtcggccaacccctgtttaaggcatgatggccctgcctattagcaaatatgtcctcatcagtgtcctgaaacatgttcaattttatgtgtaactcctccctattgggaacaaagtgagggccaacaattcttttccagtaggtggtccaaagaatataattactgaggcgtgtgtcactggaaatgcattccaatataacaaacatcttaggtacttaacttgttcattgatgtttgaggatgaatttgtaggggaacattagatgttcgtatgattgacctatgttgaaaggagacttactaaggtagaggcaggttttcactttctccaagaaggaagagttgaagaagtcccttcaatctagaggaatcatcattgtgcaaacatcagggaagagatggagcaaagttaaatggctggaagtcacagggagctctgttatggctagttgtaacacagattatgcacctggagctttacattttataaaattttttggaagtgctttgttaccttacttatcagaagatgctaaagtcattcccataggttctccatgaatgaaggaattcaataattattaccgatgatgataatttatgcttattataatgtaatggtcattagcacagcagcagccattcactgaggcactgtgcccagggctccacaagcatcatctcaagttgttccaacagtcatgggaagcaggtatggggaacgtcttacagatgaagaaattgagagtcaggtttgataattggcccaaggaaacacagtttattataagtgccaaagtcaggcctcaaactcagctctgctcccacagctgacactcctaaccaacacattgtcctattgcacaactgcagcattctttcattagtgggtatgttaatgtgaagaaccagcacttggaccagtgccttataaggatcctttgaaaccaagattttattgtggttgaagggcagagagctaaatcaccaaaatgtgtaagtagagacagaccagaatgtaatctccatgaaagcaatgtccttctctgttttttaattttttcaccatgttatccctagcacttagttgtgtctgataaatatttgaataaatgcatcagtatgtgaacattatttggaattattttttctttttaatatcaaaaatctcataaccacctaggccaagcttaacccgtgggcctcaggccgcatgcagcccaacacggctttgaatgaggcccaatacaaatttgtaaagtttcttaaaacattttgagactttttgtgtgattttttttttagctcatcagctattgttagtgttagtgtatgtgatgtgtggtccaagacaatgcttcttctttcaatgcagcccagagaagccaaaagattggacacccctgatctagcctgtctcaatgtctaggctttgagacacccctgatctaggctatagaaatgtctcctatttctctctcttttaaccacatagttcaataccctggacacagtaggcacttaaggaatatttgctaaggatggggcatgatagctgacccttaataaataaagtgctacattgccacagtaatcaacaaccttctacccttcctagctcctgtgacagatgcaactacttcttattccccatgtgggagttgtaactcaacacttctctcccctatttatggatgcagattggaaaatacattagaaagggagaagccaaaatatcctctgatttataatcagtactttggttgaaactttcatgactatattagtaatagctagttacctgtaacacagtttagagccattaataaaatacctcgtggaacttttatgtggctccatgtagcagagctcagacctgtggaagaacctggagtaattagctggaaggatgttatcacagttagcaccatccaaagagtgaatccactgcagagtgaactaatgagccctggtctgagagacactgaatcagaggtgaccaggagtcaggtatagaggggctatactaggtataggtcagatataattatcactaaagcccctttaaaatataaacgtcctagatttttgacataccccatgtctccatttattgtgacattgtcttttggtaaatgaaccccttctcataaaaaaaatttttgttgaaatataatatacatcacttgcatgaatttttactcctgcttgagcaggctgagcctggttggtaatgttagcaggatctcagtctatggcagacatactgactcttcctttgcttttaaggtggtgtgatttcaactaacagaattcatgttgtattagaccacataagctcatgtcctggaaagagagccaccttgccaaccagttcataaaaattagctcagcactttctcgtgagctccgcatggtcctgggatggcctgaggtgggtcccagcaatatgtattttttaaaaatcttctcaattgtgaaacacagttctgaaatagaacttcatcatttggggtctgcaaggcgaatggtgttgtaccattgtattcacaagtaaactgagacccagagactaaatgtccctgttgtcagaggtacagcagtagttaggggcatatttgggactaaaattcatattagttttctctagatacagaaatatttcagtcaggccaatttttatacaaaactaacttcaggactgatggtttagccagttgttggtcagttatatgtgtaggtttgtgtgttattgttataaaaagcagtatcctttcaaattatatgagggatacatgtttatcatgggaaactataaaatgtgagaaaaaggggaatagaatcaaagtatctatcattgcacaactctgagataaccctcttattatgttgctatatgtccctttagacctgctattcatatgttgggttttttattattttctaagactgggattatggtgtatgcacagtttttcattcttcactgttattatattatgagcatctttcatgttaataaataggcattcacactagctcttaaatagctatgtcgaattccttgatgtaatatatcataatgtgttcaacagagtctttattggatgtttaggatgtctgtgtattttaaaaacaacaaacttgaataaatactatacaacttctaaagctcagaagtgagatatttaggtagcaaacagctctgatgaacttaaagagttaacaatcagctaaccagaaaatgagctccccctcctttcaaccaggttaaaacctggttctttcaaccaggctggataattgagatggtacacattaatgatccctgttctcatcattgttcagtgccaggcatggccaacactttgaaatattagtaatcaggctcactgagtttcttttcaggtttgaaacagagctctgcacaatacattattacttgtggatccttgagacttctctgccacctccaagagcagaagcagggtcttccgaggttaacagtcaccactgggttttaatcaggaaaaagaaagaaagccataaatttaaactctgaaaaactcagtacccacccagaaacagcaacaaaatcagattggagtctggaagaaaggtcctctagacttgagaaagttcagggtgaaattgggtttattgtgggtctgagatcagaaagtaaaattctaaagagctcaaggcaacaacatccaaaaagtgggcaaaaatggccaaagaatggactgtggtattttctgggaaagaaaacgatttcccctcccttttcaaaaattttccaggaaactaattgtcaggcaacccacttgtagaatggaagcatctctcaaagtgatctagaaattccaagaagattttttttctactgttatgatgcccaggggagatagaagggtggcttgcaaagtggactcaggtctgcattccaaaactgccttcattccctttatgtgggactaagaaaattatattatccatctaggcatttgtcctccatccattaaataagaagtagagaggcgttacagtactcatcaagaattccagttctatcgcttactatcggtatgaaattggatcatctctttaatctctttgagtctcaatttccagtctttaaaatagagacaaaaatatgttccttagaagattgcattgaatattaaaatacaatgagctatagagaaagcttaggctaggatctgtgacatggttggtgtttaataattacaggattcagcaggtgttttatttttttttcctttccagctccaaattattctatgtcaggtgttaggggtatatagatatgctaagatatgttcatttcccaccagggagtcgagtccactgtggggtaaagacgtgtacacacagctgtcctagaagatcaagaagtagagagctgtgtcatgaaggctctccaggggtgaatgggagaggctaacagtagaggcaggcattggggtgggctttaaaagatgaaaaaaaaaattaaggcagggtaggagcagaagcactcagataaggaaaaaatggcacaactggttggatgaattgttactattattgcttgaatggcacaactggttggatgaattgttactattattgtacctattctaataggtacaattgttaaggtaaaggaaaaaaccatatttgcaactagaaccaaatcaactactgctagaaaatttaaaatcttccttcaatatcaaggtagaaaaagcttagcatcttcattttgctactaacattctgaccttggacaaataactttacctgttcctcagctaaaatgaggatgtaaatcctaacctgtctatcttaataggatgttgtaagaattaactgaaataatgtacagtctgcctcacaatcatctggacggcttgagaaagcacagattgccagatcccacccccagaggttctaattcagtaggtctggggttggacccaagaatttatattcttttttattatgatgatgattattatactttaagttttagggtacatgtgcacaatgtgcaggttagttacatatgtatacaatgaatttatattcttaacaagctctcaagtgatgctgatatagctggtctggggattacagtaagaaaaccactgctttaggtcaatgcagttttttttaaaagctattattcataactggctcaagagtcatgtaagtgttgattatgttttattatgtgtctagacccttaatagactactcaggatatgcacaaatagaagatgtaatattttctgtagcattccctacaccaaatcggccttgctcggtcatgcatagttaatgtatgtgttgattttatttgtcttcgtgtggcttctagtctcactagaaagacatacatttatttgaatgttgtagaatgatattattcattggaataaaatcggatctttttacagttttttttgtttgtttgtttcttaatgagcaggcctatgattcctaaaggactttttattttatttcatttgaacctttgatagaaactgcatctttcatgtgaccactctccatttttctgctcatatgaccacatttcccagtagtctttaaaggctccagtttggatgggatttcgattaatggaagagaacagatagctctgtaaatagagccagatgtctcttgcaatatctgaaatgaactgtctcaaccatcagaactgtaaatcaccttcagaaggctccttctcccaggagtagtctttgcattattcatagcccttttgctgtagtacattcttgtctcatgaagattacagccaatcactatgctttcatagcccatcctcctccctgaacccctgctttcatgctgtgtcatagccttggcactctgttctttgaacttctttgaggagtagtgttttccaggacctagcttcagttatgccaagagtgtttcctttctgtgatcatgatacattgtaaagtatgtggttcctttttcaaagggaaaatactatagtcaccctaattccttcaagaaagaaggcagagaaagccccccctcatcctctccgaagcagtcacatgctctattcagaatgaatcatcactttggaattgtctgccagtgttttgtggggtgaggctcagactctttctatgggtagatctgtaggcctgttttctctgcaccagaggtcccaaactggtgttctatggattgcatccagtgattttatgtgtagcataactttttaagaggaagagagaagaaaattgactttgcgatcaacattacaaaaaaacatcatgagactttgaatagaaatttggattttcagcaaaaaaaaagaaaaaaaaaaagaagaaggtttggcagtactggactcccatctttaagggtaacagccgaatgctggccacgtcctgtaagaacccacactctccagtttgctgctgtccataccagcttgtgtgactcctttacattacctgcttgactcctaaaggtatttcaattagtggcctgtttttgctctttttggcaagttcacagacttacagagtttgaaagctaaaggagtccctgagaacaaggattttctaatgttacttcacatcaaaatcacctataccctataaccaggctgcatccagtaccaattaaataagaatctctggggaggaccaagctgtcaggatttttttttttaattccccagatgattccagtatacagatcagttcatctaagaaccagtaccttggaagaatactactcagaatttattgtgcatacaaatcacctggagatttgttaaaatgcagattctgtgggggcagggtctaaggtttagcatttcttacaagccaatgcttctggtcccccaatcatattttgcatagcaaagcctaagagatcttctggtctgtcctttttcataagttcaaagagatgtcaaaatgaagctttccttgttaagtatctaagcttaggatgaattatttatttatttctccagcttttcttttccaaacaacctttttctgtagaaacagggtcttgctatgttgccctggctggtttcaaactcttggcctcaagcaatactcccaccttagcctcccaaagtgccaggattacaggcatgagtcactgcatctagccagagtttgcttttaaaagcataaatgacagtggtgtcaaggatattcctgtggaaagtagtttttcctcttatttacttacattccaacattccttcttaactaaaagagaaagaagtgggtcttcagccaaaagaacattatttcaccctggtgatgctcatgggattcccattttatgatggtagatgtgttactggtggtgaatccatacaggtctgcagcaacctcaattcttgcctcctcaaaagaaagaattcgaatgagaggcataagacagagtgaaagactgaggcaggtttcagagcaggagtgaatgtttattaaaaagctttagaacaggaatgaaagaaagtaaagtacacttggaagagggttaacggggagacttgagagaccaagtgcatggtttgacctctgacttggggttttatgtgctggtgtgcttcgggggtcttacattacttctccactgattcttccattgggatggactgtccatatgcacagtggcctgttagtgcttgtgaggagccgcatgcacagtgtgtttactgaagttgtatccatgctcacgtgaggcattcttcccttaccagtattcgtagaaccatatgccagttaaactccaccattttgcctcttagtgtgcatgcttgagctcattcacccagtttctgagatattgggaaaatgcgatcaccagtttcaggtttttctatccattgggaaactgcctttccctggcactggctgcaaccaattattattttagagagacagtttaataatcgcctatcatctgatggttgcctgacatttcttgtggtggcagcaggggggaccctctcctgtcctgctcgtgtctgactagctacctactgtaataaatggggtgcagattagaaaacaggtccttaccctcccccttccccacccagttattgctcaagatcacataattatgaaatagaagagctgatacatagagaaaaatagttccagttgtctttataagtggttcaaaactctgtgagcttctttgatgggttgagttgtaagttatgtggcagcctctcctttcaggtgagaatgaagcagtcagccaggtctaattgcctagttatatgagtgtactgagtaggtaactctctcaatagtttaatttgaggtctgcaattggagagttgatgctgaaacatttctcaggaccagaaatttcctttcaggctagccacttctctgagctgaaaatgctgtcatggtgaattcattcttctagatccatgttttttaagtatattatcaaaggactatgtgtatcggaatcccttgagactctagttaatgactgtccacgtcccactcccagagattccgagtcagtaaatctggggtggggctcaggaagtggttttttgttgttgttgctgctttgttttgtttttgagatggagttttactctgttgcccaggctggaatgcagtggcgtgatcttggctcactgcaacctctgcctcccaggttcaagcgattctcctgcctcagcctcccaagtagctgggattacaggtgcccaccagcatgccaggctaatttttatatttttagtagagacggggttcccccatgttggccaggctggtcacaaactgctgacctcacatgatctgcccacctcagcctcccaaagtgctggaattacaggcatgagccactgcacctggccaggaagtggcatttttcagaaaactcatccaagtgattttgatgcaggtagtaggccagatgcagagaaatatgatataaaggtaaatgtcctttcttccctgtctactagtatagtgaccattttctcctgaatcaaatactgcagccttgaaactagttaaaaccagggttgtgccatacttctactcagctcagaaggaggctctccatttgagaacacatgggttccttttgctaccaggacatgcagcttggaacctctgattctcagtgatgtaggcattttcttagcatacagcagcctggaatttatcataatgtacatgtcacaggaggatatgaaatagagtaaacaccttttttatagactttagattttgaggtctcactacagcagcgttttgcaactttttaaaaaagaaccaataatgatctctttggatgttcataaaagcctcacactctgctgtcccatactagattctgatatacctaactttgaaggatgtccaccattgagtgtcactacatacagggagcaaattccatttcatttttcgcgcattcctaccaacgaagagaaatttgaggcacattattttaggaaatttgtaccataaaaacaataggtatacatcaatgttttatcatttataatgtttcaaccttaatatgtttttgacactgctcctgctgcactggaggaatgttgtaatagattgttacataaccacttctcctggcaggtattttcccccttccttattccactaagactcacttgcaacgcaaagaccagggcctcatggaagaaggcagctgggcacaagcctgttgccatggaaagcttagggcgggaagcgattgattggtctctgcatacagagactgatctagaaggcttcagtgtgtctgaatggacctgtctgggctggaatttcagtcagtctgacagactgctaaaggagactcaggtgtacacttcagcaacttgataactcttccccagctgaaagtcgaatcatttgatccaacgggaaagaagctaaaattgtcctgacagctaaagagcgatctgacctttgtgatcaggaggagaatttcttgtgatacagaaagtgaaagtagaaactggaatgatggtattgatgatgaaggcatttagagcagcaggcactgccattcattaaaagattgcactgtgtcaggcacatgctttatcctattgaaccatcatgccaaacttgggacacttaggtatcattgtttttcattttccattaagaacttgaggattaaagctgttaatctatctgttcatggtgaaatgagtagtatgtggcctgggtttgaacctttgttatagctgcaattttttcagagcttttaattgttgaactacacggtgtttctggggctattcttgatctttgcacagtgtgggggcgaaagttggtccttttaggaattcaactattctctcatttagttatggccaagaaaggagaggctcagagatcagttggtgcctcaaaaggtcgctcttccctgcagccgacttaatatgtctcctagctcccagtccagtgctccagcaagatccggaagctaaatattccctgaagcctttataatctattgagaatacacaacagagttgctgggagtttttccaaggcagtaagtctcatttttcttattagtttggatcccctgaacccttaaggtagtatctcaaatgcagttaagtgttcaaccaatatttgttgcaagaataaacattactagtaagaaatgtgatcttggagacaatattttatgttcctagtctctagttttcctatttttgaaataagcaggtgtgttctagatatttcgaaaggcccttccactttaaaacttatttaactctagagcaaggatctctcacctgaagtctgaagattggtctatgtactctctgtaaccctacatgaaatgctttaaaacttcatttacagttatgtgtccattaacaattggaatacattcagagaaatgtgtcagtggacaatttcaccattgcttgaatatcacagagtgttacttacacaaatctaaatggtgtagcctactacacacctaggctatattgtatgatacagattatagctcctagactacaaacctgtgcagcatgttactgtactgaatactgaggcaagtgtaacacaatggtaagtatttgtgtatctaaatatatctaaacatagtaaaggtacagttaaaatataatataaaagatgaaaactagtacacctgtataaggcacttaccatgaatggagcttgcagaactggacgttgctctggtgagtcagtgagtgaatgatgaatgaatgtgaaggcctaggacattactatgcactactatagagtttataaacactccacggttaggctacactaaatttatttagaagtctatttttatttcattttgtttttgaaatggagtctcactcttgtcacccaggctagagtgcaatggcaagatcttggctcactgcaacctccacctcccaggttcaagcgattctcctgcctcagcttcccaagtagctgggattacaggcacctgcccccatgtctggctaatttctttaacaataaagtgaacttggcttactgtaattttttactgtacaaacttttaaatgttttaactttttgactcttttgtagtaacagcttaaaacacaaacacattgtacaactatacaacttttttttccttatatccctatgctataagcttttctttttctatttctaactttttgttactttttaaactttttggttagaaaatgtttaaagggtaaagacacaaactagagaatttatatctttaaactttaaatgtttaagaagtaaagatattaagacacaaacacatgcattagcctaggcctacactgggtcaggatcaccaacatcactgtctttcttccacctccacagcttgtccggctgaaaggtcttcagtggcaatagcacgcatggagctgtcatcacctataatactgccttcttctggaatacctcctgaaggacttgcctgaggctattttacagctacctttttttataagtagaaagagtgcactgtaaaataacaacatatatagtaaatgtataaaccagttacataactgcttattatcaagtattatgtactgtacatgactgtatgtgttatacttttatatacaaccacagcacagtaggtttgtttaagccagcatcaccacaaacacattagtaatgcattgtgctacattactatggccaagatatcactaaacaataggaatttttcagccccattataatcttatgggaccaccgtcatataagcaggtcattgttaaccaaaacatcattatgtggtgcgttactatattttggtataatttacatatagtaaaattcactccttttatacagttctatgaattttgacaaacctatatagtcatttaaccaccattataatcaatatataaaatattttaattatcccaaaaaggttttttaagcacatttataggcaattttctcccctgcaaccccagcctctggaaccactgatttgttttctgtttctataatttttttcttttccagaatgtcatctacatggaattctgcaggatgtagcctttgcattctggcttctttcacttagattcattttgagatccgttcacattgttgtgtgtattagtagcttgttcctttttattgctgagcaaatttttcattgtatgtctgtaccataatttgtttattcattccccagctgatgaacatttagtctgtattcaatttggggcatttataatgaagctgttataaatattcatacatagttttttatgtgaacatattgcttaatttctcttgtgtaaatattatggggagtgggcttatggagaattgagaaatatacattaatgtatctataattttttttctgggaagatagtacacagcttttgtcggattcccaaaacggtccagggctcacaaaaggttaggccccactgaccttgctgcttcctctggtttgtgttgggttctttaagctctgtggtctggctttcaagtggagcatcaaactgagaggcagcctggcttaggaaaacaggcattgggttaggattgaagtgcttcccaccttagtctagtctttcactgtgtgacattgccagccttctttccctttccgggaccttggaaaccctgtccattggtaaccagtttgatggctaagctccatttttccatcatgtttcctagacaacgccatgcaagcttctgctccagcccctttggagctctgattcagacactaatctcaggccctccaaggaagcatcattcagaccttccctgcttcctgcagaggcacatgtagtacagtacgtgaggctttctatggagctgctctcatttttgttcattaacttctctccctgggaggaggcatgccagggagggtgtttatcaagatgaggcacatgacaataggagcaccagatttccagtccctgttttgttatcagaagttcgctttccagacttgggcaaatcactttaatgtctcttgcttaaaaccttgactagcttttcaatgtttttggggacaaggactcaaggccttagagatcttgtgatctctctacatgtgtaataaatatataaaccataatatagctgcttattatcaagtatcatgcactgtacatgactgtatgtgctatacttttatatgcaactggcagcacagtaggtttctttaaaccagcatcaacacaaacacattagtaatgcattgtgttacaacattaccatggcagagatattactagacaataggaatttttcagctctattataatcttatgggaccaccatcatataagcaggtcattgttaaccaaaacatcattacatggtacatgactatattttggtataattttatacaaaaaaaaattgcctgacttttgcctacctacccagctcctacttccttgagttcactcctttgtgcactccaaccccactcacctatctgttatccttctgacacaccctattgcctccttccatttggctttatcctacaaagtttgctgtttacaaagtttactctgaaatagaggtcatcattttgaagactagaaaaccaaggcacagagacttacatgccttgcccaagtttgcatagtttgtaaatggaaaagctggggaaaatccacggaaacttggctctggattccatgctattgaccaactcctgacttcctgccctgctagaccttagtgggtggtcatgaaataaaggatgtaggaacagtgtgccaagagttctgttggattattttagctgaaatctcataatggctttttatagaatattaatgacttacagagctctttgctctgggttatggacttaggtttctaaattgtcatctccttctagataacttttcaggaacttatcagcacccacacaggactggatgtgcttttggaaggtaccatggaggctgatatggtgtggctatatcaaatctcatcttgaattgtagctcccataacccccacgtgtcaagggagggaccaggtgggaggtaattaaatcatgggtgtgtgtttttccgtgctgtcctcgtgacagtgaataagtctcatgagatctgatggttttataaagggcagttcccctgcacatgctttcttgcctgccaccatgtaagaagtgcctttgctcttctaccatgattgtgaggcctccctagctgtgtgcaactgtgagtctacttaacctctttttctttataaactactcagtcttgggtgtgcttttattagcagcatgacaacagactagtctaatacagaggctttgggcataagctatgggcctttggttttgaggttctccaatattcagctgggaaattatgtaccactaagatgagttttggagaagcctccttgagagtaattaaaccagagcagcaaaacaatagactcctacctgtatggaaaggacagagtcacaagtcaaagcttcaggctgaacctttcttagcaaagtgagaagggtagatctgagacaaaggagcagggattttttttaggttgattcctgtatttatgtaacttctttctcctcaacagtacaggtttcttcatgatacatgtcttcaagacagcattggagtaaaggattctcagtggccttgttttattcaatggcatttagtaaacgtggggaagggatcaagagtccacatcagatcctggccctggagcagcttttctagtcgggggtcatgatagctacagtctctctagtatcttctctgtgccatttaaataaataaatcagagaattggactcagaatctgattctctgattccgctgagtcagttcttggccagggtcatgaaactggtaacttgtacagcctggacccgtactcaaggatgtgagacttggagtgggggttgagaggaggacagttcatgacaagcctgacccaacatagtgctgtgcccaattagctagctacacagataagcaaactgaggctaccactgggtcagttcttggcaagggtcaggaagctgtaacttgtagagcctggacaagtgtctgtgatgtcaaaccccgtccatgtaactgctagttactatatgggaactcaagtttattacttaactgtattaagcttccattttctctaagaaatgggggaaaaaaagcttttaccttggcttaaagcagttgcaagaattaaaaagttaattcatgttgtttatttatcagaatgcctagcacattataagtctcagtataggagaattgtattattcttaccatcatcaccatcaccaccattatttgccaagagagaggtatatgcaaagtgctatagtggttcaaaggagggggcaatcgcttccaccaggaagacagtggagggtagtgtgaggataaatgtaaaacctgaaaatttaaacttgaacttgaaaggagactgtgtatgtgggaattttggatcaaaaggggattccaatagaagaaacagctgagttaaagcaaagcgatagaacactgataacgactatgaatggtgaatagagcattttggctgattgctgtgtacctaaatggagatgagggtggaaagatgcattggggggtaagactttgagaaccaagttcatttgagaaccaagttcatttgagaacaactacgaatggtgaatagagcattttggctgattgctgtgtacctaaatggaggtgagggtggaaagatgcattgggggataactatgagaaccaagttaagggaagtgtcatgagcagagctatgctccaaaaagatttagcaggccatctatacccattatgtctggggtgcatatgagggagttacaggatgtgagacttggagtgggggtggagggagggcagttcatgacaagcctgacccaacacactgttgtgtccaattagcacgacctattttggctttgaatggggaaggagaatctgtgacctctgagtcagcctttatggaatgctcaagacttaacaggtcttgcaagatgcattctctatcagtcatagtactttaataatggttccttactcagcttcattcattcattggaaattcatgcatgtctttgtagtccataggattctcagaataaccttgtgactagacgagagaaatattgactgtgcgattactgaaggcaaagactgtttgtgatgcttgattacttgatttttgcatatccaacaagtgaatgagtgagtaagtgagtgagtgagtgaatgattgaatctccacttgactcctgaggcaactgagatgaggagatattaaaatatctcaaggtgtcattattggacacacatatgactaggacttttgttactttcatacttctccatttacaatttcttaaaagagtactttccaaagtatatacaatttaatgatttgaaatcctgcttgcggccaggcacggtggctcatgcctgtaatcccagcactttgggaggctgaggcgtgtggatcacgagatcaagagattgagaccatcccggccaacatggtgaaaccccgtctctactaaaaatagaaaaattagctgggcatggtggcaggcgcctgtaatcccagctacttgggaggctgaggcagaagaatcacttgaacctgggaggcagaggttgtagtgagccaagactgtgccactgcaccccagattggcgacagagcgagactctgtctcaaaaaaaaaaaaaaaaaccttcttgcttttgttgctgttttcttcctaaaagtggagctttgccttttcccttttaagtcagtcactgagacagtatttggttttgtgccctctgagagttattttccagcccacgagccccacgttctgattctgatgtgagataatggagcttagccctcagagatatggaagacaccaattgtttcgttctctaagtgttcagaaacaactgttcttttcttttcttccttttttacttccccttacaagactttcttttctttgcctcaaagagggtaaaggatggaagatagaaggaggaactcaggttagtctatggctcagaggccttgaatagtttgggaaaaaaattaaacaacatgaaactataacttctcattgttctctgctgcttccacctcccactgacagtgtatgctttccatcaaatatgtgtaatattggttgtggagcagatcaaaaacatctattttctctggaatgtacagtcagtcaatcttgaagaaggagcatcgtatcaaagaggtctgttgtcaaatacctacttccccctttctgtcctttctcttccccttcaagggaaacaaatgtctgggttgcagaaaggccctttcatctcaaattgttctcttttcattagtgtcttggtttgggcagggggtatggaggcagtctactatgagtagtattgttgaggacatgaaatgttaaataataagattttacatttgtaaagtgccatgttccttgcttttacagacagaaacttaggctgctgggttttgaacaattaagttgaggagctatttgggatatgttgtataaatcataaccgcttgttgaagggtgtgctgaaatcaaggtgtgacctctgcacaattcagggacctcctcttgggcaagtctagagtcccagccttgccaatgcttcagaaatgattagattcaaggtgccaacatcaggccaactgaacccttgagagattgccctataaactgttattggagcagcatctgtttgccagggtaaatattcagtcatatggactgggccctggagtcttcagatggtgcagcccttcccagagggaagacttcatgggggtccaaatgctggtaagaagtttttgtttgtctgtgtctgccatcacagcatagagattaagaacctggtatttggaatcagacagatttttgtgtattatttacctgttgctgcataacaaattgcccccaaactcggtgactttctacaacaatctttgtttattatctcttatggatccctgggccaagaattcacatggagcacaatggagaaggatggaagacctgaaaactaaactgaaatcatctaaagacttatttactcatgtgagctgtgttggagctgtcagctgcaacacttacacaaggcctctgcattgggcctgaacttcctcacaacatggtgactgggtcttaaggattggcctagataaagtcatggcagagaccactcatggaaagctatgtcaacaatggaagatgaatggccaggatgaagacagagagagagagagtaaagaattccaaaggttgccatgtttgtctaaccctgcttcacagaaccaacagacaaaatctgtagcctcctctccttgtcagatctgtgtattttgtatgggaatgaatatgtcagaaagtagtagcttagtgataaattatgcaacagcctcttcttcattctaggttcaccagtactgccaaattaacattacctgagcacctcctttgcccaagaatttttacaagtgtaatttcatttaattctcacaacaacccaaagttataattttaattttcccccctttggattagaacttagaggatatggaaacctctcagtcacccatatatgtaaactactgctaaaaaggtttattttaaagaagtggagctgttatttactctcatacattcacctattttagtttcagggagtacttctatggcggacttatgtaatacctgtgatcgtataagaaagtcttttggttcaggtattcttatcacattatctaacatatctgtgagacttacctttgatctcccatgtcgttatacttccaaagccaccttcaactaaaatctacactaaacaaagaaaagtgcttcaataaatctgtgtttctaagcaattgtcacctttcccaaaaaagtaaaatagcaatttctatagctgttttttcttttaatggctttattgagatgtgtcacataccatatcattcacccatttaaagtgttcagttcagtattttttagtatattcacagatatatacattcatcgccataatctaattttaaaacatttctctcttgcaaaagtagcccagtacccattagctgtcattccccagcaccctcccaccatcaggttctaagcaaccatgaatctaccttctatttctgtagatttgcctattctgaccattttctatatatgaaatcatactatttgtggtcctttgtgactggcctctttcacttagcataatgttttcaaggttcattcatgtcttagcatgtatcagtgcttcatccctttatggtatatccataaaatgaaatattataggactatagtatttcattttatggatataccatattttgtttatccatttattagttgatagacatttgagttgtttttactttttgactactatgactaatgctgctatggaaattcttttacaagttgtcatgtggccatatgttttcatttttcttgagtgtgtacctagtggtgaaattgctgtgttatgtagtaactctatgtttagccttttgaggaactgccaaactgttttccaaagtgattgcaccagtttacattctcaccagcaatatatgagggtttcaatttctccacatccttaccaacacttgttattgtctgtctttttcattatagtcattctgtgggtatgaagtggtatctcattgtggttttgatttacattttgtaacgactgatgggtgttgaacatcttttttatttcctattggttattttgtatatcttctttggagaaatagctctccaattccctgccttttttttttttttttttttttttttttttttttttttccagagacagagtctcactcttgtcacccaggctgcagtggagtggtgcgatcttggctcactgcaacctccgcctcctgggttcaagcgattcccttgccttagactcccaagtagctgggattacaggcatccaccatgccaagctaatttttttgcatttttagtagagatggggtttcaccatgttggccaggttggtctcgaactcctgacctcaggtgatctgcctgcctcgacctcccaaagtgctgggattacagatgtgaaccaccatgcccagcctcttgtccattttttaatttggttgtttgtcttatattattgaattgtaagaatgttttaacgtattctagttataagctgcttatcagatatacatttgcaaatattgtcttttttttttttttttttgagacggagttttgctcttgtcgcccaggttggagtgcaatggcacaatctcggctcactgcaacctccgcctcctgggttcaagcgattctcctgcctcagcctcctgagtagctgggattacaggtgtgcaccaccacgcccagctaatttttgtatttttgatagagacggggcttcaccatattggccaggctggtctcaaactcctgacctcgggtgatccacccgcctcggcctcccaaagtgctgggattacaggcatgagccaccgtgcctggccacaaatattgtcttttattctatgggttacctattagccttctttatggtatcatttgcagcacagttttagatcttttttgttgttgttgtttagcttgtttatttgtttcattttatgtgcagtactcacttctgctttcattcatttatgccttgagtgtccattatgtgtcaggaacttttctagacactggtgatatgtcagtgaataggatagaacaatgtccttgctctcctgaaactaatattccactcaagaaaggcagatgataaacaaataaatcaaagatttcagacaatgataaatatgtttaagaaaatgaagtgagataatgaagtggaaaatttttatgaggcgtgtgtccagggtggggaggcagctttaggtagattcacactgttggcatttggggccagataattctttgttgtgttgtagctgtcctgtgcaaatatcctacaatgcaaggacagctgcctgtgtaaggatatctgtagcaggatctctgacctctacccactaggtaccattagtacctccctcacttgctataatcgtacaaaatatctacagacactgccaaatgttcctcagagagaaaaatcactctcaattgagaaccactcagattaatagttgagaaaggcatctccgagtgatgacctgaagacagagtccaccttatgggaagcagtggagcaaaagcattcaagatagatggtaaataagtgcagaagcaaggtggggatgcacttgatgtgtttgagaatagaaacaaggctttagagtgacagtgtggtgaataagggaaagaatagtaggagataaaaatagagaggtaggctggggtcagattatgaaggatctagtagacagtaataagaaatttggaattattccgagtacagtataattggaagccagtaagtcagggataaatgggtgctctcaaatataggaaataagctgtagatttggggttttgtcccactttattttattttgagtttttgtgggtttttgttgttgtttttgctcaaggatccacaatcagagagtgatagagctaggactaaaacccaagtctccaggctagtaagctataggtctttctattaaacacgggtgacgaagcagtctacatttattaactgtaggattgcaattggccgttactctaactgacctttccctgaatccaccttgtttaagaattcctaatatagtacttagcatttggcatgaaaatcaaagaagatgaactttagcaagaagctaatccaaatctgcttcacagaccagcagcatcagcatcacctggaaacttgttagaaatgcagaatctcaggcccacctcaaacctactgaattaaaatctgtgccttgatagtccctagttaattagtatgcatgttaaagcttgagaagcactgatctagtttatcaaaatatcatcagaaacagtcgagtgattcaaatggttttttttaatgggcttttactgagtcagaagactaatgatggtgtcatcattaagctctcattataacatcttttttattcctttctttctttggctcacagcaattcttcactcacaaagtcctatgtagtcttccttaataacagcatacattctttcctttcatttctgcagccaccacctttgtctttaccctcactaatttgtacctagcttattatagccatatcaaaatttatgccttcctcccttcatgcccttcattgcctagagctctccgaatctcaaacttcatatggctttttcttgtcttcagagtaaaattcacatttccaactctgactttgaaggccttctatatcaaaactccaaacacgtttcccagagaatctgttgtgtgtatgtctttaagtccatgtctttgttcacaccctggaatgccctttcccatcctttctactgccttcaaggctctgctgaaatcccacttccatcagtgatgtcaaatctacccagttgcctacccaggttctacggcacttgttgcctgtaccaattattttttggtgggggggtctgatagcattataatttcaggcacaagcacaggtcttcataactaaattgtagttcatggagaacagaggccacatctttgtctgctcccactctaatgcttagtaaggcactaagcatgtagtaggtaatcagtaaatattttgcctttgaatctgaagttgtggagtaatgcccagatttacaagcacttcgtttctactaatttattttctctaagggtctatgctacagttcagcaattgtgtaaacagcattgtttataaagccagccatgggtaagcagtctcagatcagctgggtggtaggcaatggatgcagtccagaatttcaggccaaataaaattgtgaatctttatttcaagaaccactgtattctgtgggaccaagctctgttccgggtgtcagaacaataggtatccctccctgctgctgagcagctgtatggggcaaaaagccccgattgagcctggcccgcctgaacctgggatagcccagatataaaatgataataacattgacctgaattctgtattttgttacatttttgtgtttgcttagtacttctttcttaaggttgttggcaagagcatctgctggtaacttggctcagtgtgttgtaggtttttgtatatggtttgggtttcctattcctgggcattgaactattaagattcctgcagataggcataactacttacagccttttctgtgtatatattagctcttacggacctcataaacctaaagaggtgcagaggaaaagtgccatcattctcattttacaactggggaagcagaggcccagaaaagtgatctaactttcccaagttcacaaatgtgttatcagagctgcaaccagagctaaggttgaggctttatgaaccttaggttactattcggttaataggctcagtgcagccttaccttactaattattaaaaatagacaacattaggatttaaaccagatggtcttttcctgttgttcacactcttacccactgtcagcaatggcccatcagataatccacactgattcatgaaaaggcaaatattttctgtttctgttctaagctaggcttgccaaaaccgagagcaatattctctatccccgagatgcattgcttcaagcacctatctactttctctgcaaagttatccctttggcaatggttcttcaattctgattatatctgggagagaaataataaacctatttagatgctaattggctttaacatctcagtgagtcaacaggctcatgtatgtcctacaagaagtctctcaaacctggatcatacagctatcaaacagtgttgctcagccaccaacttcaaaatggctcaatccatttgagtttacaaagcattccattttatagcaaaggacatctgtgctaaggatagtgtcttaaaggctaggcttttgaggtggcaattattttcttgctgaggtttcagaatagacaattttttttcctacattaaaacagagaaatgaagagtctgagtattctaggaagttcatggcataatggtaagcagataaatttctgatatccttctgaaaattaacttagtagctttgtgacctctggcgccttatcttctccaagcctcggttttctcatctgtaaaatggaagtcataatggtacttacaaggccaaaatgatgactaaatgagaggataaatttaaaatatttagctcaatgcctggcacatagtaagtgcttcataacaattgagtactagtattactattatttattaataattcctatagtcaaatagaataaggagtcccccttgttcactatagatattcagaatgtccttctctcaggcctgaatgagtaattccttctggattactaatatcaaaagtccatttgtatctgattgagatgaggaaagaaatgcaggatggagcagggaaccagtcctcacactacatggtttactccagcgattctcaacgttagcactacctatgttttgcacagggttagtctttgttttggggggctgtcctgcacaatggaggatgttcatcagtatccttggcctctatccattataagatgccagcagcaaaccaacctcctccaagttctgatgaccaaaactatatccagatatttgccgactgggggcacttgcccccagttgagagtcactaattacacagtacatttgtccatgatggggacatgtaggctcacggggtagccagtgacaggcaggcagacaggagtggggaattttttttctgtaaaggccccaagtagcaaatattttaggcactgtctgtcccaactactaaactctgccatgtagcttgaaagcagccaaagacaacacataaatgaacatgttccagcaaaactatttatgggccctgaaatttgaatttcatataattttcatgtgtcactaagtaatctttttaaaatttttattcaaccacctaaaaatgttaaaactatacatgagtcgtacaaaatcaggtggtgggctagacttggcccatgagccatagttttctgacctttggactaagaaatacatgaagccgtaacttcatatttatccctaagataaacatgggataaatatgatacttctcctaacaccatcaaatttacatataaattttagagaaagcatattattttattaaaatgagcattgctatattttggaataggacccaagccaaaatgaattttagagataaaacattatattccaaagttatatcttgcttcccatgggctgttgacccatgcctcaggtccccagaggccttcatttcctgccttcattttcccttgcttttaggctaccttggtaggaaaacttaagaagttgccatgccattttaagtgagaaactaagtcatataagagccttttagacttcccataactggttacccttagatagtgtccaataaggcacctcaaaatattctaagtgctctagtggttgtctaatatatttcatcagagaatggttgtgtaatatacgattgtttaatccaaggtggctcctataaatcctttttgaaatgttcaagtatctctgtcacacacttggggtatgaggtttattcacttccattgtcaactaagcagcatgtgtaccccacagcttgatgagtacccagaaaatcagcaaatggtgtgggccctactctcaggaagctggaatctgatggtgatattaggacctgctcatatgagatgacccgcaaagagtacaccatcaagaaaggtgttgtggcagaaggagaagtggagtggcaagcgggaggcacattttctagcacctcctgtgcattcatcctgaaggagagagttactttacctttagataagtttttctcttctgcccagagtgcttttttgagacagattctgagacatcatccaagttcagctgggaagaatgccacaattgattagagctgtcagccgtggatgggagatcagggattggctggcaaaagtgccagggtgttgacaggcatagtctcagtcatctccacagttcttcctggctggaaatgcctctggctatattacccttattgcatgatttcatggtactgatcagatccaaagaaggaggatgattgtgagatgcaaagctcaggggacgactacgcggtgaaggtgagagaatgcccagagctttgaagaggctgcttcttcttcaaagctgtgttccagcagagcacattttgtgcatacttgaattttcgttggctctaggctgagcgcattctattgtggcgttggcatgggaagagggaggcatgcgagaaatattgcatctctgctattctcctgggcccttgtgaatgggaatgtcttcttaatgagcctatcccagagagtctggcctttcagataaacaaataagcatcagcaggagatgctcacaaaaggactgggcaaaatagggccacgttgagtgacaacccaaataaaggagtcctaagaggtctgaagctggtggctaatgagcacatctcctcatttgtgatttcttggccaggacatgtattgttgagggtgccaggaaagtctgtcttattttatacaggaagaagcctttctggcctttgtcctggtactggcttttatattttatgttgggctaggggcctgcctggaggacatttacaaggtgaggagaaatctcaagctgattttaacctaacacaattttcttatctttctagtgatatatatcagttttctcacttgggaaatgggaataaaaatacaactcacctactagaattgttgggatgattaagtcggatgattctcagaaagcacttcccacagtttccaatatgtagtcagcatctgatacatgttggctgcaatcattattagtaacagtattatcatcatcattttcatatgtggaaagataccaaaaggagtgtccaggggtgagggatctagttccaattctgctaccagctggctgtgagattttaggcaagtcatctctcatgtcaactgagagtgctggacgggagtttttattcattttgtaaacatatttggaggacctactaagtgccaggctctatttccagggagcaaatatataaaggtgaataagacacattttctgtactcaagagatcccaaaggtaatggaggagacaggtaacacatgtgaccacatagcatgagaattgctcttactgtgtggctgcatgccaaatgctcgtgaggcctggcacggaattagcaagactaaaggctctgtcccagtccaaccttctgtgagtctataactgaagcatccaaagtataagctgggtgattaggggaagaagaagtcacctagctggcaaggggcctaaaactcaagtcccctccttctaggaccagagtactcaccaactaccaagctgccttaaaataaaaacattcaagaacaagtgatgtgcagagaggcaacacagtgataagtaactggggtctggaaatgggagacttcaacttcaatttcagcactgttattttggtagtttaatgatttagagtcagttgtttaatctcttagagactcagttacttcatcagcaagggtgttactatagtaatacctgctagacattattattatatggagagagagagcttggtaagctgtgacatatacattctagttggtggttgtttctgttgttattattaatagtaacaacaataaatatcctgttgtttatttttttgaagtgttcagtggctggtaactgaattagagtgcctggagatataggtaagggttttttgttttaataatcattatctttgttcaagagaataggaaaaatataagcctctttttaactttaatgcaaaaaagtctttatagcttgtgtgtgaaaaacaagaggaagggaggaaggggaggaaagagattgtctatttctacttaaagctaattagagaagtaattttaggtaagagtattatgacctgatttctgattaatttaagtattattatactgttgtaatagaaatccctgaagtgctttattgattatctgttggtagaatgaaagggtaagcagctgtagtaaataaaatttttgtctgaggcaaagcaaaggagaagtaatataggagaaattattataataaagatgggagtgagagaagaaacctgggttctagttctttcagataggtgaccttgaacaaatctcttccctatacttggcctcggtttccccatcggaacaacctagggcatactctagataatccctaaggtccctttcagccttgacaaactatgagatttctacctgtacaatactgaaacagtgattaagagggagagacacccacaaagaaagaaatagtttgtgctgtgctcaaatgcctgactgataaaaaagagaacagactcataaaacccactaattcaaattaaatggataattcttgttgattttgagctggcaatctcaggcttctaaatcacaaggaaactccatttgatcctgcaatggtctcttggtctctttcttagctcagtagtgctaagcacagaggtttcatggaaatcaagagagaaagagagagagagagagagagagagagagagctgtttaaaaaaagaagaacaatatacttggatgaactaaagagtggtcctcatgaaagcctcataatgtccattgcctacctgtttaaccctttgtggcctgatttttggtcctcaactgaaatcaaattaggtagtcttatgtagggaaatgaataacttgtacactgttgttgtttgccatctttaggaccaccaaagggtaacgaattcagcagacccacaatccggcacttcaggtttttgaaatttactcatgaaaatttaggaagtcctaaaggctgtgaaaaatcattgaacttcattggcaggcaggaccttgctttcaaaactctatgaggctacaaatcagagattgaaacctaaagagggaacagggctttcccagagtcacctgccttcccaggcagaactgggactcgaagtcacagctagactagaactccactgattccaaatccagtataaccaagtctcctgtggcctttcccatgatctggacccaaagactttctgatgttccccaaaagagttgtaggtgcactctgttctctggttctttgcagtgtaatggcagaactgaggttagaattctccttggatgtaaggatcaccagcccaccaggctggcagttagacaagggagtgatggatttgggatgctttgtgtgaccttgtatacaacaggttcttagacacaaccctaggacatggaaaagaattacattcatcctgagccccagctactgttaccaattcaaattaggacaacatattgattaagatacaggtagttatgctaccctaagaactggaatctgaatacctactttttatttctacttctaccgcttgttagtaacctattcttgatccaccatttaacttctgtgagcctcagtttctccatctttaagacagtgatgataatgacagtatctgtagaacagcttaacttgaactaaatgagaaaaactaaacaaaacacatagaattaagtatgaatttctgaggttagtttatacatgttttaagagcttagagaaaaggaaaaaacataagtatcctaaggagattaggaaatgtttccttggggaggttggaaagcagctaagccttgaagaataggatgtattttgaacactgggagaagagatgagaaggtagtgaagtggaggcaatagcctgcactatccagagacagtttctgattgtcctaatgctatgggctctctacttcagtttaagaaatattccaatctttgataccttcattcaacagtcctttctatttttctaatttcatttcctgaattgtttccctgcggaggagtgggcctacttgttgaaataaatcacatcacagatacctcttttcttctcttttgttaaaagttctgttaaaatatatatattgttaaaaaattaaaggttatctccagataattccccaaatgagtaggcttaggctttaatcatattatgttcccttccttcttgctcttcacttgccaagttatactaatgatcataatctcttctatgtgttttggactttacagtgtgtgaaggttttattgccactgttggccctctcagtgagctgatgcaataatttaggttataattgttggactctttatacgaatgagttgctagagctttagagatgttgcctgacacgtagcaggctctcaataaatattggatggatggatggatggatggatggatggatggatggatggatggatggatggatgggtgagtggatgaatggatggatggatggatggatggataagtgggtagatgaatgggtggatggatggatggatggatggatggatggatggatgagtggatgaatggatggatggatggatggataagtgggtagatgaatgggtggatggatggatggatggatggttggatggatggatggatggatggatggatggatggatggatggatgggagaaacaggggccttgagtggattgatagctgctctaagtatctgctgtattttatcattttctctccctctatggtaactccagcttcagcagagatcccaaggcacagaaagcaggcataccctgcaatcatttatctctgggatgccctggagcctgtcaaatggagatagggaccaagatggtatgttgtaattttgtgatatagaaaatctggtcaatttccatgaagcaaggccctcacccctatggctgcttgtataagatactgtccccttttgtaccctgtgtagataatgtgtttggagttcctcctttagttgagaaaaatagaatccttgctcacttccatcccaaagtctggatttgagagggatcaatgcttggtttgcagggagaatatgcagaacaaaggaaggaccagaaaactagaagtcagaagacctaagttcaagacccaagttcaaaacttataaacttaacttatttattcattgattatgtattgattccttactctgaggcaggctttgccagacagtgagaacacagtagtgagtaagggggacaagacacctgacttcatggaccttagttcaagtggggtaagagagaaaaattaaataaatcaactgaataagcaagataattgtaagataaagattccccaggcacagtggctcgcgcctgtaatcccagcacttcggaaggccaaggcaggcagatcacctaaggtcaggagttcgagactagcctggccaacatgacaaaacccagtctctactaaaaatacaacaaattagctgagcatcatggtgcgtgcctgtaattctagctactcgggaggctgaggacatgaaaatcgcttgaacctaggaggcagaggttgcagtgagccaagatcacaccattgcgccccagcctgagcagcagagagagactctgtcaaaaaaaaaaaaaaaaaaaaaaaaagaaagaaagaagaaagaaagaaaagaaaaggagaaagaaaacacgattctctgaagaaaaaagcaatacactgagagaaggaaacatgaaggtattcgtttaaatagtgggtcagtgaatgcccttactgagtaaaagtgacatttaagcctagatttcaatgctggatggtattcatgctacaaaacaatttggagaatattctagccaaaagggaataatttgtgcaatgatttgaaaaatggaaggacaaccagggtagctggaatgtttatggcaagggagagagtgatagaagattaaatcaggaaaacagagaaagtaacagatgaggcagtgcttgacaggccatgaaaagaagagtgacttttattttaagtgcatgagaagccactggaaggtcacaagtagaaagggatgtggtctcatctgttttaagaatttggtccagtcggctggccgcggtggctcatgcctgtaatcccagcactttgggagcccaaggcgggtggatcacgaggtcaggaattcgagaccagcctggccagcatggtgaaaccccgtctttactaaaaatacaaaaaattagctgggcatggtggcgtgcacctgtagtcctagctacttgggaggctgaggcaggagaattgcttgaacccgccaggtggagattgcagtgagccgagatagcaccattgcactccagcctgggtgacagagggagactccatctcaaaaataaataaataaataaataaaagaatttcgcccagtcactgaacttctttgtgactcccttttctctcctgaaaacaaggattaaactactgattgtccttccaagaggttgtctgagtgtcagatcatgttcattataatactttgctccaagttgtgcttgataaattttgaactgaattgtttcataacaatatgaaaatgctttataaactgtaaagggccatgcaagtataaagtattaccaataaccatcatttccccaaagctctgactcctttccaggagtttgtgtggaacaggtaagataactggccataaaatgctttgaaaaccctatgctaataaaagatactttatatttatgttcatttgtttattgaagtttgcatttggttcctttattccatagcaccaatgtattctctatttttgggctaggaaacaacaagcagactcaagtgtgttatttaacctcaagaaataaaaatatccagagataatatgatgagtgaggctgagagtcaagtcagcaagtctttggttagaactgggcacttcttcactctcttacctgagtagatgggagcttgtcctcattagtcataggccccccgttacttataaagaagttgtgaaaaataatactgacaatgatgataatttgaatgacacatgtttagtaatgcatatagatatatactcatgggtatgtatatacagtcccttgctacttttctcaaagcatgtttttctcatctattgttttaatttagctcacactcacatgcagaggtagagtaggagtattccaattggagaaatggccatgaagtgcttaagtggtttgcttcaaggtcacactgtgagtgatagaggagttgaaaccaagtcacagagctccctagtcctgtgccagcactctgtatcaagacccctcagctcctgcggggccttgtgaaaaaacaaaaacaaacaaacaaacaaacaaaaaaaaacaggatcctgagcctcacattaaacaattaggaactggagcattttcacactttagaaaatatttgatccatgtagcctagccctcttccctcatgtcacatacagggaaacagaggaccacaagtaggagcccacttgggcaggtgagttttctgccaactgctcaagcacctactgatgcttcagctctctgtcttttaacctcatatgtagctggtgactaaggtggatggagataatgcagtagaagtcaaggtggtcccctctgaggaccatcttaccagagagggaatcacagtaggaagagaactcttcagttaattgataattttttctttgcaatggaagggaggtctctgtgaccttgggtctgacctcgagcctgacatgcctttttccctagccctctcttgctctcccttcagggatttgggcaaggtaaatcttcaagttcatttaccttctttaaaattgggcagctttacacattatcttggccaatttgagcctaaaaagtgatgtagctcagaagcagtcaagtttagttggatgaacatgagtattaggctgggaagctcatgcccaagtgtgaaccttgtagccttaatcaagtgtctgccttagagctaagcttctctcttggtgaaatggtttaaaatacccatccagtacatgtcctaaaatggacatgaggttcctctgggataaaggatgagaagatactttgtattttgtaacattctactcagatgcaggatgttcatctcattaatattacactctggtgccagtttctggggggtcagctgcagagaagctagttcaggctgcaacatctcattagaagctgaaatttggattcaggaagaggagcatggagtgggtgagagccactgtctgctgctcaagttcctgctgctatctgtattcagagaggcatcctggtaccttagcagtgctgctcagtgggacgtctctgactttgatgttgcacgtgtcaacattctaatagggcagcagccgagatggggtatgagtttggaaagacatcttatgacagctttttcctaaagatgtttcaagagataaccctttagaaataacgaaggtagtttatgcatttcataggaaacccagcggcttacgtagcagctcacttcgaagtctggcatgcggacggcttcctactgtcccgtttttgccctccctgcacatctgtgagaaatcatcacttgtcacagtaacacagtattgtatttagttacattgacagcaatggtgaaaggactataagcctatttccttctaaactgttcacatcaaatgaaccttaaacatttactcctctcttaaaatgtaaatcagatcacctcagcctactgtttaaacattctatcatggctttccatcatgaatagaatccaaatgcctaacacaagctggatggtagcctgatctgacctttgctgacctctctgacctcccctcacacacagctccccttgctcactgtgcttgagccacactggtcttcatttgtgctcaaatatgccaagttttctcctaccttaggagctactattaaaatacctaactaaagctctaaagctcttcatgcctgcaccactcttttctaagatatttcctgcctgcctccttcacatcgagtctcagcccagctcagccatctcttcagtcagtacttcgctgaccttcccctttggccccactcctacccctctgtacatctccattacattgcctttggtaatgtcttcttagcacatatcgatttgtttacctattaattccatgccatgagaggagagattctttcttttctctttttttttttttttagaagggtgttgttctgtcacccaggatggtgtgcagtggcatgatctccgctcactgcaatctctgctccctgcctccaaggttcaacctattctcctgcctcagcctcccaagtagctgagactacaggcacatgtcaccacgcccggctaatttttgtattttaagtagagatggggtttcaccatgttggccaggctggtctcaaactcctggtctcatgtgatctacgtgcctcaacctcccaaagtgctgggatcacaggcgtaagccaccacactcagcctgagatcctttctttcttatggtctcctgaatctctagcatggaagaataaaggtgccgtagcacagaatagatctattatccaatgaatatttgttggaggaatgaatcaatcctctctttttacagagggagaagttaggaccagagaagagtagacatcattgtgtttctgaaggttttatgttagcacctttgggccatgctgggaccttggcaaattatagcattcaagggttttagggtaatgttcatggatccctagaaagtcagcaaatggggatcagggtgtcttgagccctgtgaaagtgttggcatatttctggggagaagattcatagcttttattagtacttcaaatagatatttgatccattggtagcacccatcaatttttccttttaattagcttagtttggggaatgtggagcgagcctaaaagaggatagatgtctcagcaccaccttgaagacctttcttctttttcactgacagcatggttccatcgttctgcccctgaatacggggacagctcctctttttctattaccagagcatatctttcttaaattcactatttccatgatgaatctacagtgccagaagctagagtctggaatcaaagaattccagagttgggagagcacttaattcagtgttcataaaccaaagtgtacagcagaattttctggggagctttttacaactatgcgtttcccactccttcccctgacttttatttgtttgtttatttttgttagagataagatcttactctgtcacccaggctggagttcagtggcacgatcacagctcactatagccttgaactcctgggcacagcaatcatccacctgagcctcccaagtaaccaggactacagggggtgtgccaccatgcccagctaatttttgtatttttggtagagacggggtttcatcatgttgcccagcctcatctcaaactcctgacctcaagcaattctcccacctcagcctcccaaagtgctgggattacaggcatgagccaccacacttagctaattgtagtatttttggtacagatggggcttcgccatgttgcccagactcattttgaactcctgggctcaagtgatccgtctgcctcagcctcccaaagtgctgggactgcaagtgtgagcctctgcacccgggtcccctgacttttagaagtggagtatattaggttcctagtgtttctgtaacaaaattccacaagcaggatggcttaaaacaacagaaactcatggtctcatagttctgaaggatagaagtctgaaatgaaagtgttgctagggctgtgctctctctaaaacctgtaagtgagaatccttccttgactcttcctagcttctggtggttgccatcaatcctgggtgatccttgacttgaaactgtcaaagaactcctgcactttaatttcctcctctgtcaccacatggctctttcccctcgtgtgtctgtgtgtcttttcttcttataaggacaccaatcaaattgtattaaggtccaccctactccagtatgaccacatcctaactttttatgtctacaatgaccctatttccaaataaggtcacattctgaggtactgtaagttgaaactttgttttcaggagatacccaaaacatgacatgacatggggtatgggaatctgtattttttaaaaaaactccaccagtgattgtgttgagacacattgctcttatacacatgcccttcactgaaaaggtgagagaaactgagggctgggaaagggacaagctcagagtcactcagagtctcaatgacccagactggggcaccaagtatcatgattcccccaacattctttctaatgtgccaagctgccttttggagtctggacctggtgatgctctcactggtctccaaggaccagcatttaagtgaatatttccagtggtccatgtctgccccaaggggctacttactactccagtgtaactagaggggcattagtggatcttttggtcaaatcaactgcctccatcccaaaggatatggttttggggcaagttggactactccagcagtcatggacaggcaccccagcttcctccaagttgtactcatgttgccccaaattactgtggcggatggctggtactatgatgaaattctgtgttatatgtgtgagaagacttccttcctcatccatcacttacccagaacactaacatgtggtatatattaacacgatcctctcttgggttagcatgtgggtgggttcttaggaaaataaattaacatctggaaagacaacccaagccttgcccacagtgtttgagatgttactcagtggaaatattggttgtcgtgcccaatttgtgtcccctcccattgtgtttttatgctggaagtctgcacaatctgttgatccccgtctcaactggctccctcacagcagatgcatttaaagtcacagatctcaaagtaagcaaatctaaagtgtttaatctattattaatcagctagttgcccaaatgatagagctctaggggaccctgaggaagacatcaatatttatggcctccttagggagtgcatatttttctctctctcctttattcccacctttcttgccttcagatgagaatggaaatatgaagcctgttatgttttatgccattgtacaaggcaggaatgtcatgttttgaaatgagatgactacaatgtggtattttatgtttgtttgagaatattagctgttagggctgtggtaacctctaccagattgggttaaacaaaagcagtctgcagtccatgataatacaatggaaaagcatagggaacacaagaaacctgggtgaactttttcacaaacaattcatttttctaatgaggcaactaaagctcagaaaaggaaagggtcttccttgtgatcatacattcattttatcattcaacaaaccttaactgaatacctcctattcaacagtgcacgagctgccaggaacaatgaagtaagtattaacagaaatgcctaacatttactgagcacttcttaggtgctgggtacacactaagtccttcaagtagtctctcctgctgaaagtgctattccaagtgcaagttggaacagcaggtgccttggcaccaaagctctatgtgaccgacctttctgacctggcctcacttccttccccctcccctcatttctctctcttctctccctttatttttcttttctttctctctctcttttttttttttttttttttttttttgagacagactcttgctctgtcgcccaggctggagtacactgtcgcgatctcagctcactgcaacctccacctcccgggtccaagcaattttcctgtctcaccctcccaagtagctgggactacaggcacccacaaccatgcccagctaatttttgtgtttttagtagagacagggtttcaccatattggtcaggctggtcgtgaaatcctgacctcaggtgatccgccctcctcggcctcccaaagtgctgggattacaggtgtgagccactgtgcccggcccctgtcctcatttcttatgctccagcctcagtggctttcattgttactgtttttggaatataaatcaggcttattgcccctttggacctttgaatcacctgtccatgctgactagattcctcttcccgtcctcatttctggctactcatatttcaggtcttagcacaaaatctttttcagcaatttcttgaaagtgagtcaccccattctcacccattaagagatagtgactatcgctatcataagatagtcactatctcttaacaaacctgttttagtgtcatcctacacagtgatgtgctgtcaaatccttaacacctgagtctgatggggtggtggtgaggagggggagtgtggtgaggagggggagtgtgctgatttcaagcatttgccaattttcatgatgtaaagacctttactatggctgattcaatagttcaagctatcagcatgatgtcactgaatgagaagttgggaagagatatacacagtccactcttgtgagccactatgcaccagctctgacatacttcttgttgtctgaaattatcatatttatttgtttagttgtaattcttttaccctcctatgcaatgtaagctccaaaggaagaggaaccttatttgttctggttatggttgtatttctagcatctggaacagggccaagaatatgatagtaacttaataaataactgtggaatgaattatgaatgaatgaatgagaattctcacaataactcggttaggtaggtgctactattatcctcattcaccgagtaaggagactaaaatgtggctagagattaaataacttgtccaagctcacacagtcagtgcatgggattgccaggatttgaatcaaggcaatttttctccagagtctcttctctaaatcccaagttatatgaatttaacaaagtcactcctcttgaagagctcaaagtctagagaagaaatagacacttgaacaaaaggggaataatgcacccatgacaatgacaaatatgtacgtaatatacactcagagacctcggtgagtgagaaccaggagagtggcatggtgattaagtaaggtaatatttgatggagtcttggaggatatcattggagtgctttttccaccatgccaaagttgcttcccacctggaaaaactgacattatgaaatctttcttggataaggaagagaaatcaggctttactcaaatgtaaagaaaagcacagaagcattattgagatggtttgagggtcagccggatatttcagtacacaagaaaactgatagtccacttgaggcacgtttccagacagggtcttaacttctcctcactgctgatcttgtgacatgttctctgatgaagggcttttttaagctctaggttgaattgctcacccatttctgcttctgattctttgcctcctgcatcaaaatttcaggtggctactcacctgggatggtagtgtgatatagtttggatgtttgctcccacccaaatctcatgttgaattgtaatccccaatgctgaaggtggggcctagtgggaggtgtgtgggtcatgggggcagatccctcagggcttggtgctgttcttccaatagggactgacttctcataagatctagttgttataaaatgtggcacctcccccaccaccctctctcactcttgtttttgccatgtgacatgcttgctcccacttcactacccaccatgattataagcttccagaggcctccccagaagcagatgctggtgctatgcttcctgtactgcctgcagaactgtgagccaattaaacctcttaaataaattatccagtctcaggtatttctttacagcagtgcaagaacagcctaacacatagtgagtggacagagtactattgcagtctctgattgttctagtagccaggcttgagaaaccacagagtcatcactgacaactgccttggcactccctgcctcttcttctcccctccccaatcccaaatagctactaggttcctttgtcaggtcttgcatcatacctttcccttcatctccacagctatcattctggtccaagatatgggtctattcatccactcattcattcaacatacgctgagttgttgtctgctctgtcccaggcaatgtggtaggctcagggaatacaatgataaccaaaagcagacatgactcctacactcacagatcctatttccaggggggcatattctagtggggcaagcagttgtaaatcaaataaccacctgcataaatggataatgccactgtgatgaaaattaccaaggggagaaggacatggtgctgggggagtctctaacagggcatttgacataatcaggaacaccagggaagtagtcacatttataccaaaatcttaggttctaaaaaatgagaaagcattaaggtatcgaatggaggaaaggtcattcctgccaattgaaaagacatgtacaaatattcttcaatggaaggaccttagctcctgccaggatagtgaaaagcaggttggtttggatggggacagagaacacaggcagagaatgatgtgggatcaggctgaataaatacggcagtgttagcctctgtgtctagatatttgagggaatcaatttttgcactccctctataatacctagtctccccttctggctcattttgtgcaccctttgccaaattcctctttctaaagcactgggtttgtgtgtatgtgtatgcacgcacttcccccaacccccatgcctccattactcctctactccaaaaaatgtcagttgtttttctagtgcctgcaatgtaaggcctaagcccactggcatcaaagacttctgtaatttagcatcaactaaactttcagctgtcacttcccactgttgggaaaccatataacatgatgttagaacatagtgacagaaggagctttggagtcaaatagctgatgtaaatcttgtttcttccattttctgcctttgtgacctaggatagattgcttaatcctgctgagcctatggttttatacttttaaattgaaattatagtgtaaagtttaaatcagataattaaataaagccttgagcataatccatgatgtactgaaagtaatgattaaataatagtctattagactatacagcctactcactatctctcattcttatctagtatttactagctagttaggcactatttctattgcttagaacaacttctttcgcatctatccaaaatgtataaccctttggtcaccagatcaatatcttcagctccttcctttcaggtactatatattgcatttgcttcataacacctaatacaatgcatgaagcatgcttttaataaacattccttggatggatgaataaataaatgaataaagaaatgaagtaaaagaaagtcaatttttatattattctaagtgagggaaaaaagagaaacgaatcaaaatatcttggaaataaaattctgttcctctctgagcttttgatttgtttataagctggggagcatgttgcttaccatttatttagtctcacaagtatgttaacatcatcaacataaggtttatgaagtactttatactgcctggaggaaggatggtatagaaatttaaaatattatatatgatccttccaggaagaaaaaaagaagcaatatctattctgtgaggtgcatcaattttggatcactctaatggaagtgccccgagcagttggtttatttcttcaaatgtgaattaatttatacatttcaaagctcctgatggatacttttcattttaattaagtacatttttgccaaatttcaactttaaaaactcaacaaatttgttcccacacttgctttgtagaatttgcaatattagatataaatttattataaaagggtatgttagaaacttctcatactgaaatcggccacccagcaactttttcttaggattcaagtgctctaacatgtgcttgcttgtttgtctgtgtgattcggtggttttattttgattttcatagaaaataataaatatgtcttgaaatgatcatttcattactgagtattgccagaggttcagagtccttgtgtgcatctgcatttactctcaggttggcactataaactgctactgcaattgtgataaactatcgagaacagaaaaaagaaaatttgatacagaaataatgcatagtaaaataatgctgggtgagggctcactgacataataatgtactgtatggaaaaagagggaagatgctgttgaagaaactgaatattcacgcagcgcacagtagttcaggtgtgctgagctcacagaatcaatgtgattgcacagtactatattgctgtcacaaatggtgttttggagtaaacaaataccattgtttctaacattaaattaatattggtgattcaaaatgtactgaaattataatttgtgtttgtctcatttgtaaatttcctttggttttatagttttaagatagctataaataaaggattgatctctgacttcatgtttgtacattttcaagtatcattatagtaaatataatttgtcaacattgtggattcagaagaacagtttccttcaaaaagcgttcataaattacatcagttcgaaaaattgcattagtagatgatagtaaaagcctccaagaaagtgttgcattatggccaagctttattataccaagttcacaaaacataaagggaggaatcagaaatgcagagaatggcagatatggaaacagcagctttgcaggtaagagtaaaatactgaagttctaagaggtttttagggttggataaaatggaaaaatcaagactgagagaccgccagagtcctgtgagtattgttgatgaactcttaaaatgtgcaaactcaacaagctattgaaatgtgtgtgtgtgtgtgtgtgtgtgtgtgtgtgttacaatatatgtatctcttcttcaatgctttggagatctttttcctacaggactacttctctaatttaccaataacaggctttgtggaaatgataccaattttaaagaaatttactttacacctatattttcctaaaaaaaaatttgtgaaacaagggcatccttattttacctcttcaaaactgttatctataccaagttatcataaaagcagtaaacctgcatttgttagtttttaaactttattttcaacttcctatgtctataaatgtttgttcttgtttaggatgtgtactgtgcttgttagaagaataccacctttttttcttacccttttaaagttgagaagattatttgtaagagtgtgaaatggtctaagcattgcccctttaaatgggggtattgtgttaattgtaagcactgcaaagtgggttgctatattgtggctgttgtactcagtgtcaaaagatttagttccttcttgacccagtcctagttattcaagagtcatcaaacagagatacacaattttaaattgtttttcagaatgaatctgaagagagcgaagagttgagtggagaagtcagctagatcatccttgtctatctatgcagactccttcccataatttttccccaatctagtttatgcctaattttataccaggaatttcttcctgaccttttaattgcctgtccttagggcatgaaaattatgagtgtaattttacagaccattcttaacttttcaaaaccattccaacgatattcatctaagaaatggccagtgtttgtggagcactaatttgtcacgcagcattgtgctagacattcaagatatcccattgagtatcgcacgaaaaccctgaccaacacatccctataccaactaggtcagatcctcattcacaggtattcataatacataaaattcccctgcatagcactaggtcacatgtaggcaataattatttatcttgtatatgccttttcactcaactgtgagctcctagaggacataggtaaaatctgttttgttcactgctgaattcctagaacccaacatagtatctagcaccaagaagcactcaatagaagttggatgaactaaagaagaaatggttggtctaggaaggggttgggaccataagaagcatactgttatttaagaagcaaggaaggcatttaaaaagcacagaattgaataaaggcagattcctgcagcaagaatgccacacaagtcagaaagtaggccagattattaactacaaactaaggaagtagaataaccttttgtgattgcaacatgaaagcaaaagtccaaaccaagaatcatctcaaaagatagaaagtatattaggaaaacatgctttaactgtacccggaagaaaaagaagtgggctaccccttttagtgtgtgaggagggaaagcaaatgactgatttcaaaaggcaaaaacatctcgggctttattcttttgccccaccttagtttttctttcccagagtaaaggcagtgatattataaaagcacacagcatccagaggggttggggaggagtatggccatgaaactaagggctgatgaaagatgattttagaagttggttcttttcatagcaagaggctgtattccttgaactgtccaagccatggcctgttgtttttcagaactcacagaaggtggtaaaggtcagagagtgtccctgaaactagtagatggctctagattccattgaattcctgccaaggggcctgacagcatagatgaattctactacttccagcttcctctagagttagcagagtccaggtttgggagtcaggagacccagattctagtcctgtctgtgccgtggtctctttgtggttttgagcatatcactttatctcttgtatcctcagtttcctcttgtgtaaaaaggagatttttctcatcactagttggtaggacaaggacatttttaatttattttttctccctaaataatgcatgcataacttacaaaatcaaatgttacttcaagtcataagacaaaattcaacattctcttccctcctccctttctatcttggattccagctctcataggggatcactttaggctctcttagctgtttcttctgatattttacctttgtatctcttgtattgcctgttctggtttgggctgctataacaaatactatagactgggtggcttaaacaaaagatgtttatttctcagttctggaggctgggaagtacaagatcaatgtgaggccaatttgggtcttggcaaagacctgcttcctagtttacagatggccaccttcttgctgcatctttgcatgaaagagagaggagagagagagagaaattgagtctctttctcttcttagagtctcatcatggggctccaccctcgtgacctcttctaaatctgattaactgccaggcgcagtggctcacacctgtgatcccagcactttgggaggccgaggtgggtggattgctcaaggtcaggagttggagaccaacctggccaagatggcaaaaccctgtctttactaaaaatacaaaaaattagcctggcttggtaacacatgcccgtagtcgcagccactcgggaggctgaggcatgagaatcacttgagcctggaaggtggaggatgcagtaagctgacatcacgccactgccctcccacctgggtgacagagtaaaattccatctcaaaaaaataaaaaataataataaatctgattaccccccaaagactccatcttctaatcctatcccactagagattagggtttcaacttatgaatttgtgtagggggcacaaacatggagtccatagcaatgccgtttcctgatttttcaattttagatattagtttttgactgtactatggcagatgcagaatattaaattaatattcagtatttacgttatgatgactaaataaataccttcacaaccaagccaaatagcacactcttaaactttttgtgtttctgctttattgttttttgtttgtttgcttgcttgcttgctttgtttattttattctgcatattttatcattgactcagatccaaaatttctgagcaaaccacagaattcctcccagttacaatcaggagtgtgagatgatctctcagttgcatggttttcccagagaccttcctctgggagccccattcagctgaagcctgacctggttgctgctgtgacctgcaggagagctatcttcctgggaccaacacttttcgctagttcaggctctcctattctctatatctcattcttcctcattaccagttatgctctcattttggcagaatgcattttcccgtagtttcttaagaaagacaacatgagggtaaatttttagatcttgcatatttgaaatagtttttattccactcttaaacttcattgattggagatgaaatgcaagcttggaaataatttttattcagaattttgcacacattatttcattatcttcttttttccattgtggctgattaaaaagtccaatgttattctgcatgctccttctttgtttgggatttattgtcccttctcctcctccagaagctgttacgattatctttttgtctctaaagttctaacttcaagacgatcgccttttttaattcacaggtcattcatggggctagaaagacattctgtaagctttttccacctgaagactcagacccttcagttttaagagattttcttttgtaatttatttgatatcatccttgccttcatttctgctctttcatttgcagttccatatgttaggcttccaagattctatttctttgacttttattttattttttgggtgataccttcaacttcgtctttcagtatttttgtcaactaatatatttatctactgcattaacttcctagagttcttttttgctttttgatttttccttcattatagcattctattcatactctagaatgagtgtatgtttttttaatgtgttcttttggtccctaaattgtgcttgtttcccatgatttattttcattcatttgcttgttaattttaatttctccctctccctcctccatatttagaggcccttgactatctgctcttataagtaccacaaagccaatgggctcttctgcatgcaagtaggaagatggccagtaagtgtcctctcccttattctcagctatacctggtgatcctaacctagagtctaaatactttgtcttcttcagagtccacccccagtcttctgcttggctgaaaaagagggattacctggctgcataggctagggcaggggctctggggctttccaccaggttttaccccatcccatacctcagacttcaaagtatccagtgcttcatatttttacacctttcttgtgatctgtggttttatggctttcttcttattgactctactcacttcctcttcacagatggttatttcagctttcttcaccttgctaagtcagttaccttcatccactctccatccttcagatgttgtacttcctttgtcttctcttccctcttttaagtttctctttgatctgtatattcacacctattttattattttgctgtgatttatgtgagtttgggggagatagcaaagataagcatgtatgttccacatcacatgcatcagacacagtgttgtgaaactgtaatttttaaaataaacttttattgtagttttagatttacagaaagttcacaaggttagttcagagagttcccaaatactctgtgctccatttttctcccctatgattaaaatcttacattagtgtggtgcatttgtcacagttaatgaaccaatactaatactaatacattattattaactaacactaaatacttgtttagctagctctttggaaagaagtcactatgtccagtctacatttaagaagtgatgagttacactctacctctttgagggcagagtgtctatgtaaattatttcaaattattctgactgggaaatttgtttcttctcactatttatttacatatccagtcatttatttatatcaatatggattcaaggatatctattttatactttgggttataattcaataccatttcatttattttattgctcacattgtgaaatgctttttaattgtaaacctttatctaaaaagcaagatatgagttaaataatataatataatatatatataattaatatatataatataatgtaaatacggtctacatcttagaaatagttctttagtcctttactaactaacaaagtgctagacacagaatgctgggcaggcacataggattggaacactaaatacttctttggctaacttagtgcttttaaatatatattcagtcatttctaaattcccagtgtcatgttccatgagaggtcacatagatgcataaaagctccctcaaggactgtaaccttattagggaaatacacatatatagacaataaaaaaaaaaacaggtcaacactgtcactaagtagcaaattatgtcattttcatagtttaagagtgacagatttcatggcctgagtgatcaatttggatgcatccatcatggctggcatcccagaaaaggctgggaatgatttagacagagtgaaatgagagagtcttttaaccacacagggtataacaagtatgcatctattctttttggaatgtttaaaaattatcaaatcagaagcatcttaaaattcacttttctttgaaaaatgtatgcaagatccagccactttatttttgttcatatttggttttcggctctgtccacatgtacatttcaaaatccaacaaacaattccattgtttatacattgtggcttccagctgacaaaacccctttatacactggctcactgatccccacagcaggcctgtgaaagaggcagttacaacaggtattacatagagctccattttgcagatggggaaatggaggcccctgattttcaggaggttgcacaggtacaaatgggagaggtggatctagaactcagcactcctgactccaaatccaaggctctgttcatcaacttggagcccctgttctgacgctggaaaagctgggtggaggagaggcaggagagatggagactctaaaaactcagtgttgtggtttgttaggtctctggtgtccttactctcccttctcaaatgaaatgtaatatctcagccttagagattaaaatgggttgccagttattctccttccttttccaggaagaggggattctgcaccactaatctttgctagttgaacaagttgtttaatgaaaaatcatatttgtttgctaaagctggtcccaccggcaagccggtgctagtgccactcagctgtcatacaggctgatgggtcaggcaagaggtggacgtagggtctctgggaatggtctgagctcacccggtcccgtggcctccccaggcattctgcacacttggctgtctgcagcctcctctgctaggaatgaagcagagagagcaagcaaacaccaccaggaaagcttctttaaggtcctttgaagggttcactctgcgggagactgacggttttgaacatttcagctctgcagagccttaagccctgttttgaaggggcgctttggtcaatagaaatttggtccttagaactcactttccctcttttcctttgtatacttcaactcttagtacgttcagggactacctgaatatgaattggttattgagactttcagaggcaggatctctgaaggtctgtgccatggatcctgcaccccattttgcaattttgcatgttattcttctttctaggtttgtggcccaattaggggatcaccaaatctttttcaagaactcaggttctataggcagactgccagggtttgtattctggttgcttcatttcacatctatgtggcctcagaccagttatttaaagcctaggagcctcacttttctcatctaaaaagaagcaatgagttcttgcttcagaggatgattgagtattcagtgagataatgcaatggtccctagtacatagaagcactcttaaaatattaacattagttttacctattattgaataaactttgctatttctgagtgccaaaggaaataccaagatggctaaaaaaccatacttgccctcaagaaaatcacagtctagctgggtccagtggcttatgcctgtaattccagcactttgggagataaatgcaggagaattacttacacctaggagttcaagacaaggctgggcaacatggcaagaccccgtctctaaaaaaaaaaaaaaaattaattagcctggtgctgtggcatgtacctgtagtcccatctactcaggaggctgagttgggaggattgcttgagcctaggaggtcaaggctgcagtaagccatgttcatgccactacattccagcctgggtgacaaggtgaaactcagtctcaaaaagaagaagatcacagtttagaagcagatctagagaatgacatgtaaataacagattacatatataatgaccattgtataaatgtgattttatatgtataatgattatatatagtggatattttatataataatatactatcacatgttattatatattatggcaattatatatataatcaaatatactaagtcttgtcaaagtagtatactcaaactacttgggggagggagaatgcaagaataggaagagcacatcctgtcagtgctgttacctttgatttgattctgatggtttcagaaaggaagcacctgactgggttcagttaaattatgggttgagtttagtacctattagaggaaagggaaaaataaaagcaaagagactagcaccaaattaaaagtatattttaggaacaccagacaatccatttgcagttacacaggggaaaaagtaagaaaaatataatagataaggtggaaaagcagtttatgcttagaatctggaaagccttgaatgccaagcagcagaggtgagggaaggactcagatcctaaggtggtctcgtggagaactgagtttgacaatcttacttattagcctcccttaactgccttccttaactgcctttggatctgtatttccttcttaggaatttcttgtttcttcctttccttatagccaatatttattgggctcttgagtttatgatatggtccactgaaaatctacaatctatctgtccaatgatactttaacagaataaaatgaaggttaaaccacggcagcttttctcactaacattcaataatttaggtttaataaagcttccgtggagtggggctattttgtttaggttttttattgtattttattttatttgagacagaatctctctgtgtcacccaggctggagtacagtggcacaatctcggctcaccgcaagctccacctcccaggttcatgccattctcctgcctcagcctcccgagcagctggaactgcaggcgcccgccaccacgcctggctagtttttttgtatttttagtagagatggggtttcaccctgttagccaggatggtctcgatctcctgacctcatgatccacccacctcagcctgccaaagtgctgggattacaggcatgagccactgtacccggccagggctgttgattttatataatttccttcctttttggctgattgaagtccattgctaattctagtttgacactttttattacctcaactagattattttgtccagaaagtttactgagcatcttctaggctaagcactttagaaagtatgaaagaagtttaattcacaatacttatcctaaaagatcacaatcttgctgatggcacttagacagtacagcaatcccttgatatccacaggggtttggtaccaggactcctacagataccaacatctaggtatgtttaagtcctttatataacatggcgtggtgtttgcacataacctaggcacatcctctcacatactttaaatcatctctatattacttataatacctaatacaatgtaaatactatgtaaatagctgccacactttattattttgattgttatgttgttaattttatttttaatattttcaatctgcagttgtgaatctgcaaacgtagaacccacagatacagaggggcaactgtactcaaattatttgagagtggtgcaagcccgccagtgagtttgtcaccagttgagaagacttaaacgactaactctataatatagagatttattctgggtggtcaggaagggccaagatcatagatagttaaagatccagagaaaatgggactttgaagtaaatgaagggaggggaaaagaaaaatgtgcctgagaaatagcataagtaaaagtcctgaggtacatggtggagtcacaggggaaaggaagaaggctgtcggcttgactaaagtgtgtgcagggagatgaagcccgctagataaggtggacacggaggcactgcgcaccttgttgccaaatagcgccggtcgtcagagagtctacagtgagagccatctcttcctgtttgtaatagaagtatggagtctggacccggcgcggtggctcacgcttgtaatcccagcactttcggaggccgaggcgggtggatcgcgaggtcagaagattgagaccatcctggctaacatggtgaaacactgtctctactaaaaatacaaaaaaactagctgggcgtggtggcgggcgcctgtagtcccagatactcgggaggctgaggcagcagaatggcgtgaacccaggaggcggagtttgcagtgagccgagatcgcgccgctgcactccagcctgggcgacagagcgagactccatctcaaaaaaaaaaaaaaaaaaaaaaaaagtatggagtttgtaaggataggttttcaatcagtagaaaaagagaaatgccctcaaatccagaatttatttaggaaagaaatagcgcttttccacccaggtttttgactgtggaaagtcaaaggaggcacctgaaatttcagaccactatacccaaagcacctacatacatagaaaatggtgatctcaagcctcagagtgaaaaatgaacatcccagggagaccaaagaggagaagtgcctgtctgtttcttgccaggctggggggccaaagggaaactgggagaagaagcagagacacgtctaccaccatggaaccttgctgctaaaaattgatttcagagtttccttatgtctcacagcctgggaacttgaattaaatgagctttgcacagagattgccaacccaaaagacctgggaggtgaagccttctgtttatttcaagtttaactgtagcttcagctgtcagagcagcatcacatcttgggatcccacctggagcatcctagcctcggggcacttctttatctcatgaggaaggtggaagtctgagctgatcagatgcttgatgatgaagtggattcctcctgaggtagaaacttcctctcactggaagttttcaagtagaggaccactttgcagggacattgtcaagaaaattcattcattcgctggatgaacagaatgatgataaacagctaacaccgactgagcacatgctggtgccagaccctgtgtttagcactttaagtattttgcttcctatgtctccatgagataagagatgctgttatccccattttacaagcaagaagccaaaacctcaaagagtttggaatcttacctaagatctcataactcataagtggtaaatatttaaaccaagtctgtctgattctgtgatccatattcttactttttaacttcttatttccagaaaagtgcactaaagcccacatacttcacaaagagactttttttaatatcttacagccctgctgttttataatctcactgctaaagatgaaggcatttttggtttctgaccttttgctgggacatgaaggtcttgggattaaggttcatatactctcacatgtgtgagtttcatgtcctcagtgcccatgtctaaaagcaaaagtgaaaattaaatcagagcggaaaacacctctctattcaacaccagattgttagggctgagctgaaaagctcctaagtaaactagttcatggccaagtggccagagaacaaattctaggagcctgaaatgtgagatgggagagccagtttgcaaccccaccttgttcacaggatgatttcaggcaggttccttagatgactgaagtttttgaattgtaagggaccttagagagtcctaatgcagattgttatcaattatgctgtacagaattatagagttcacaacttattctgcaaatattcattgtgaacttgctatgtgcctagtattggccaggagatgcctccagggctgctagaaaggagaaggaggaacaataggacaaagttgttctctcatcctcacttctttagctgtgccctccattgtctgtgtcatgtcagcattgcagttaagacttattttgaaaaggacactatataccaaaggactataaatcatgctgctataaagacacatgcacacttatgtttattgcagcactattcacaatagcaaagacttggaaccaacccaaatgtccaacaatgatagactggattaagaaaatgtggcacatatacaccatggaatactatgcagccttaaaaaatgatgagttcatgtcctttgtagagacatggatgaaattggaaatcatcattctcagtaaactatcgcaaggacaaaaaaccaaacactgcatgttctcactcataggtgggaattgaacaatgagaacacatggacacaggaaggggaacatcacacactggggcctgttgtggggtggggggagtggggagggatagcattaggagatatacctaatgctaaatgacgagttaatgggtgcagcacaccagcatggcacatgtatacatatgtaactaacctgcacattgtgcacatgtaccctataacttaaagtataataataataaaataaaagaaaataaaataagaaaaagacactatatagcttgaattgctcttagacagcaatgttctattctaacactcccatttgatagatgatgaagccaaaaaagataaagtaatttgcccaaagtccagccatcgttgctagctagttgccactttaccccagtacctcctacagccctgggctacagttcccacatctctacgatggaggaaggggaacagactctctctagcagtcttttccaaggccaaagtgttttcattttctgaatttcttgaacatccactgtttggccagtattgtccttagctatctaatagtcacaacccttaagttcttttctttctgtccctcgtgccctttgtcttcaggctggtaaactgtcatagatattgatctgagctttgtttaatcatgctaagcttataccatgggtcccagggaaactaggaagatgaacagtatataacaattacaattaacttgtcatttagcattaggtatatctcctaatgctatccctcccctgtccccccaccccacaacagtccccagagtgtgatgttccccttcctgtgtccatgtgttctcattgttcaattcccacctatgagtgagaacatgcagtgtttggttttttgtctttgtgatagtttactgagaatgatgatttccaatttcatccatgtccctacaaaggacatgaactcatcattttttaaggctgcatagtattccatggtgtatatgtgccacattttcttaatccagtctatcattgttggacatttgggttggttccaagtctttgctattgtgaatagtgccacaataaacataacgtgtgcatgtgtctttatagcagcatgatttatagccctttggctatatacccagtaatgggatggctgggtcaaatggtatttctagttctagatccctgaggaatcgccacatgtgccctaaaacttaaagtataataataattaaaaaaaaacagttaccagtatttattgagtgcctaaggtagtaaaggcttgagaagctggagcctattttcataccgaatatgtaaatatcgacatctctgctctagaagatctaggacactctggaaaagtgtctgtatatcttatattaggagtagtggcctcaccaatgtggtgtcatggttagtaaaggacaggctgagtgaacaagaagggactgatcatgtctttgccagttgccaccgcctagctacgttcttgggcatgggacctaatttgtccagcctcaactttcatctgtgtgacaggtccaataattccccataccacagggatgttgtgatgattaaatgataagcagagattttagtacaggattggatatatagtaagctctccataaatggtaatactattactatacatatacatgtattttacatacctatatatatttacatacatttatgatctagtttataatctccaatatgccttggaagcttcagaatgagtcttatttcatttttgtaatgttactatcatacacagcaataacagaaacaagttctaaaatttctccctggagctttacttcaggagtttgctaccaattagaggggtggggggaagaggaagagatgggagaaagagaatttcacctgttttagtctctatatacaaataaagtgggtgacccctaactttgccaagctcttgcctcagaatgaaaccacacccagtgcctgtaacttcctaatcaaacacgtgagttaccttcaagggttacaaaatcatagttcatggatgaaatatgtgtggcccaaacagaattctaatttgttaaaaaaaacagttgctaacctttcaaaatacaagaatttcatttgaaaatctaggtttctgtcttctcacttacttttaactttcttaatctgacctacatactcaaggcaaaactatatagcacactgttttatcacaaaggtaacactcagccaagtcaagaattgtagcgttgtcagcccccaggaatgctcttgtgcccatccctagctctatacactgtctctccaaacagaacctctatcgggattcatcataacatccttgtttttctttagaactttaccacctaagcatgcatttctaaatgttagagtttaattttgtctacattttggaattcagaatatactcctgacctcacggtaggaaaaatcttcttaaacaaaatataaaaccatccataaggaagaaactgataaattgaactgtattaaagttaacagtttctgtcctataaagcaggagataccattaagagagtgaaaatgcaagctacagaaaggaacactcacatttagaatacctaaaatcagtttaaaaagaggagagacaaccaagtagaaaaacaggcaaaaggtggccaggcgcagtggtcaggaatttgagaccagcctgaccaacacggcaaaaccccgtctctactaaatatacaaaaattagccaggcctggtggtgcacacctgtaatcccagctactagggaggctgagacaggagaatcgcttgagcccaggatgtggaggttgcagtgagccaagattgcaccactgcactccagcctgggtgacagagtgagactctgtctcaaaaaaaaaaaaaagagatgagctattaacacttaaaaaggcacatcaacatttcaataagcatccagtatgtatttatgtgtgtatctgtttacgtttgcttaatataacactcataggattcatcctcatgattgtagataggtgtagtttactcattttcattcctgtataggattctattgtatgagtatgccaaaatttattcatccataattctactcttgatggacatttgggccgtttacacttttgaataatgagtctataaatattcttgtatatgtgtctgggtgcacatgtgcacatattttttgttggatataaacctgggagtgttatgtgaatgttcagctttaatagatactgccaaatagtttttcaaagtagctgtaccaatttacactcccaccatcaatatgtgacaattcccattgctccaaattctctcaaacacttgggattgtaagtcattttaattttagccctcctggtgggggtgtagtgataactcattgtgattttaatttgtatttctcttgattatttgtgagttttaacttcatttcatgtgcttattgaaatgctgatatgcttttttaagtgataacagttaataccttttttaaaaattgattttaggtattctaaatgtgagccttcagtcaaatgtgtatgttgcaaatatcttcttcctttccatagcttgcattttcactctcttaatggtatctcttgctgtgcaggacagaaactgttaacttgaatgcagtccaatttatcagtttcttccttatggatggttttatattttgtttaggaaaacttttcctaccctgagatcaggaatatattcttctatattaacttttggtggccttatgtttttccacttaaattaatgatccatctggtactgatttttatttagggtatagtataggggtctagaatcaatttttctacatagatatccagttgtcagcatcatttattgaaaagatcaccttttctccactaaacttcagtggcatcttggtcataaatcaagtgaccaagtatgtctggttctgcttctggtctttcttttctgttccactggtttgtttatttctcaggtacttagatttaaactgagcctttgtatctggaacaggaagcttttcccctttttcaaaattgttttggctattattagacctttacatttacatacaaattttagaaccagcatgtcacattccaaataaaacctacagaaattctaattgggatataatttaattacaatcagtttgggagagttgatatctttacaatattgagtcttcaaatcccagagcatagtatattgcttcaattattaagatcttcttttatttttttcagtaatattttgtagttttcagtacagatcttttgttagatttattttgtaggtattcaatgttttttgatattataaaaagtgttcttaaaatattatgtcataattgtttggcgctggtaaatggaaatacaaatgattaattttatattgattttatgtctcgtgaccttgctaaattcacttttttctacagtttttctttctgtgaatacagtcatgtcatttatgggtaatgagagtattattttttccttgccaacttgaccataatatctccttattcagtttgttagtactttaagatgtttttcatcctgattatgaaataataaagtatgtgtaattttcttttcttacaatacccttgttcaatttggtattcaggttatgctgacctcaggaggaaaataaggcagtgctccctcttcccattctttaaaagaatgatataaacatatcacaaaagatatatatatatatatatatatatatataatcacagtttctttatccactcgttgattgatgggcatttgcattggtttcacatttttgcaattgtaaattgtgccgctataaacatgcatgtgcaagtatctttttcatataatgacttgttttcctctgggtagatttataatctcaccttctatactattgacattggtggattttttgcttggttgctctcatattttctctcaaattattgaggggttggttttgactttgtttatcttgtctattgtacatttatttcattaacttctacactttatttacttcttcttttctatgtttaatttgcagggctttttcctgacttcttaaaatggatgcttggttcattgatttttttcatatcttttcttcttttctaatatatgcatttgtaaagccttgcatttctctctaaagatagacttaaccacatcactattttcttggcttgtttcagatttactaaattttaaatttttttgactttttactcctgtattaatttgaatattaggcaccccttaactgttcttctagtgcttacactgatgattgcaacattcattcttggcatatcaaatgttattgtaattgccacttacacccttttcccagatggtacaaagaccttgaatacttagttttatttatttaactgctaatgtacatgttattattgttgcataatttttatatttttacagtcgacaatatggtattattgttgttgctgctcttttattcagtcagcattatttatatttacccatatatttataatttttattaccttttattctatttgttatctcaaagtttccatctggaataattttccttctttgtgaataatatcattctgtatttccattagtgtgggtctgttgttgacaattttttttctttttctttgcatcaaaatgtctttattttacattctctatggaaaaaagtttttgttggatatgtagtctacatcacagttattctctgtcagcactttaaagatgtaatttagttgtttcttgtgaagggtcagctgtctgctttattgttgatcttttgacagtaatctgtctgcctttgccccacttccaggtacagagttactgtctttggttttcagcaattttgcaatattctggttagttgcgattcttttttttaatttaacatcatttgggtacattggacttctcaaatttgtgtcttgatgtcttttgtcaggtttggagagcttttggcaattaattcttcagacatcatttatgtgtccttcttttttcactttatgaaatttcatttacaatgatgttaaggtgtttcactgtaacccacattcttttccatattttctatcattttctctttatatgtttcaatcctgttatattcttctgatctatcttgatgtttgctaattctctttttggctgcacctaatctgccattgttcctgtctattgaattttagatgccagtcattatactgttcaattttggaaaatttttcgtggttctttcacatggttttcagtcctctgataaaattatcaatccttcatttaatctcctgggagatagtaagcatagttgattatgaaatttatgtctgtaatgtctgattactctattatcttgagcccctgtgggtctattcctattttctctgcttttctgttcattttaatttatgttgtcttatcttcctgtataacagtttttttttactgcgttctggacattgaatttgcaaaatttctttgcagaaataatttgaggcctaagctgatgttatctttttccctagtagatatatgtttgcttgctgcactagtactccattatcaggtcaatccaatttcagggattgagatgatttgaagctacactgcaacccttactagtacctgtctatttccagttcagccttactcctattgggcagcccttctgagtcccagcctaaagttgggtttaacaagcttcccccactgcaatcaccatattttggtcctggactccaaatttcatctttctatttctggcaagctcttaaatgagcttcctcttagttgtttagttgcttactctagaattagtaaatatccccaaggtgcaagcagctccaaacacaaaggttacctcccgggcttcctccatccttagatcccagccctgctattctttgctcttttgttagctctcctacatcttcaagtagatttgtaaatattttgcccagcttttcttgttgttctcattgggagtattcgtccaaattacatagtctttcattaacacaagaggaagtcctgttcctgatcttgaaaaaaatgatagatatgtccacaataggctgaaacaaggcagtgatttctcccttcatatgaggaatacattctcccacaatgtccagctagcctccttctcattcaccttagcccagtgactttggcatttgggattcagactcttttctttttttttttttttttttttttttgagatggagtcttgctctgtcacccaggctggagtgcagtggagcaatcttggctcactgcaggctccaccttccgggttcaggtcattctcctgcctcagccttccgagtagctgggattacatggcccaccaccacacccagctaatttttgtatttttagtagagacgaggtttcaccatgttagccaggatggtctcgatctcctgaccttgtgatctgccggcctcggcctcccaaagtgctgggattacaggcatgagccaccgagcccagcccagactcttttcttaaatattccaataaggtacaatttgatcatcctaggtttctttcctctaagtctggcatgatatggttggtaaatggaggttaactattttattattttgctagagaagaactcctaaagcccctatggggttggcatcattctactgtctgcatgcctggaagatctaaaatatttagtgggcccagaactcctctatgaggacagattgccagactgctttgcactgcagagcctttcaatggaaaactggatttctagcctcagttgtgatgtgagaccaggacagtgttgaatggagactaaaaatagggtgacttacaaacagatagtgtgtatctcccagggagtgtgaagtccactttccaaagcaactgccagcataaggagtgttaatgccctctgggatccaagtaggatgaaaacaaaccacagaaaatgaggtaggatgttcaactctccctttcagtgatcaggaaatctacatgctcatagactggattattcagaatagaccttgttgaaagttactggaatggaggaaaaccctacaaagatttccagattccctggggaagacaaaagtatttggtctttgttgttatcgttgttgttgtttaaagtgaactcctgtcctttgctctaattcaaggaagaatttctgagtatagctactctatgcaaaataatctctgcctttagggcttcccctaattgtggtcgagagtgtagtctccagagtcaagatgcctagatttcaatccttattctactatttattagcattgtaaccttgggcaagttatctaatttctctatgttgcaatttccccatttataaaatggaagtaaaagtgctactttatctccaagggtttttgtgaggattttaaaaagtcatgcatataaagtatctagaacagtgtctggcacatggaaaaactcaaataaaaatagctatttataattaattttgttttagtattataattgtatagtaatgctcaacacgtttatcgtgtgtctctcaaagccctggatttcttatctcagttctgcactctttcatttaaagttctgaacaggctgtcttcaacctggtggatggttcaaacaggctgtccaactttcttagttggatatggggatttccaaatcttgctgctcatttcagaaagctttttgaaaatatagactcctaggatttgcccacagagattctgatttagtagatttggagtgaggcctaggaagctatattttaaaaagcttgccactacgtataatatgcaaccaatttggaatgactgaactatgatgacctggtaccaattattaaatatatggagccaattattaaatattcataaattttgcaaactgattgttaaaccattagtagttattagctatggtaggaatatttacaccatggaaactggcaaatcctacattctttttttcctggaaagctggtttactgtcccaccactggcacaatcttcttagcccctgggatctggagtatctctgtctgaatctcctttggttagaactttacatctccatgattttctgttctctaattgaggttttgatctgccaggcagtagatattcctgtgactgaaagggcttccagctagatatctctgcagccataatcaagctctccatcattgctttgttttgaggcagaggtggaaaactggtggtcagtggtgattctggttcacagatgcataattgttggctctcacgaagacttaaaattaaagtcggaggcagctttttaaaaaattataagatggcatataaaaatccagattctcaccttctctttcaaaaaacaaacaaacaaacaaaaactaagttgaaagaagatctggacctgcttttcagtggacaaagttcagccaaagctacgtgagcactggcaggggaaaggtgttctctcaccggctcatttgttcatttatgttttccgcctggccttgagcttgcagctcctctgggaagcagtgtgttctgttggaaaaggtgccagactgggtctttggagatgtaggtttgtaatcatgactctgttttttaatttatcgtgtgaccttggtcaagtcattctccctaacagagcctcagtttctcacctgcaaactagggagaatgcttgctttgtctgcctctccaaatgtgagatggggaaatgtgagtccttgaccaccagctgtagaaaagtaaggaattattgctaaatattgattcctatttcctgccattggcacctaggtgggaatgaataatcccagaacaggttctgataggagaaaatatttgaatagataggagtgctgagaagggataaggagagagtgcctataatgagaaaagtgcacaaaacagaaatactagtgaatatgctgaatctacagtcttcttaagggaaatttgggaacatgagaatttgaagttgatactattaaccaacctcatgtcacatataagaaaatatgggcttggaaatcaaatctgcacataaattccagaaggctatgcctttgtgcaagttaacttatctgagcctctgtttcctcatgtatacaaggtggatattagaatctatcttgcaatgcattgtgaagattcagtgggataatgcatattaagtgcctgagatattttgtgaatgtccaataaatggcaactgctgttatcagctcaaatcaggcatatgcaaattgaactactggcaaatagggaagtagttaggagaatatgatgtattgttagtggatatttccttatcagaaaagaactttgcataatccgtaagggacttcttctacttcccattccactgaagaacttcaatttagtattttacccagcatttgctgcaagcttcgtaggatacccagccacacatacccatatcagcagcaagttctgagagccagcggcagtattagcattataaagtgtttccagagttggaccagtgtgtgcttccccttcataaatccttaaatcttaggctcactcagctggaaaaaaaaaaaagaaatctgggtttgaagaacacttatttatttttgattttctctgccttgtgtgcttcttttgactgcgcatctgaatatcaaggcaagaagtgctcaagttcctctgggctctggaaggctggaaccaattggtattcttggagtcggtcctttttggactaaagctcctttttcttttcctccccccaataaaaatttctgttccagggagtactttctcagtcactcctttcctaatgtaattctgtttgatttccactgaacggctcctgaaaggagacactgaaccatgcctccacaagcatttcaattcctcaacaccagctttcaggcaggagcagttccagatgcatttttatatccagtaatcatgcatttaaccaaaatgattgatgcagcattttttcccctctctatcatttccagtccattagtcttatttgttttccatggtttgggttcctgccaaatcagtgaatatacaaatacttgcataagtcatgcacatctacacacacatacatgtaataggtactgggtctgtatctgagttgaatattcaacattttatttccaggcttcatgtctccactgaagttttagccgcttctttccttctttcttacttccctctctcccttctttttttccctctcttcctctcctttatagtctattaagttggtgcaaaagtaattgtgattttgccattacttttaatgacaaaccacaatggcttttgcaccaacctaacacttttcccagaaacagccacttttttttttttgtcagccatcatagaatctgatattcttcagcgttaaaggggcttgagagaggcatttacataatccgttcactttagtttcagaaaatcaacaggccagaaaggaaaccatgtgccatcccaggctttccttggcccttaggcaaacattccagtgccacgtcccccatcagcccttgcacgccctggaccctgcccgctgcatcagccacctctccacctcagtcttcacactgacctctccacttcaatcttcacgctgtagccacacaggcctttagtccttgccttggggccttcacacctgcttctctcgctgctcggacagtttttcatacataggtgcacacaccttcttcactgctccacctcctatttattctttaggtctcagctcaaatgacacttcttagatcacacaccataccaccctctcctgactttccaccctttctcttctgacacttattacgatttgtaattttgtatttacttgggtatttagttgtttaatgtatcttcacttattagaagacaagccctataaggacaaagaccatgttttccccgcccctcaattgtttcctcagtgccatagacagtgccttgtgtttgatagtgacaatagttagcaatcataaagtgacagtatctaacatctgttaaaaacttgctagttccaggcacagtgtcctatgatttttatatgtatttactcatttaatacttacaacaattatcccgtaaagtaggtgtgattattatccccgttttgcaaataaggaaactggtcaagtcactcacccaagattatatggctggaaagtggcagagtttgtttgtaacccaggcattgactccaaaacctgaacccacaaccaggccatgctactcctgttaagcacttcattaatattcattgagagaataagtgaaaaatataccttaatcaattagtagcaaaactgaaaacctaaattgtttgattgataagccatttctctttctatgcaaacagagagcctctcaggtaccaccagaatgcagcagaaagaaagagaagattaacaaattcatttattgctgataagaactatgagagggacgctgtgatatagatcatgaagtgaagtggaaattattattttagattcaggcaggacccagtggcaggtggaaaaaatacagagtcaattgaagaggccttaagataaggaatcagattctccagaaacatcaagtgggtttacagttattatcattaacaatttaggcaattcttatgctatggataacattttccaaatgtgattttaaagtatgagtaatcatcagttttatgaaactgctgctcagaattctaggataaaaactccaataatgagccttgttcagttgttccatggcatgtggaacagttcctagcacatataagcactcaacagacatttatttagtaattaatgggaaatgaacatcaacaaatccatcagcaaatacttactaagtactcgttattaagtctatacagatcaaggcacaacaaggcacaaaagtaaaatgtcagatttcttttcatggagagctcataatccaggtagacccagaaataaccaccacaatgaataaaagctgctagctgggcatggtggcacatgcctgtaaccccaacacattgggagtctgagatgaaaggaccgcttgagaccaggagtatgagaccatactagtcaacatagtaaggccctgcctctacaaaaaatttttaaaaatcagctgagcatggtggcctgtgcctgtaattccagcttctcaggagactgaggcaggaggatcacttgagcccaggcggtcgaggctgcagtgagctatgattgcacctctacataccagcttgggcaacaaagcaagatcctgcctattaaaaattgttgataaaataaaaaataaaagtaaacgccaccatcactggggagttgctttgtccaggggctctgccatgtccctctgcatatattaggtcatctttatactcgtaacaactttaagatgatggtacccttcctcatccccatctctagatgttgaaactgaggtttaaagatgctaatttctgtcctaaagacacagaaacaagaacttagtgcagccaggatttgaactcaggtcggtttgagtctggaaccaatgatgccaaatgtcttcatccctttattttgaaagcactatctgtgggtgaggcatactagaactacaagactttgcagtatcagaggatgggagtggctacagagggatcaatgaaagcaacattacccagtctctccaggtctgcatatcctgcttacctgggtatgaaacactccatctctcacctgccacagtcctgtcattcaggtcccagattcagtatcacttctgcatatgctgcttacttgggtatgaaatactccatccctcacctgccacaatcctatcgttcaagtcccagattcagtgtcacttcttcctggaaggcttttcaaacatggtacaatttgattgtttcttcctttatgctccttttagaatccggtgtgtttcctgattataattcttatctcgcattctgattacttgtttcccattaactagtctttgagttcctctaggacaggggtgaccaatcttttggcttccctgagccactttggaagaagaattgtcttgggccacacataaaatacaccaacatcaatgatgagctaaaaaaaaaaattcgcaaaaaaaaaatctcataatgttttaagaaactttacacatttgtgttgggacatattcaaagccatcctgggctgcatgtggctcacaggccacaggttggacaagcttgctctaggatacaattttattctcccagggcctagcacagcccctagcatatagtaagtcatttaataaataagtgtggaacgaatgaattttaggtagaaattgtcatcagatggttcaactaatatacagcacaattccaagagaggagtgtattcttgggcatcagggaaaagggactttggaaaagttgagttggaggccatgtggctattaagatatctgtctccacatgcctcgactgactgtgtgagccttggaaagttattctctcttcacttcagtgttttcatccttataattaagatgataaaaactgggttgttgggaagttgaaataacttaacatgcaggaactcagcagagtgtctgttcattgtaagtactcaaatgttggccatggctatagctgctgctgcttgtcttctctgaattattattatggaaatttgggtgagtacagcatttcaggcagcaggtcacttctgagtaaaagtacagaactatgaagagatctcctacccttggatataaaaacaattcacagcattgccaagaaagactgtagatattcagggatgagagtgagattcctatgagccagagaatcaaaagctctgtaaattagtgagttcgtgatatcatgctacgctcctgtttttaagagctagatatcaaaataaatggtccagtgtatgtgcctgatggctatgtcttttccactgtacacacaagtaagattctgcatggtgactatcattttgttttcaggaagtagatgaatcagccgtttggttccctgggaatgtgggctgctggcttttaattctttttggggaagatttctatgtcatcagccatcttgtttatctggaaacatgggacaaacgttggctctctttctacctatgtagtcctttgctagggttgtacagcttgagtagaattgggaaaagtgatttggatccttgtgactgggattagggagaattggtacatgagtatacagaatcttttcattgatctccttgcctctgaccttgatttagccacctactttcagtggataaggccctacagaacaaaccaactgaagcatactttaggataggccacacctctaatctcatatttattatgaccaactaaaaactgcttatccttctctttatgtctattatttaactttcccctcctctctaccttctttcccttaagtccttctgatacactacatgctcctgccattgtgactatgagtctaaaaagctggtggcattacccaccttcccctccaccttcaaaactcacatgtacaccatgctttgggcttctctgatttggctcactatttcttcaacttagaacgcccactttctattatgatcattaaaagatcctggatttatgtgtggggtggatgtagtaacaactgggaaatagcataaaattatttggtttcttgtatgctggttttcttcccagaggtaacctgtttggtttgacgtttggcttaatgttgttaatttgacgaaggtggaaatggatgggctagaaatctttgtgggactaggataaggcttgaatggtctaatctagggattcaaactttctagttaagaatgtacaacctgtgaggataatttgcattttattctacatatatcccaatttaaccagctttcagactttaaatcaccataagattttggaaaacttctactgtctaaatacagaataaagttttctaagccagatgaaaaaaattgcatcattcttgcaccctgcaggcaaatgcatgttgactgcaaagctatataaatgtgtgttgagtgatttaacaggtctggctattgaacttgttaaaaatggatgtcaggaaagaaaaacagcaggtgggtgtagactggaggagtgggcaatgcctgctgacagaaagaggagtgacagctgacaaggagggaaggcccaatggagacttcaggctcaccacgtatggagcagtctggggaccgaaacaaagaaatgaaaacaaacagagcaccctaccacctcaagaatccctaagggagttataatatgcacaaatgctcatgattattaactaggaaccagttattctatgcctgctatgagccaggattcattccaggaaattaaagagaatagaaagaagtataaaatacagtgcctaggtctgcaagtatttattacctgtgacactactatgttggccaaggagaagttctgtatattatgctctttttataaaagcagaagcatgtatagaaactattaggatatttttcttcaaaatgtttaaaattctttagctgcttacaagagaaatttatttagtactactttctcaaagatcccatttcctgacaatgctaataatggaggcatttcaagataatgacctcataaaattcacacaactgtctgtctgtgcagacttagatagcacagtcatgacctcacttaggtcagggacagatcttagcttgatagggcaatggtcagaaatgcagtttggtttaaacagttttttcctcttctctgttgactcatttaatgaaagaaagtgtctcattcaacctgcatatttttttcaaagattccacaatgatggggccatgtctcctatgagttattatacaaaatggacactgagtcctgaggtacattaggaagccccaaacttatccttgtatttaattcatttgaacattttggatattttattttatcaagccagtcatttcgagttgagaagtccgaagatcttactcattttagaaagactaggttagggcattttctctggggaaagacctcttctgtaagggaacttcaagaaagggagcagatgggctctgtgtctactgagagacaggaggataatcaggcagtgacatagcccatggtactggagagaaagacaaatcgctatccacataatggaaggcatggggtagggtgagccaaatggaaggcttataaaggcagcaagcaatgaggactagccatttatttaaaatggaaaagggacaaggtatctttatcccactttatcccactgtccaacaaaattattttaaaaaaaagagagagagagagagaagatgaagaaattaagagtgggaaaatactactacaaccgtttggcctttctggcctcttaaaatctgaggcaggtcagggaaaacatggcaagaacactaaacttaaagagtcaggaaatggatgctcaagtgttgttgctgcctctgactcagccttactgtgtgaccttgaggacaatatttccccaaactccaccccagagcacttaccgcttccctgtagataaatataaggaagttagaacaagtctctacagttctttccattcctgacattctaggcttttataatgagctaaaacaagaagcttgttttttaatgtgtgacacaccatgaaatgtatacagagaagtgacctataaattctgattaagtgtgaattagatgcaaatacaaaatgcaagattagagtgaaaagcattacccctctgtaggtcaggaagtataatgtggtttctttgcactatgaataatgaatattgtacatgccgaaatgagcactggaaaacatagaaggaactagatgctcttctagaatgggctttcttccctttgggatagactttttttttttttcctatttttgcacccatgcttagagaggacacaaacatctctgagattctacttgagacaatgcgacaagcacttaaaggaacaccaaatcatttgagtgcacaggcaatgacaccatctgtagacttatctgatccagagaacctgaggtggagcctatagcctctggtcagttggaagcggtggggaaatctcaagaacacttgtcctgagagaaagaaaactttatctgcttgttacacatgagcctgagctgaggaaatagacctggatccagggaattcgtgtttactgggtgccacaacttgtgttagcacttgacatgatttcttctatttaaatattagactaaaaacactctatcagactagggttttaaaatactatttcatttttttggtacctatttataaaatggggaaactgagtcttgggggatattaaggtcttatagactgtaaatggtataatccaaggttgaaaggtttcctgactctaatgctggttctctttcacaatacctcattgccttctggaagttgtagttcctaccctagttctgcctttatttggctgtggtaatcaaaacaaatcacttaagttcttgaatctcattttgttcttctgttaaatatcacaaaaccaaccaaccaaccaaaacagtgagaatatagctttgttatgcttccatgatttgtggatggtcttcacaggcaacaattaattcatgaggaatgatgcccactgctgtcatgcaacatagtggccctggattttaaggaatccatgtattaatacatgcaacctgaaatcacatatgtaaattgtattatatacttgcatatctatattgttttagagaagaggctaaagctttcttgagaggctttctgtggcatctatatccccaaattcctaaaaatcattaggttcttggcagctcattaagtgattagtaggtctccttatgatgtgttataactcaaaacatcagtaaccatctgaaagaaattaaggtttaggacaggcatggtggtacacacctgtaatcccagcatttggggaggtaaagatggcagtatcgcttgaggccaagagtttaagaacagcctgagcaacacagtgagaccctatctttacaaaaaatttaaaattgttattaaaagaaattaaagtttagtacatgaaagcagctgaaactcagaactgacccttacatcagaaaccatgtggtatcatggaaagaaatctggcaaagaatcaaagattctgggtcctactttactctgctgtgaacccactccatgaatctgggcacatacttgggcccccattagtttgtcattcaaaaagagatgctaagttccagcctgcctctcccaaagcactttttaaaagaatcaaatgtgataatatggatgaaggcactttggcaaaatatgaagtaccctgcaaaagtctgatattaaccatgagatattaaagtatcaagtcatttcactagttgtcaactgagaaaaagggaaaattgcaagttccatcagcaaaatttagaagccttgctttttcattccttcagcaaggtcctacagctgatatttatgcataaattttcttgactttaatgagaattggttgcaaatacaccttacaggattcaaatggagatcatcaccattctaggagctgctaaacagaacatgtggcttcttctctagccaagagttctcctcttttatcacctttattttatgatcagtggttctcaaggaatggtcaagcaccagcagcgtgagcatcttctgggaatatgttagaaatgaaaattctcgagccccatcccagacctactgaatcagaaatcctggaggtggagcccagcaggctgtgttttaacaaacccttaagaggattctgatgccctgcacacttaagtgtgagaaccactgccataagtgattatccttggagagacctactttggtcctgggtactttaaggaaaatcgtggggccccagtaatccaaacgagtacctcatctaagtctctgaagggctgatgttagagcaaaggttgggctagtgaatgtcaatgttagcaaacatggtgggtgtgacccaaaacataatcaaataggcctcttaggttaaagtcctgatgttaggtttgctggttgagaaggaatacaaatgtatctcaaggaatgcagttctctcaagattcagaaagtatggatacctttgccatgcctggcagcttgaaagaaatagcaatgtaaagttaaaccacgcctatgtgaaagttagctccatagcaggctttcttctctgagatttgaatttatggaacatgataacaaatatgaaaatagataatttttattgaatatcatatcactaccactattttaagtgatttgtatgtattaatggctaaccttttttcaggtagttactccaccaagctctttgctgggccctgaaaatgtaacagtgaacaagaaaaaaatctctttcctcaaggaactcacacttcaatgaagggaaattagaagaaattagcctattactgttcaagttcagggtgtttgcagaggcctagatgcggcacctacactcagtcttatgtaaatagaggtttctcaaaggaagaaatgtataaatttagacctctgtagagtgagaggagttgatcactttagagtggagaaacagatttaggataactatactctagatcacacagcaagtaagtgatagtgttgggatttgaactcaggttggtttcatccaaagccattgctttcaaccattaaggcaagggcagaaaatgggttttatcaagcctgtcaattctgacaaattaataatggcttccaagaatgtggatggtgaatactcggtgagcactgggctcaattggaaaaaaaaatgccatgattaattaataatgtcttccctgggttcagagaggagggtgtatgtgtcatgcatttgcctaccctgcagtacagagtactgcctccaggacttagcacgagaggatgaaatctgcggttgtttcttattcatgtaagagtgtctatgacttcaaggaaccttagagctcaatggcatcagcaggggcttattatatgttagcaaaggtagcaagtgacagcccaggatggagcattcagtaaaaaagagaataaagtttcctgtcaaaagagaagacactaattaagtttaacagtgaaaaacaaacaacaaagcaattggtcttactaagagactaaacttcaaaatttgtaagccaatttcattttcatcttttacctctgttagttctatcaacatggacggcgttaatatgacagaatatttgtttggaaataatgggatccatatgtattgagtcagcttcatcacgcccaggggaaacttaaattttaaaatgccacccaaaatatatgcattcaacatgcataatggctcatctgttgaatagttgggaagtgatatcaatcagaaggattaagaagatggctgtttaaggcaatgatgataataaattagtgccagtttgcttcaatatgttttatggcgtcagtaagatggtaggtgagctctttgaagtctcgttgaatatggttgtttctgcagcacatttgttaaacccatatatggattgaaatcatactaatgacaataactgctcctatgactcaaaagggaaacaaatggatactgtcaagttagtcagtgcttggaaatggcttctggatgaatttcctttgcaaaaagtctctttcactttccccagctcaccttcacatttaaccgtaataagcactctttactctagacatttaacagatgtttttaaataactcagttattgggtatataaaaagaagaagatgacctccccaaaagtcccaaggtcagagctatttgccatctgagcaattgtccccaggaagaatgttgtgaatgatcacttctctctaaccgtgactcagcacagcacaccaacctgcacccattttcagaggctcaccttgggttgagggtgactttgagtatatgggcctcagcagtcaccgcccaagggctgtgcctgcttgtcatgcttctctatcaccccacccacctgcagccatcagagaggaccagtttctcactgatcctcctcccctgatgcatttacatgagagatgggggaggagctttcccccttgagacttgttcaccttgttttactttggaagacaagattttacagtaccaggaatcaaaacatttctctgatcacgtcatgctgaccagtgctaaattatctctgattcattgtacattttacaggttatttgaaacctcaacaggggggaaaaaaattgatagtattctgtgtagaagaggctctggccacagaccgaaaaggactttatctttactcatccctaccagattagataatcacgtggaaaactgtaagaaacatcttcaacatacaagaaacatgcatctttagtatcttctgtatgcagattccaacatggagaaagtgttctagagcctaaggtttgaggactccaggtttgagtccatgttaaatggaaggaggaagagaaccatttaaaggtttgcatttaatgcttttaatacattcaggactcagtaacgtctcctgtgcagagctcctgatccattcacggcagcagagacataccaagtcagcacagagaagatgccttggctatacaattcattcatgtgccgcagccctggttggctgctgaatataagtccctagtacatctctattttttttttagcaatattgctgctgaagcttagctgtgtgctctcgtgtgtcccatcctgctctttctgcctcaggtgtgtggtctagttaatcctccattccatgggagaaacatagcccaggaatgctggttgtgaggagatttgatttctactcctacttctgccattaactgtatgactttgggcaaggctctttcctggtcccagcccagccccagctattcagcatccatttaggataggttggtctctaaggagcctttctagccccagcattcaaggacttagtggaaactagaattctgggttcagttgagttcagtgccaccggcatttgccgactgacttcctctttgtcatcaagcaccatacggggcactgcaggggatatgtttatatcagagctctctctgataccacggcactcacgggcaaagggagagtgggatgagaaaaacaagtgtattgatataccagtgcagagcagactatgttgtatgctggaagcaaagtacaaatgattatagggtccaaaggaagcagaaatttcatttatttatgaaaagtcagaataaaacttcatggcatttcagatcagccttgaaagagaaaattcaaacaggatccagtgaagtttctatagcaacatttactgagcaaatattatgtgccagccaatgttctgagcactttgcacacagtaacttatttattcctctcagtcttttgagattaagactctggttatctgattctgtatatgaggaaactgaggcatagactggctaaggaataggcttaggctcatgccacaaacaagcacaagcacaaggattcaaagcttagcgatctggtgcctacgcccgtcacttagtgtggagagtcaactgactgtcacataaacaaggccaccgaacctggagggagggagacctgactctgcagatgagctttgtgtccctgggaaagtcttttcagcctctgaccttcacgtttcttaactctgaaatgcgaatgaaaaatagtttcctcgttgggttatgatgattcagcaaaatggcaggaataagaatagattttaaatgattaaaagttctagatgattttaaataggagagaaaagcagaggagctgattgagcaaatgctgagaggaggtaaagtgtgggacatatttagggcagagtgattattcagtattagggtctcttctccacagtttgagaggttcccacctgaagtcttgttccatctcatctcttccagctatgccaggccttgactctgctctctctatgtggagaatgacaaatctagtctctgtgtgtgtgtgtctgtgtgtgtgtgtgtgtgtgtgtgtgtgtgtgtgtgtgtgtgtatgtgttgtgctgttgaagctgaatgccagcacaattctcatcagcatttgagttcattggcagcatttgaaagaaagtatagacccttagctctcagtgctaatatagacattggcacattagtttcagctgaattaactcatgtaggactgacgctaagggacagttagagtggagtggaaacttctctgcatacagaaataacatctcagcactgtctgtgtagcaagatgtattatcatcatcttattggtactggacaaagcaggatcttcagatggtgcccagcgactatagggactaatgggaaagcagaagggatgcagcgtggttaaatccaaaaaaagagcagcagctcaagagacagtaggaaatacgatggacaagggtcaggagaccaggatttgagccccagcttaggtgattggtcctggaaatgtcatttctataaattagcacaactgataaagatgctctctaaagcaccttcggttctgatagcctaaaaatgcatgagttatttttaagcagaaacttaactacagctattcttagtctctcaactagaagctacatgtgattctgcatttcttattaactgagaggtacaattttccactgcatgttgctcttatctttcttagtggccagataatgttatttataaaacaataacaatatagcctcagataactgcagcaacagaaacaatagtagtcatttacagggccaggaactgtgcaaaaacacgttttacatgcatttgattctcagagcagcaccattgggtgggtactattatttccataatacagatgagcaagcaaaggtttcagagttactaattaacttgcccaagggacgaagcaccgttttgaatctggcttgtccaccatcaaaccctttatccttaaccactcaggtgtctagcccagagtagacacaggcacgtgagcccaagtgttccaggtggcctttcagccccagaaatctcccctcacttgaaaaataatctagaacaatttttttcagaggaatcagtctttcttccccagtcagaatgaagtcactaactccagagtaaaagaatggggcaagcgatgctctctgtaaagtgaattctaatgaggtaaaagtgggcaggtctctactggaggagagaggacagcagcgaggagagtggcatgggaagtggagagagctgcatatgcccccacctccccagttctctgagagatattccacacaggaattcctgacccttgcccagcaattgttcaatgactctgaccatggaaagcatacgagaaaaagtacgccagaaaagttgtatcatggtcggtagaccagagacaacagagaaactggctgcaagtctcagcatcactcagaaagcctttgttcccaaggcactattaagtatcaggcagacagagagattcctgagacacagctcctgtcctcacaggaaggactcactggataagatgggaggcaaacccaggcaggctagcattgatgcaagatgctgagtgccataacaaacgtctaagcagcttgctttaggtgtagtgtgaagggaggatcagacatagttaattctaacacgaggtaggaagtgttaagtgtgctaatagcaatacaagccaagaactatgagagcccagcgaaggatggattaattctgactgggactctcacagaagaggtggtgtctaagtgggaccttgaaggattggaatgagagatagagcagtgatgagattctgctcatcacaggggagttggtgtaaagaggaaagtctatttgcctgtgcttgcttttccgaaggcaggacggctacaagcatggagctgaagttcagactgacctggctttgatttctgtgtctgtcatttctgtgtgcccttgaactttcatattttcctctgtaaatggagattctagtaccttcttcatggcattgtgattgggaacaattacattacaacatgtttagtaatgcaagtgtttaagtacatgttcaataaatgatagtttttattgtctgtgctatgactatttcagtgaacattatctcagtcttctgggtagcatctgaggctaattggccactgttaggcaattttaaaagttaacgaaatgcacctacaacttcatctgcatttgtcctctcttcagatccttgtatatgagcatctttgcctattcttggatcatagtcttgcttttttgtttttgatttgtttgtgggttttttttctatacaatagagcaaattattgattcctttttataatttcctcttcctgttctaaagtcctaccttggatggtccactctttgttgtgtgttcagatccagtagtgagtgcagaaggacagttaccatagtcagcctctcagttagaattctgtcgtgtctacagaccagctttgttcctctcctagtcaccactatgctgctgagaatcatcatagaatatgggaactgcaggcaactgcagccaaatcttttgttttaccaatgagaacctccagcccagggacaggaagaaaattgtcaagtttgtacagagagacaggcaggggtgggcctgtgtactagtcctcaagtgtgctgactcacaggccagtgccctggatggtttgcatgccctttctgcttttcttccgcagacttaggctgtgaggagggcaaaaatgcctttcctcctcctcatttcctcttccctcccccttcctccctgctttgggtaaagctgaaacatgcagctcgtgcttccacaaggcatcctcagcatgcttttcacagcaccctctgctgactccggggccttcacagcttgcagcccagttgacagccagtgaagtgagaagattggaaacactttaaactgtctcagcattgaagaaagtgagaagaaggcaggtgggaaacgtctgtgatgagcgacattgtagagagttaacaaaaactgggagactttcagggtttccttctcctgctcccctgaaaccaaggattataaatactttcaatcttacaggacaactctagctgtgcagtggtgactaggttgaagaggatttggaagcggtacttgggctccgtgtacacacacttgggaacacatgcacacacgcatttatgcatttgcactatgtagtaggcatttctgccttggacttttaaaaacatgcttgccctttaggatcctcatcttggaaatctgccctcttctccctctttaagggattgcccttccctctgaatgtgcagaacatgctgttcttctactgcagaatttatttcattttctcatgcaatttttattagtggctcataagtgtgtctttcatcgcattggaatgaccctcttagaggcaagggtcttgactgttgttttccccatactataccacatacactatgttgaattgataaatttacttattcagtgaatgttttggtattataatagacatgttgcaaggtagtttagcaaagtgataaggactcatgtggaatcagacatacaggggtttgaattgtagctccactattatcagttctgtgacccctgcctacctatgttttagtccctcttttgttaaatggcaataataataaagtacaccctcttaagctgttacagagattaaaagaattgatgaaagtaaaatgtgtagtctattttctagcattaaagtgctcagtatatgcaagcacctattagtaattaatgttagaaataataatgataattatcatcatcatcatcatcatcatcatcatttgttgccactgtggctgtgccaggttctccagatcctcaatgatcccctttcttttcttagatatgtgagggagataagcaaaggaatatattgaagagaaaaagcccaatgtttattactgcgtggctgttgctatgctgtgggcttctatgagctggaggacccaagaaagctactttccctgtggccctcacctattcttggctgtctggatctcagcactatggggatcagaagaggccaccccaaaacaataggaaataaaaaggaatttttgcccaatgctttgaacaaggcaggtccaagcttcccacctcagatcttcagagtgaagtcccctccctcccatgctcaaagcagctctagacctgcacagcaccctcaaagaagcaaatccagcagagattttatggctttagcaccatctggccttatctccttagctgtcttgaaggagacaatagagggtggaggagaagtaatcatcctaaaaccaacaggtggccccagttgtaggctatgtagcagcatggctgtggtggtggtggttgcttggtgtatgtgtggaagtgcaagggaagtctataatgcagtgttctgagtgtgtgcagaacctatggaggaaatcagaacttgagatagagaaacaagtcctgttaatggtaacgccatttggatctggaaataactgtgtttgcatagtccatgtctgttctcttacagatgaggaaacaaaagctcttcatttaaggagagaaatagtccactctcttgtttactcttttacttgacattgattgaacctctcaatggcaaagactgtgttgtgcattagatagatatgctgagaaatgagaaagaggctgtgccctcaaaaatttgtcctaaaaggggaacatctagataatcaatgagctaataaatgattagatacagtgttgtcccttcaaccatctctttggattcaccacattctccacactctctctaaagactcccactcatgcccctggtgagtcaaaagctcctggccagtagcctcttctctgatcaactcatatatttctgctcatatcacctttgctggtggcataccagaatcaagaatcaattctgtttgttttcaaacctgtttatatttctgtgtttttattatacttggacaatttaattaaaatgatgtgaactagtgaaatatgagtgcaaaagaaagtcttttttctgaaactaaatacttttgaaaggctatcggatgaatcactaaaatcattgtaatattaggtatcagagagacgactctaaggttggggaaaagcatggaagaaaatctaaacttatatttattttataagtgccttcaagttcctgatatcaaaatattgatcaatacatgtgcttcacagtgttttaagtttttttggtatattttttaaataatctaattgccatccacgttgcatcagttaagagggcttcaactgtaattaagactttgagtaaagttctgtgaaggatacaaactaaatgttgtgaccgagaacagcaggatgacctgcttaaggtggtccttgcaagataacaagaagccagccaagcaaaagtaggggagaagagttttgggcagtgagaaccgcatcgggggaggtgtggtatgttgcagaagcagcagatgagggaaagggaaatgataaggtttttcaggtcaacagcgcttagacagtgcagattctcaaaggtcatgcaaaggagttgggactttattcaaagcatgatgagaaagcatgaggggcttgaggggatctgtttgacaggatgtgatttccattttcaaaagagcttcctggctgctagatgaaggatggatgagaacggaaaaagggaaagtgggcaaggtggaggcagggatgaattaaagtgacaaaggcaagtgataaagtgcaataagtctacagtgacaggtgagcagtggcagagccctaggccagggtgagaatggagatgtaaagtgggcattgtaaatacatttgtgacatctttagagggacgtgcatccatattttctttagtcaatctgcatgaccaaacttacagctaatttttgaaaggcataggtgatctgatgggggagaaaatcctaccaaaagtcaggcagctgggttttctttttctagtttgatatttattggctgtgctactcagagcaagcaacttaactcttggaagctcatctagaaaaggacaataataatatcctgtgcagcccacctcatatttgggttatgcagtttaaataaatagatggcttacatgtatctaggactttggtaagcttattccttcacttgatcctcacggcgcataaggcagatactatggtcctcacgtcacaggtgagcagaccagtacctgttcaataaaccgttattgaacatctactatgtcagggtcagggacaggccctgagacttttgaaatagattagacccagccctgtcctacagaagttcacagtctgatgaagaagacagatatgaaaatgtgaaattatagaatatcaagatacatgctaagacagaaagtacattagaaccttagaggaggaagaaatgaattttttctggaaggagtgaaaagctttccactggagtcaacatctggctggggtcttgaaggatgtgtagaagttttccaggtatggagggtcatttttgagaaggatatgcaaaagtatgcaggcctggaaggaaatggttcatatgcatctatgtgggtggggcctcaggtgattggcaaactgttaggaatgaggctggagagtgaatcaggggcagggaggctcctgctcatggatctgtgagtgagtgagttatgcaaaagcaggaaaactagtacatttgcttcattttcattctttcctcaaatgcttcccccagtttcatagtatacatgttcctgtgccttatactcccttcttccttgcttactgtttcctccagaattaatttgaatctcagcctttttcctggaactcttaattttagcagggatatacaaagggaacactccaggatagtgagaaatgcctttttttctccaaatgtcttccggaattctgttacttagcaggagttgtttcctgccatgttttgagaaactttgaaaagcgattcaaacgttggtgcaaagggaactaaatacttggtagtgaggagcatcttggcagagaaggcagctgagcttttgctaaagtctcagtggttgaaattgtccaggaggcctgagttttggtccctgggctgggcagcatgtgctcttggttgtcatgcctccattcctccttctggaaaatagtaaagaagaaaatgtataagttagagaggtgaaagagtgttagagctaattaaatctcacttattttacttatgaggaaataactcccaaagaggagaaatgactaagttcatataaagaacctgcagctaacttggtcatttagtcatataaagaacctgcagcttacttggtcatttatgcatttattccattcagcagacatgtttcagtgcctcccatgtgccaggcactgtggtagatgctagaacaatagtgataagtaaataaacatgattcttgccctaatcagggagatgaaattaaacaaataaaccaaaagttaaacaaaataattaaagatagagataaggtatgatggaaagaaacaaggtaccgcaatagagaataaagagtagggaccgggcacggtggctcactcctgtaatcccagcattttgggaggccgaggcgggtggatcacaaggtcaggacatcgagaccatcctggctaacacggtgaaaccccatctctactaaaaatacaaaaaaaattagccagtcgtgatggcaggcacctgtagtcccagctactcgggaggctgaggcaggagaatggcgtgaacccgggaggtggagcttgcagtgagccgagatcgcgccactgcaatccagtctgggcaacagagtgagactccatctcaaaaaaaaaaaagaaaaaaaaaaagagtaggatgagtattttagagaaggcctctatgaagagagaacattttaagctgagatctgaagaatgcgaaggggtcagccacttaaagagggttggaagagctttctaggagataacagcttgtgtaaaacctcaaggcaagaaagtcgggactgtcctgaaaggtaagagaaagaccagcatgaagcccaggcagaggtgtcatggcctggaagcagatgtggtgggagagataggcagggccagaactcagagcctcagagttcaaagtgcccttattggcagactcttgattgatctcacacccctgcggaaaaggaaaggcaagtatacgtgcattgcaagactctattggccgagcatttgtttcaaatgtcgttttcgcagcatgctttgctgagaccatagattacaaaaacagaaataaaaatgattcagcttttcttctgtgtctacccctcaacttaattagtgctcacagctccagaaatcagttgagggcaggggtcaggagtgaattcagatatagatgaagtgggacttagtttctggtgttgccacttggttttaaagatgcagaacttcttatcttccatagctttattttatccttcatttttgtcctttcacttcctcagtggataaatcctagctagaagatgaattttgctgatttagggcaccctcgggctgtcctctgtagctttcagtaaagctttgtcttgattgacagatgctgatcaagttcatgggtatgcattacagtgtacgtttgctggttggcctaggaaaacccatttgcacgtatgactttcataggaaaagaatggcaaataagaaacaaaagattttttttctgccactcacccaaggaacagaaattaagacagccaaaggaagagtctgccttcatttaacggatgatttacctggtgttccttgcggtagtggttcattcatgaaccagcagaaggtattttgtgactatggggattgcggagatgactgggccaggaggggaagctgtaaagctaatctctcccacaacccacttctctttggctaatggctttgcttttgtttgttctgctttggctggttcatgtgctagttcccaaaggctgcacaaaggcagagctaggtagatgtactccctaccagggctctttagtgaatcccacctcctagccccagatgaggctgagtgaacactcactccagccttggactgtagcctttactgtggcccctgaacctaacccaagaatgagacttgttgacccaaggctcagaccccaagtctcagatcccttatttcaaagagagctcctcaccccagctccagactgagcccctggcccagcattcctggctgagtccccacacgtggtagagccttggcctcaaagggtccatccacaatgttgtgagtcccttggtacatattcactttttgaatgaacctctgaggacccctgccctctcaagactggcgtctcctctgccatctcatcagagtggcttttagccatggagcagtgtcatagcctcctctagtccaaagctggccggtgctaagaagaggaagcctggaactcagaacctctgtccttgtgccaacatgttagttgcagtctatctgtgagcttcacagtcccattgactcttgtacagaaatcagcaagcagtggtcttcagtcaaactgggacctcaacaatcgactttggtcctgtcagggttcctttcccttactcttcttaagagcacccagagtcaccatgaaagaaccacaagtggaaaaggaatacgtgggctcagacgtgtgtccatccttgcatgacccttggctcctcatctgttcatgggtttaaaggtcatccttcctgccctgcctaccttattgagtattcacaacagaaaatgaatgtaggagattgaaaattgtataatgcactctaagttattattacctctcccaaattgtcagcatttcatccttgctatctagcagcagaatagtgtagggtaggagtttacaaactacagcccacaggccaaagccagcccaaggccagattttctaaataaagttttattgaaacacagcaatgtaaatatgtaaactcatttgtttacatattgtctttggctgccttcatgctataaaagtagcactgagtagtgcagcagagaccacatggcccgcaaaacctaagatatttactatttggctttttgcagaaaaagtttgcctatacctggcatagaggagcaaagtgaggactctgaagttggaatgcctgtgtttggattctgaatcttctacttaatggctatatgaccttgtgcaagttaattagcttcacttttctctctatgaaataaaaataaacattgtatccccaccctgtgctatcaaattagcattaaatgagtaattcatgtaaggcacttagcttagtatttggcacatagtgagtgctcagtgttggctgttattattatccaaagaatgaaagctctggtttgtgttgatggactctcaggggatggagtagcatggtttatggcacaggccatggagtaggacagaacattatttatatcccagctctgccactcaccacatgaatgactcggagaagattaattaatctccctgaacttcagcttcctcatgcatgaaataggaaaaagaaattaaagagttattgtgaagagtaagtgataaaatgcatgtgaagtgccaagaatagaatttggaacatagtaaacactcaataggtgatataaatacaataataaataagaagaagaatggtacttttctaagtagtactagcttctcagaacaaatagacagttggtagtgactactatgcaaacatcatgtgaggtaggaggttctacttatcattaataatgctctggacaccaggttttgcatattccaggcacatgtaaattaaatacactttaaaatggagttgtttagacagctgtctaggcttttatctaggccaatagtccttcaagaccaggtacctttctgtactaacaatccatgactctatgactgttcttaggtgaagtgataggtcaaggagaacagcatacacgttgagtcactctatggaccatcccggaaagatcctcttctcataataacacgtgggtacacagtgatgctaaggagtttgccatatggggtgaaaatgctctcattttgaacccattcaacatcttcagggttgagttctgtaatgggatgtaaatcttctttcctggggagaaacggctgaggagactgggtgttgtaggtggaatacattaaggctggtggggtttgagtgccagcccaagagcacagctctcattctcagttggcctaagctaacagggagtgatcaagttcagtggactgaagcacaggggagtattacgtatcttccagacctgtggatgctagatgggcaacctaatttagaggaatatgaaacaagtaacagcaccgtgcaattttcgttattccctacctagctctttatgagttattgttcattatattagcagaaaaatgaggatttggagagcctcttccttcaagggagcttacatctcaattgcaggtgaaaaggcataaatacacaaaaagttacttgataatataaaataaaataatcaattcattcagtgcaagacatgtcatgaaagaaagatgggtcaacttagtatccagagattaaaataggtaaatgacttgcattcattcatttattctcatattcattcatgtccaaaaatattgtgtagtcattatgggaacccttcaaagggatatgaataataatataagctttatgagggcaaaggcatcatctgtcttatttaccactctattccacagtgtctagcccatagaggaaagacaaggactgagttagacatagatccttatttaatactcagtgtttagatgtatgtagttcctaacacatttgtggacatttatggagctcctaacatgattttgggctctaatttatgaaatactgcaatcagacatttagtagacatctgttggtttgatatgcccagcatgcatctcctctctgttcacagcaccttaattttcctctggctggtagcttagtaacgtggatagttgttctgcttcccttgacccaggggcggcccatgcccaagcaaggctaatcttgaactgtgtaaacagttatcacaaatggctggagcaatggtgagaccctaaagagactgtccatgaaatgctgacatctagatttctagagctgctgcaatttctgtcttatatgaggcactttttcagctggggcttcctcatatccttccaaaattctgttcttacaaattacagaacctaaactaataaagcatgggtgttagataaaaaattgataagacgcacacatttttatgtacatttaaaagatgggtggagactttcagtttatagctaggagtagggaggtgtaagggtctttatgaaggagatggcatttgagcttaacttttaaagaatggaaaggatctgcaaagatccttaaagaaagaaagcaggaggcaggaggcctgtgcaggctggagcaggggcatgagtgtaggcccagagcctacggccgagaaacaactgaaaaacagccacgtctgtgctggaactcagtgaactcactgagcatcccatgtctgtcgtgccattacacttaagtcagatgttcctgttcccattttctagcttatcctactgagtcacaacaaccttcccctccattgtctctcatccatggactggacttgagctatgggatgttagagaggaaaggtcttgtgagaccagctaggactgaccctcttaggccaaagtgatgctagagccctccaggcacccatgccacacatgaagtgccggataccttagaagagctcagttttactcagagagctatgtgatctctttctcctcacctgcatctctactgctttcctcctttccccctatactgtgtccacatgggccttctgtttctcaagctcttcagtcttgttcctgagcctcattcagagcctctgttccattccttctgcctgagactgcttctttagcctttagcctggctggctccttcttagggttcatttctcagctccaatgctagtgacacagagaggtctccctgaccatcctgtctaaaatagtcctgccagtcactctcacatcatcccgttttattttctttgtaatattcgcagcatccaaaatggccttgtttattcacatgtcatctctctccctctctagagcctaagctccaagagagcagagacttatctttttatccagtgatgtatacccctagcaccagcttgctgcctagcatacactacacattcaggaaacttgttggatgggtgaatgattaggcagaagaaagatggagagaagaaacagaaaatttcaatctgtaggacctcacatccccagtgagtacaaaagttctattacaggtacttcaccaaaacaaaaaaagtttgagaaacactgatttagtttaaactctgttatccagagaggaaaaatgcagcccagagaggagaaggggcttgttcacagacgtgcttctttgcatttacttctccacaatcatgtcaggcacctgaagatttttataagggaagctccagttgatcagtctgtttgccctggccccctgcccttggttacatatgtcagcccacagggtgagtctaaattccaggaccagtgagcccagccctgttctaattcttagcctcgtatgcagtaccacatctcattggctttcaatgcctagtaattaagacccatgcttaataataaatacacaaatatgacctgggaggatggcttttcttccacatctccttttgcagccatcttccaactgggcatcagggcctggatgaagaaagttcttgtgagtctcaaatgaatccaaaaccaaagtgaaatgctacattgacacatgacacaatgacctaacttctccagcccgggcaaggcccttggcaacctagtccccacccatctccaactctgtgccataccccgaccccagtcatactggtgtttctggagtttttctgttgtgcccttctcttttatcttggtgctttggataaagtggtccctctatctagacacaggaacaaggtgcttaacactgtgcccggcctctgctaaaggacccagttaacactgactataatagcagttatgatcatttatcctgtggctgatccctttattactctctcaaatcaccctttattttccttaatgtaaaactcactgaacacttgcttaagctctgtgaaggtagaaaacatgtctgtcttgtgtaattgtggtaccccaattttctggcaatattagtttctggtgccaataaatatctgttgaatttactaaataaatgataacattgtatctagtaaatgacagacaccctggatgtgtctcagaatcctaagtaaatgtgatattgtttaagggctttgggatgatttatatctattatggtaattctttgcatgtcagcattatatctacgatacaagagaatataaaaagggatggacaggcactcttattgtcctctgagtgatggaactgaagcacatcctttgatgttacaacgttagagtaagatgatgaagaatgtgattcccaccaataaggatagaattattccaggaggggaatgagtgcctgaaagtccccccattcacacatacttttgatctccctcccctaaaatgaagctgtcctgtcacctcattatctgctatttacaatgaggctgccacattcccagggacaggagccaaggagaaatgtcggtgtgagaggccttaaatgaagtgacaataaaaaaggagttgttaatgccaggagttccctccctgggagacagctgtcagggccagtacccagggctgggagatttattgatactaagtggatggtgccctaaccaggagtgattatcaaagaggtttgagtgaggtgaggatagaattggacagcccacgccatgcagtgtgtgggttttcctgctctcactggttcctgccctcctgcttccccaagagggaattcctggcctcgttttttacttactctgattgttggacacgctctgctacagagtttcttggaggcagggccctcagaatctgacactctggcagggctccctgaatgctctctctatctctgccaggcctttgctgttgctcttccttctacccatatacagtactctttatgcacatgtaactgtaccaaaacctctctcctggctgattcctccttatctttcagtgtcaaagctggcacttcctcttggaagctttctttgaggtccccaaaggatggggttaggtgtccctgcctgctgaactcatccttaacatagcatgtagactgaattgctattgcctacatagttgtcagtctctcccattgtcaaagtgacaatcccaaagtggttggggatgggctggtttaccactgtatctccattgcctaacatagtgtcttcacaagtgccagatactgggtgtcgaatggtgggtggatggatagatggaccaaagaataggtgtgtatgtgtatagacttcccagggatgagacaggaatacatcaaacataccactcaattttatttgcttatatttcaatagattctaatgtagtaatgcctctttatctggcatcaggggaagacagtgtgctacatgagaggattttccagaaactgaagctgacccatgtcccaagactatttcaaacatccatgacatatcacagacattaaggactcaagctctgtcgtcagactggtagaggtcatctctcaacttgccttgtgctgtttctagacctcacttctccaatttgaaacccacctcagggaatgaaaggagttaatgtagagaaatgtctttggcacagtgtctggcacttggcaggtgttgaagtatcagctcttaattattactatcagaaagcattacaggccagtcacagtggctcacacctgtaatcccagcactttaagaggctgaggtgggaggatcgcttgagaccagcagttcaagaccagcttgcgcaacataatgagatcccaactctacagtttggagctgcagtgagccatgatggcaccactgcactccagcccaggtgacggagccagaccctgtttcagaaaaaaaaaaaaacaaagaagaagaagaggaagaaagagaacaccatattcaagtgctttctaaatggcaaatactgcgtttcatcccagcaacatgatggaagtctgtgcattaacccagtacacacagagttctgattctgaaaaatgccccatctcttctctcctacttgtcatatctgacaatgtagtctccatctctggctccctttctagtctgcctcctttcatctctctactgggtaacttattcacatagcaggttaaaagttgtgtcttaacacttaagactccaaatgcatctattcagaagtcacaaaggtaaatctgttcaggaaagtgagatatgggctgaggcacaactcctgcagagtagtgatctttgcaaagaggtaagaaaagcaggctgcaggcaggagggggacagtgcaggatcccaggattttgttacaagggaatccaagaactcagagacttacctgcttactggatttgaaaaagtgcactgggggttgctagaatttgactaaataactaaaatattgtcgaatcagtaaacattttccaatcaattagactagactctagaatgtcagagtctgaaagggcattaagcattatagagatcaaacaatcatttcacagatgggaaagctgaggcctaggagagcgtgggatttacttaaagtcatacaagtactctgtaatgataaaaccaaaaagagaatcgtccaggtcttctgacagctagcctagtactttgtctacagaaccatgttatctcttctgattgaatattggttgtgacagattcaaagtagatataatacctcacaactactaattatatttatcaacatttaaccaatgactgccttctcccacaggccttgggcctatagggtctgtctgtctgtttctgtctctctctctttcttttacttcctctctctctgctgttgcttaggtttggctgaagtgtagaaatggtctgacagtcaggcactgagcaactctgggagccagggttcactcaagtaaatccaggccaggctacctccaagccatgctcttttagggagtagtgcgtaaatgcaccctcttagccttagaggagaaagcactctgtttaaggtaagagatgtttgcagaaggggaaaatgaggagataatttgaaggggaaaatgtcctggcctcctgtgtgtctaaggatttgttgtgtctgcctgctcccatttcgtccacccccatctcaccctttcctacttcacttctaaagtcctagcaagaaacaccatccatgagggccccagaggcccaactaaatgtgtgaaaccaagtaggtgacatgagggaatagatctggatcataagatttatatcctgtaggataatattttattgcagcaaggggagagaagagatcctaaaaatactgtagagagtatattataatattttaatgaggtttatgtgctccccatatacacttcaccctggatgatggattgtgcattttgacaaatctatatttaacattgggagaataatatgtgatgtatgcttcctggtagagaaatcatatttatggaaatctttattctagttattataatagacatttaaagacagtgcctattgtgggctgtggatagatagagtgtcctcattagggtggaggagaaaatagtgtgagtggcagaggataaatggctaccttagaagacagcaacccaggcaggggagcaactagttcagggtgacccaacagtcacatctctgtttgggttcagctcctcctcagcccctgctgcaggtcatatgccctcatcaagcactcatcattcatttatttatcaaatatttattaagcatctaccatgtcccagacactctgctggcttttgggcacaaagaagcatgtcctaattttcagggaattcacattgactaaaacagccacacatatatacaaataaacaaagaaaattattttagattaattaaagaatgggaaataagacagagtgatgtgatacagactgatgaggggtcactatttagaagaggtgatgaagcaagatctatacagagaggtgagatttgggctgaggcacaactgctacaaaggagtgatgtttgcaaagaggtaagggaagagcattgcaggaaggaggggaacagctggtgcagagtctcccatgcagaatgagcttggagcccagaggaagagagtgaaagccagtgtggctacagcaggcagcaaggagaagacggttgtaagttaggtgaagtcagaggagcaggctattcatgctctgtgtgatggtcagatgttgagacttttcctgtgtgcaatgggaaaactttgagtggatttgcacaaggagaaagaacaatgtgttttgtttgttttgtctttgttgtttaaataagatctctctggcttctgggtagagaagtgattttgtcactgaaaaccaaatgtcctaaagctcaaggccatgaacaccaccttcagataccaggagggctatagagtgggtcaagagcaagaattgtgtgaaaccagaatctcagtaactagaagtatgcaagcagatgttaatgatcacctgccaggtttcctgcagatggtatgctggttttcagtgggagtaggacagatgggttatatggttcagctgcaatctttaagagattatgacctttaaagcccattttctctagggactaacagaaaacggagactcacagtagacaattaggtaccactggttaattgcattctttattgcagcatgggccaaaagattttcaataacatttcaaaagtattcaccaaaaaaaggtcttggaggcaaatagatttgacaaaatctgggataaaaatgggtagaattcctcacaatcttttatgcagctaatgtgaagtatgaaactctaaaacagggacaaagtatgcaccatttcccaaatgtatttgaccaaagaagacttattttttaaggagcatcttgtggggctatagtttcatgaaaccttctgggcaatggtcgcatactgtaatttgagatcccatacacagtggcaatgtggggttctggaaacaggtgatatggtaaaaagagtaaaggatctaagagcattaacttttttatcttaaaagaaaaaaataataatacctaagtcacaaggatgtgatgaggactaaatagcctaatatatgtaaaaggaccacaaagcactctaaaatactgttttcatgacaaggatgaatgactttcctcaccatccaccttggaagggcaatttttaggcattgaagatggccttggggttggtctcactggggcaaagattatgaactctcatcctatatcatatagtaaaacaaagtttaggagctgactgacttggagtttaatcccatgaccttggtcttattagcatcgtattttaattagaagtataatcaaccacaaaccaggattggcaactgcattgggattctacagaatcggtcctgtgggtatgttctcacagctaagctattactatggctgatacactggggggtctgaaaatcagctagcaagatgtacaagcacaaagtgaacattagcagacaaatgaacactgagagttaagggctagactgggaaaatcgacacttgttttcttaaacgtgtattagcagcaatagctggattcttcctgtagcacctttttatgctttgcctttaattgatagacaatgtgaggggaagatcgttagattaagagtcaagaatatctgcccaagtcatatgtcctagctgtgctaccttgaatatgttcattaaatttctgagccttggtttctcccctttaaaaaaatgacccagtcatccctttctagcctcaatagggtcattgtagagaccaagtaaggtaatagatgaaagtgtcttatatacatggctactgtaattaataaccatgacaacttctggcttctaatagatatctaataaaattggatttacacagatgaatgaggcatcgaacaggtgaatgtgtgagtggggtagttagatgggtaggatggatggacagttggatagactggtgtgtcgaaaggatgaatggatggattggtttgttggatgggtagatggatagatgacagttgggtggataattgatgggttggatggatgaactagtggatggattcattttggagtcatctgaccactttttgcagtcttctattcattaatccttctcttctcttgtagtctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggtaagccaagggttaggggagggagacttttgagggatggagagaaaattaccagcagaaaggagaatgatgcctcactgcttccctgaaaaatatgggaaaattatccaaaatgctttatttctgagaaatctgactgatttatcagtagctgacctctaattcagtttggaaacgcattctgagaataattctcttaatgcaccatgtcactctacagctcactaagctttcatggctcctgagtccaaactcaatgcaaaaggacctcagactttggagtcaggcagatctggatctgaaacctaggttctgtcctctccagctgtttgactttggacaaactctctctgcctcaatttcagcacttatataatggggataaaattctctatgccttcattttctcatgtctataatgaggataaaaacaatgtctatcttataaaggttttgtgaaactgaatgagatgactatgaagtgttcagtgcctgcaacatagtaaaaactcaaaattctttctctgttttagatgttatcatcatcatcatcctcctcatcataatcttcatccttctctgggctttctaattcttcctcctttgaatttaacatcacattttccaaatgttttctatactttttcttctctatgtctttactcatgttattccagttttctggaatgcacttcccttctccaatttacatctgtaaatccttctcctcttttgcaggatgtccctattccccaattctgtggatgggagcactctctccaactcccatgatgtttgtcttgtactgtcctaccttctcattgtatattaaatagtcttgtaataatttattcactactggtgtaaacaaataaatgggtcacgcaagacctgaaaggtgagacagaggagtacagtactgatgtggttgcctgcagggagtcttagaaaacttttgagttggagagaggtttgtgaaagtgatttttcaggcagttaggcaggcgtcgttcagatgggaaggagccaacagaagaaaccaggaacaccctattttctttgattttctcttcactgtccccactttgatgacttcccttctcagactgcgactattgcaggggtcacctggaagtctatttcaggacagctttgcagcataatgtagctggaggcctggaagtaataaagccagaaaaatgtacctttgcttgtgggagatcatctctggggtcagcagaagcacccacactctcaaaagagctccacctacctcagaactcagagctcagagccctgccgtttgtcagctgtgtgaccttggactaatgactaaatctctctaagcctcaatttccacactataaaatagggataataatagtatctaccttgaaagattaagtggattaaaaccagtagaacagtgccagacacacagtacattttcagtaaatgttggtctcaaactcaccaaacaacttgcactgaaaaggaaacaaagataggaaggcatagcagaaccaatctgcagatgattcttgaggccagataccatattggtcactgtggaagaggttaactgtgttactgaaagtcagaaatgacatacatacaaaaaattaatccatgcaagatcaaaataatatctgtgaataattaataatgacaccccccccccaagatgttcatgttgcaatctctagaacctgcaaatatgtctatgttacatggcaaaggaaaatgaaggctgcagttgggattaaggttgctaaactattgacctttaatagggtaattatcctggattatgttggggggacacaatgtaatcacaaggtccttaaatgtggaagttggagtcagaagagtcagtgtcagagtggtgcaatgtgagaaagacgaccaccattactggccttgaagatggaaggggccatatgccaagaaatgcaggtagcctctagaagttggaaaggcaagagagtggattcttccctagaacctttagacaccaacacagccctgctgacaccttgattttagcctgggacacctatctcatgcatcttacctcaagaactgtaagatagtacatttgtgttgttttaagccagtaagtgtgtgataacttgttacagcagcagtaggaaactaatacaccatctaattctccaagaagaaacaaagcagcattgagtaatggcctctctactcatttagctatagatcagaagagagtagtttaattcaggacacattttatttatttatttatttagttagttagttagttagttgagacagagtttcactcttgtcacccaggctggagtgcaatggcacgatgtgggctcactgcaacctctgcctcccaggttcaagcaattctcctgcctcagcctaccaggtagctgggattacaggtacctgccaccatgcctggctaatttttgtaattttttttagtagagatggggtttcatcatgtttgccaggctggtctcaaactcctgacctcaggtgatccacccacctcgacctcccaaagtgctgggattacaggcgtgagccactgggcctggcctgccaggacacatattaaacacctactgtgtgagagacaaagtattaggtattaaagatactatattgaacattcacaaatttgatcagcagttattaggtgaccatttagatgctaggttggcacatttaataagcagttactgagtgctgaataaaactaacagctaatatttataaaacccttgcaggtgtcaggctctgctatgtatcaaacattctcacttaatcctcataatgacattatgaggtgagcattatttacaccacactttacctttgaagaaactaaagtttgaagaggctaatgagcctgcacaaggccatttagccatatgttggatttgagcctcagattgttttttaatcactagttctaccatctatgttcagaaacacagtgtctgatctcacagagttcagagttttgcagccagagaaaactagaactgagtttggcagaagagtgggtttgggggtagccaggggaggtaggtgcctgatgggagtgggtggtgcccacaaatcctgactgtcatttctcttctactcatctgaactttaggcttatccgtcctgcagaaagtcctggatacagctgctgagaagaactggcaggtgacagcagtcaacatcttgacaaccacagaggagggataccggatgctctttcaggacctggagaagaaaaaggagcggctggtggtggtggactgtgaatcagaacgcctcaatgctatcttgggccaggtagtgaaagcagcaagggctcagggtgggtgcgggaggtgattcaggaatagccagacacacttttgccttgggtgttataaagagggttataaagagggttcttgactaggtgagactaaaagacctctatctcattttctataattcacaaaatttaattctgaaatagcacaaacaatgggagccttgacatagggcttcaaatggttctcagacctgttaactccaatgtatccctctattgtttaaaaaaaaaatgctggatgcagtggctcaggcctgtaatctcagcactttgggagactgaggcaggcggatcacctgaggtcaggagttcaagaccagcctagccaacatggtgaaaccctgtctccactaaaaaaaaaaaaaaaaaaaaaaaaaaaaaaaaattagcttggtgtcgtggcatgtacccataatcccagctactcaggagggtgagacagtgaggcaggagaatcccttgaacctgggaggtggaggttgcagtgagccaagattgtgctactgcactccagcctaggcaacagagcaagactccatctcgaaaaataataaaaaataataatgataaattacattccattttagagtttatgaaatgttatcatattaggaacacagcttatagggccaaatttctgggttcgactctggactctgtcactcatgatccagggtttggcatctcattcctttcaccttcttaactgttttgaaaggctaaggaagcagcagccacctttatttccattgtttccttgaacatgcccttccctttgagaaatcaattgacagtacattcttctataaacaggcattgtaacttcaacagtcttgagctagatctctctaaactgtgcttcccctggtctcaaaacaaaagcccatgcccaccacagaattaggattttttgtagattccttatctttttaaactacatttatgtattcagattcagagctagcaaggtagcagacgttgcaataacttttgaacaatgtcatacaataaaattgatagttttaggtacttgacaacatgacaaagtttgttaatggccttcaagacccctggggccctcacagagaatcttggtactaggacagctattactcagaggcctcagcaatagaacacagacagagtttgaatgttatggattctttaaggcactaactgttctactttatgaagtacaaatttggccttccctcttggaaagagaaacccagcaaaacttgttccattgagatggaagttctctgggccggagtcagggatttgaattgcagttttcaattcaggcaggataagataatagttaagagcagagataaaaccagactggctagggttcaaatcccagctctagtatttactggctttgtgaccttgaccaggtttttaatctttctacatctcaagttcttgatctgtaaaatgggcatcatcatcataataatagccacttttagagggctcttgtgagaattaaaagaatcaatatatgtgaagcacttagaacagagtctgccccacagtaagtggtacaagcaagcatttgcctatttttgctattcctagtgcctactaggaccagcttcttgagtccctttcttccttgggcataagtgaatccgtctgtaaaatgtgaatgaaggcctctgttctataaaactgataaaaaggcaagataacatagtcgatggaaaaagtgccaaatgataatgacatattaatagacagatgacctattgtatattgttctatggtacagacagtagctattactactatttttttagtgtgtatggtataccagatactatgccaagaccttcccatgcataatcctacttcattcccacatcaactttgtaaaacagcttttttcaattcccctattttatagatgaagaaaagagagattatacttgcccaacatctcacagctagcatatgataaaagcaggaagtcaaacctatcttggtctggccaaagaacctagcttcttaaaaatgcaacttttctgcttctgctatctataattaactcctctctcaaagggcaaacttgcgttttgtaaagaagtgacccgtttgtatgggtattttagattgtagcatattgacattttttaaaattgtttcattcatctattttgaaaagtaagaccaaagagttgaaaggattttacagatcacttgattctttgcttatgcttacattttatagatagaatgactgacggtcaaattgattaagttatttgccttagacaaataatgaatgacagtaatgagcctacaacttatatctctgacttacaatctcacacttagcatcatcctggactatctcacattcagtaactgggaacgtacctgggatacagttacattcagtaactgcatacagtctaacacaaaattttccacctaatctgaggaaaaaaacagtgactcaaaattccaaatagggaattaactgcctgtgtctgtctccagcccccacccaactaaaatctaagctcgacgatgccagggatttttgttttattttcttccctgctgagtccacaatgccttggatagtgcttgacaccaaataaagtattcaatacattcttttcagtgaattaaaagaataaggaatcaatgaagcctctaagaaagttcttaaatgtaagataaatctggatttctatagatagccattggctggataagagcctttaagatggaggaaaaggcatgtcaggaggcccagagggcatgtgagggctgggtttcatactgcagttttgcaggctgagtgatggatgctgagcgtccactggagaggatggcaggaagataaacacacaatcaagaatatccttggaaaccattagaaagagtttagggtttattctgtaaacaatggggagtcagtgaaggtttgtgagcaaggaacaggattattagaatataatactttatcaatatatgatgccaaagcatataaaacagtcattaagcacaaaattagttagaagtgagaatagaccaggacctgttgaggttatccatcacatccccctatgttattgtcttcatggtgcttgtacctgctgaaatcttgttcatttatctatttatatattgaccatctggcaccctactaaaatgttaactcaactcaatgagggcacagagaccttgcctcacttgctcaatgctgtttccccagcacatagcatagtgcttggcatataatttatgttaaataaatgtttgttgaatggattaattagttaatcatagagggttttacagaggagttgagattggagctcagccattaaggatacgaacaatcagagagaatgggagaggccattcagacacaaatattgtgaatgaaggcaatgcattgggaatgagctttgaagtaatgggggtcagtgaggtgatggaccccttgtgaaattgcttcttacatttataacacctttctcagtttgttaccctgtatatatttatccgttcacctatttattatggatctcctctcaatgaagtgtaacctccaagagggcaagcaccatgcttctttcacctttccactgtgttgccaatagtgcttcacccatagcaagctcttaatacatatttgtgaaaggaaggtattagaggagggaaggtcaatgtataggttggggaatagatagatgggaaggttggtatcaggttggatcatatgaaattgccagtttttataagtcaaaagtcatcagttatcagctgtttcctttgtttcaatttgtactttcatcttgtggggacaatatttctccattgcctgaatgtggttggttttaaaatatcatgtctttgctgttttgtgtttattagaagctgaataggttcttgataaaggtgtctcattgttgaaaaggcagcaaaccatttgacaagcagatgaaaaagtaatgaagaattattaataaaactatcatcccaatagtatttgagctccgtggtctggaatttcacaatctaaccactatttcaaagaattcattgtgtgtgcttgcatttaattattccccacataaaaaaacatgagtcactatgcacatacatccaattaagtagatgtctgaatgtggattttaataaccttgaaaatttattcagttagagaagaagcccaagtgcttatcatctgttatatgtctccttgcaacagtgcagggagagagacaccgagcagagtacactaaccccaatttgatgattaaaaaaaatagggaattagatctagttaatctgcaggctgagctagatctaaaaccaaggtctgtagtcttaaccattcattattaggtgtgtctcctgcccaagcaaacttctgggcagttctttccacaaatattttttctacctgtgatgattagggatagtctgcattttgggataaaagggtattcattgacactggttcttaatgattaaccataatcaaacatcaaatggaaaagttcacaggagtcaggtccctgtcctgatactgccaccaggctactatcagatctgggcaaaacattttccctctgtgggtcttgacttcctatctgtacagtgagagtttggaccagatgatcctaactttcccttccagcttctaagttgggcaatccattaatgtctgagtacctaactgattcggggaggaaggcacaaaattcagaaaaagaaagaagagcatctatatatggttcatgcaaggaattgaaggtgaagtcatccacatacccatctgaccattcatccaccatccatctattaactcatctgtttttccaatcagcgaatattgtcatgacagatttcatgcaacataaaattcccacctaaagaagaatctccacatacaaggaaggtttatgaaagaaagaacgcagtgagcatttcagatgggtccttggggttacagtaacaccactctacccttggaatcagacaaaactgatttcaaattctgtatctgccacttagtagctgtaagattacaacttacagaggttatataataggcagtccatgcctattccttatttgtaaaataaggatgctaacaatgccaccatcattggatggttgggatattgtagttctagtacttagggtagggcacattgtaagcactcgatatcagctgccgttattactgttgttgtcgtggctttaactgttagtatgattaatgagtctccacctattatgttttgtagattataaagctagagaagaatggcatcggctaccactacattcttgcaaatctggtgagtagagcactgcaggctctcagctcaagtcctttccaggtttggggccctaccttgcttctgttgtccctggctgatgtgaactgagtgggtggaaggggcaattcagggctgtaataatgagtcttggcaatactacatttttatcttctccacatcccactcatcaaaccacaacacactattcatgaacctctaaccttccttggaagagagcatactggtgggcacggctttatcatcttcacaattccagctttaattggctctgccccttggcaatagggacaaaatcaccacatctttgaattaatgcaagatgtcttgatcttactggtttgggtcctccattttgaccccagtgatagttttacttcttataaatacatttacatcataattacactagtattgacaaaattttaaccagaaacaacttcccagcatgaacaatattatgtccatttagtttatattcacttttctatatggcatagataagtttgttttaaaatatatatatatatatatttgttttaatgtactacagatcattgtattgagtgctactgttttttatattacaaagaaaacaactcatcaaatcattttttgtatatattaaattttacctagtagcacatactattatgagttttcttttgtaaccattatttctgtcaagtctattttttctgggtcatgttttgtacctccaccttttttgtcatgaagtttaattcttctagcttttctatccaaagccaaatgtatttttatttggtgtttagccccatttttaaaggctttattgagacatattttataaagcacacaattcatccatttaaagtgtacaattaaatggttttcaatatattcacaaagttatgaaaccatcaccacagtcttattttaaaattcttcatcactgctaggagaaatcccttacctattagcaatgactccttatcatcccctaagctcctccagccctaggcaaccattaatttactttctatccgtatgtatttgcctgtttggagcatgtcatatatgtgaaatcatacaatatgtggtcatttgtaattgacttctttcacttagcataacattttcaagtttcacccatgttgcagcatgtatcagtacttgattcctttttattgccaaacaatatttcattatgagcatataccacattttctttatccatttttcagttcatgcacatttgggttgttttcactttttgactattatgaataatgctgctataaaatattagtgtacaagattttcactttaatatatacctaggcatggaattactgggttatatgataactctatgtttaacattttgaggaactccaaaattattttccaaagtggctgcatcacccatcaaattttaatcaataacaaatttttccatgtgacagtttgaatgatggcaagtgtctcttaatgataactatttctacagtttattatcctgttctgtctttgcaattttccatgtttccattaagaagtggtttctagctttttatctataacgaattttcaggttttaacttacttaactgaacatataactggcttcagttttaaccatgttattttgtgttgattatctctatgagcaatagtaattgaacaaaggattaatatttgttactcatttctggagtaaagtctgttagtagaaataaggcacagggtgcatgaatctaaaaatgtgaccaaagcatcctgcctaatccataaattctgtccttctttctgacctggtatccagccttagatagatccctgccttactcttctttccccttcttcaactaacttgtcttggcaatatttcggagtgaggacttgaaataagaagggcttagagaagtaggttaatttaggcccagctgttaatggctaaatatattacctttctcagaggtatttgcattttaaatgagggtggctctccagacacttttggggaaccaagagtctcaccctccaaagaccatttgcaaaaatggaatttttgacttcggagtgaggaaagcccttaacatcccttgactcccagatccttagtgctagagcggacttaggaagtcaactccacttaaacctcacttgtttatagggaaacaaccagcaaaggggtgtgacttggccaaggtcacacagtgaggcagcactagagctaggcctgtcaccaagggtagcaggcagtattcaggccttttctataactccaggtcatctctcagtgaaactttgtaggcaccctgctgcttaagaatacacagaacaatacatagaacaagaatacacagaacaagggtggggataggcataattacctctctggggtgagatagaaattgcatgccagtggccttagagacactgaaagaccccaggtaattacattgccagcctccatctgttgccaagtaacccctcagtcacagcatcaccaagtcagcctcttgggttgttgtatccttctgatctgcatttttcttcttctgacctaatgacctctcaaatgcttacaactgccagctaataggatgaaaattgcatataccatccaaataaaaaagacttgcatgtttcgatagattagttgataattaggcttcaaattactaattaattcagtttgaaacatagtcgagtatgtggtgtgttttcttcccccttcagaggaataatgcaattcataagacgataatttttagaatttctgccacataattagcctactgctgcatagaactgacccactccttcggaatgtttgtgattagggtgtaattatagagttagagaccaaggaaggctttgaaagatttaacaaaaggagggagctacacttttattttacagttctttctgtccctgtcggaatgcatgagcttcaaagtagccagcagcattcttttagcagatcacttcggaggaatgcttctggggttcaaatagccacctttgaagggctgccggaagagaggaggggaggagattgtaggttagagaagacaacttataggcaaggagtcaaaacaaaacaaaacaaaacaaaaaaaaacaaacaaacaaaaaaaaaaccttgttttttgtccagatgccccttttagctggctctgtattcttggacaactctccaatcctcagtttcctcatctgtcaattgagaacaataattcctactctacctactcatagtgtcactggggagaccaaatatgttgccaaatgcaccatgctttaaaaagttaaaagtgttctgcacaaatggaaaattcttacttcacatattaaatccgcccatctgtacatattcacatatggtgtgtatgtacatatgcatatatatgcttgcatatatatccatattttataggagagatatgtatgtttatttccatagcattggtgtgggcataagatgaacttgaaccatgcagaaattggaaagctatgccactatctctcacagatgtgcctgggtcctggaacacacaagtgctgagcctggctgccagtggtcctccaaaccctaacactgactgtgcattcactccctgctctgagactgtggggagtgcagacatctggcagccagagtccttcagagttgtagttcttatctttgtgactcaccagaagcaaatcttagaccaaatgagtgtttctcaaaacagaggacctgtggacctctgtagtgtttctgtagagccagtttggaaaatgtggcaccaacaagcgaatgcttcagtgccactgcaattgccaatatgagtacctaaaccatggagtaaatggtcagattgttatattggtatttagaatttcactggaatgaaagcacatattttaaaattctcatagagaactagaagattgggagaatttacacagggttcagcagactcctgtctgaaaaatattgaatttgttggacaacattgaccagtgtgaacaatatggtgccttctagaggagtagtaacaatagtaatatcaacaatctctctcatttttataccatattatagtttatgtgatatttctgtatgaatcatactaccgggttttggatgtcataatactcctatgaagtaaacaaggtggaattcatcatccccattttacagatgtgggaactgaggctgagacattacatgactgagctgcagaggagaaagacaggaacctaattaatggagtttggctgtcaggaatatgacaaaaaccaagagatgtgggcataagaataagatgatcaggctaacctgatgctgagacacttgagtcactgaattagaattccttaaacccctaataaattacaacaataataacaatggcaataacttccacaattgactgattgctacattctagacactatgataaacacttaaatgcatgtcaattaaaccttcccaatagcccttgaggttgatattatcctcagatgaagaaacagagcttcagaaaggttgacttttccacagtcacaaaacatataaagtgatggagctgcacttctcctcaagggccatggaatcccaaaatttgtgttcttattaccgtgccatgtgagtgctgggcagggagagttggggaaagagtcaggaaagagagggggttgtcctggacaagacagcttgagtttaaatcttgtctacagtagcagcaatagatctgacattccaacccaggctctcaaattcccattggacatctgtctcaccatttactccatggtttaggtactcatattggcaatcgcagtggcactgaagcattcacttgttagtgctgcattttccaaactggctctacagacacaccacagaggtccacaggtcctctgttttgagaaacactcatttggtctaagatttgcttctggtgagtcacaaaggtaagaactacaactacattgatggaattttattaaaattattatttctagtgtgacagaagctgaggaagagatgacggagttagcccattccaggtcttatcggggtacttgggaaccaggacagttggccatttctgccatgtgcttgcagattaactcctgtagaatgttagattggaagttttagtctatttggcagctattccaagcccccagccccatgctgctgctcctctgcgggatcagccctgagcagaaactgttctttagtctccttgctcccctgtggtgataaatctgtcagctccttctgcaaagctgagctcatccactttcttcagtgcctctcttcctgttggctccgtacctcacagttatgtttagtttctgcagcttctggttaggcaggtggtatagtagttgggaagggtggctttggagccagttctgggtttgaattctgacttttatacttattagctatgtaacattagtcaatttatctaccttttctgagtttttgttgccttatctttaaaaaagagaatgatattatgtacattcttatagggttttatgagaactaagtgagatccctcaacgctctcggaaatgaaatcacatctacctgttttatgctgccatagccccagatattttttcacttactatacttgagattagataactgattctctattatttcatgtcttcttccctgtttatctacaagctcctagaggaaggattgtgtgtgacttattctctgttgaattcccagggcctggcgaagtgagttgcacataacaggtgtgctttaaaaagtcaatgaatgaatgaatgaatgaatgaataaatgaattcctagaaaataatgtctgcacctacatatcaaatgtacttaaaggcaaaatcttttagcacctatgctagaagaagtagaggtagtaggaatatgaatttagttatgaatatgcaaataagtagttaaagacaggcctaagaggccttctaacccacttcatgtagagagccagaatctcctctacaacgtccccaacagaaactcagccatcaggttcatgcttgaataatacccagtgatggaaaagtcctacctctgagacagccccttttcttctcaaagggctcagacagtttctgcactcttcctggaacagggcacgacctgtgtgctgctcaccctgtgtcactctctcatcacttctgactctaatgccctctggctcttgcaaaacttacctgtgccttcccacaaagcagcctttgagtatttgaaaatggctaccttgcttactctttggtgtttgcaccttcagtctggacacacccctgttcccccagtgccttctctcaggatgtggttcttacagctgtccagacaaccaccaaacatggaccaggcctgtccgtatgcctgatactgcactgggctcatgcaagaaggactaagaagcatgaggctgaactttgtcccagaagcaacctgaccttttcttccagctagattagaacatgtaaaataacattctcaaaagaatgccagagaaaaatcacagcctgtgaaaatatctaagcctcatagatggccacctaccctgtcacagtgtggtgatcagaggccagggaggccgcctcagctgtggggtgtctgggaaggctcgtgaggctgcatctacaaggccagcagtcatgtagagtgtgccctcccccttgtttgaagaatccagcggagtgagagctgaagggtacctatgaaactcatctcacccggcgcctcattttataaaatagacactcaagaatgagagaaaggaggtgatctgtctgaattcacccagaagttaaacagcaaagctgggctaggatttggagtattcacttgctccttctttgtggcttcttttctccaaactgccttttcacaatgtgcccatatgcctctgtgttgagggtggggcaggagcagagacagagacagagacagagagggagctcagaagtgcttcctactccccactgtgcccctctcaaggactctctttgctgatgaagcttattccagtttcctcttcttcctcccacacagccttccctctcccgctctgctctcacctcactgttcggtaacagacactgtgtgatctccagagctgacactgcccagagcctttggaaggaaaaggagagtgggtggatagaaagacaaaccccagatgccaaaggatgctgtcttccaaggtgatccaagcatcccagtctaggttactctttgtattcacccccatcctctgagagaattcaccccagagacctctgagattttctgcctccctccaagaaaagtaagattctggtcccattttataaggagaaaaatgaagttcaagttgttgaaaaaccttttgtaaagtcatttgactaaaactggaattcaaacttaaaacctttcccattctaaggattaggcttgttctccattgggccacactgcccaaactggggaaacctttgcaattcttaggactggtattataattgagcaaagccaagaaataaactcctttcttccttaaactgcctgggtttgaaatctggctcagctacttactagctgtttgtccattgcaagtcacttctcctctttgtacctcagctgtctcacctatgagtgggaatattaatgtggatctcataagataaagataaaatgagttaatgtatgtaaagttttagaacacagagtgcaacagaagcccagggtctcatcctaactctgtcacttactcatgaccatttatgcaaatcatatttttctgtaagatctcaatttgttctagaattggcataatgttttcaaaaggaaaaaaatcagcaaaacaatcttcctgcctgtgtgatttagggttctagttttcctgattgtcttcagttcagaggtatcaaaaaatatctctcatagccacactggctcccttaagcttaaggaagaggctgttctattaatctcaagcacttggtgtgtgtatctttcgatcttgcaaaccatgcacacctaggctgatttggaatggcctttttcatgctgggtcagcatcctttggaccatttcagatatgtaagacagtgactatgattgctctgacagagcatggaaactcactgtcaccagcagccttcaagcaagaggggccccttagcactaattttggcagatggttggtgagctatgtaactagaagagtctggtccttgtttccttacctatccctctttttaagacagaaaaatagagaatacaatgggagggaaatggagctccaggagacacaggattttaggtaaatacttactatgtgccaagcactgttctctaagaatctgacaggtaacatagttaatcctcacaacagctatgagaaataccataataatccttatgttgcagcaaaggttactgaggcactaaaaggttgagtagccctcctgaggttgcacagctaggaggtggtggagctaagatttgaatctaggctgacatgcacaggcagtttctgtgacagagggcagtaaccctctgtggctctgactctgaacctcaatacatgcatattttctgcttggtgttcccagccctcttcacccaaccaaaggcactttttttttttcaggcttcatgcttttgctgcaagaccttccctgagctccaagatcaagtttgggtccactcattttgctctataattacttgtgtaatattggcctttctcactagaccttaggtaacttgaaagcaaggaccacacctgtcttcttctctgctacatttctatgtatagcatgggcctgacagtgttaagcactcatgagtgaatgagtaaatggacaaataaatgatttactacaatatttcttacctggttcccagtagctttcatatttatcatgtttggactttcattcttctttttatcaaacattcaatgggcacctactatatgggaggcctgtgaaggtgtaaaccggcttttcatcaaaagatgggcatgctatgagtatttgcttggccttttctagataggaaggttttgatcatgtaaagggtagatgcaattggttttaagtccactgggaactgtagccataagggcccacctcataccaggaaatttgctcttgctctgaaatggccttggccaggtgtcattcctgaccacaacagttggggcagagtaaagatgaagggactctctggaagaccaactattcccaggccaggtagtacacccatgcagccttgcactcaatagcccaacctggagtccctgaccttctgccagaaagtgccagcattttatcctaaatcccagggctgagagaaattagtttgtgagaccctgactgacatttacaatgctttgtcaatactggatacttgtatgaggtatgtctgttggtgtgtttgcagatatccaagtgtgcctccctggttccaaatgtaactggataagtcaacacgaatgcttttttcttctcaatatttatggtgttttcactgatttaagcacagctacaataccttgtttaattagaggaaaccagactaccctctgtgttaccagagattatatagggagaggacaccttaaaggtttggttggttaaagtggctaaaataggaaaatgtgaagacttttatgcagagacatgggtatttgaggacacaattaagtcttcagcccaggagtattccacaaattcacacatatccatattcatgcgcacatacctgtgtgatcatagaattgtagatcaaagctggaagagcccttaagagagaaatcaagtggctcagaagtttccaaactttttagtttgaggctctattttcaaatggaatcttgggggagaactctcatatataaaacagataaaaagcagagctactatggtggaaaagagagggtgggatttaggaccacatctttctgccttttccctaacctaatatggtaacttctaaaatgcctgcaaccaggaacatagcttataagatcattgatgtagccaaagttcttattttgcagatcaatcaactaatggctatacaggttgagataattgcccaaggacaaacaactcatgagattcaaagacaggatttatgtggttctccctaaaactcttttcctgacacttcttatttatgacctggttcacaatagactacacaaaaaagtcaataagaagacctctttgatccacaagacaaaagctgaggctgagtggtgacaggattgaagcttataaaaaaatcatgagagggtgagaagaaactttctgttccttcattcctccacatgtattgagcatgcaccctgatccaggtactgcttgtggacgctgtgggggccaacgtccctgccctccaggagctcacagtctcacagggaagatgagaagggcccctgcacgttcaaagagaaagctaggagaggcctagagagataggaataaagtgctgtgtggttcacatttcaagtaccagcacacattaaaggagctaagggaaatgccctgatctcatggaagcctgatacttccttcttggtataaaaatgtgtgctgctctgagtgcttcattgcaggacaggacataaatgaatagattggcctcactagtggttgggaggcttgatgtacagtggttagaaaacaagtcctagagtctttttacttgttggtctctgtccctcactagctatactgtactgagcaggagctactccattaacttaagcctcaattttttaaatttctaatttgctaatgggaatgataatagtacccactttacaggattgctatgaggattaaatgagataacacaaataaagtacttagcacagtttctactacacagtacaggtttgatacgtgttaggtacttgtaattattgttttagccaaagtctgccttctatgacatttgccctttcattggctctggcctgcgttccagagcctcagagaacaaatcatccatctcttccccatgacaacccttctgggactcaaatacatccttcacttactttcttggtcttctatacttttttaggctgataattcccacttttaaaaaaatacttctaatataagacttttcaaaccacagtttcctataactactctctcaatggagctgtcatctaagattttatctgacaatttggggaaacttggcatgttcaacctgtgccattcagagtatacagtacaagttctttgatttttctctcaacttacctcctgtggatctcaaggggatgggatggaggaagtgctctttccagtgtcccaggatttgtttaataaaccttacttgcccgtttccttgaacaatgttagatgctccttcttccttctgactggtgtggtgtcagcacaggcaggatgatgagggctgaacagctcgtatgtgaccccttgaaagaatcccagagcaaaggaaatccagctttgaagataaagcctttcatccttcgatagctatgttcctatacacctgcttcatgttctctcaggcttcttgcctgacccagtccctgtatttgaagcagttctaacacctaacctcttttgacccaatgataatgataatggtgaatgtgatgatcataataatagctaacattcattaagcacttactatgtgccagacatggtactaagtgcttagttttattaattcttttaaaccgttcaccaatcctgtgatgtaggtgctatatctgcattttgaagaccagagaactgagcctcagagaggttaagtaaccagtagacacatataatcagttcttttctttccaattgcacgtgataattaatagtcataatgatggcccagagcctcttcaagattcttaaagcattctccaaatcttcacagcaagatgaaagcatgtccaatgtagttgtagtgttaaacacctctttaggatatcataattacttgaaatgccttttcattctaatcctttgaaaattataattggcatatgatagatggagtgactatattaactagtttacttaattgagcgcatttactccccatcattgtactcaaatgccttttcaacattgtgttacctcctacagtggatatacagaggagacagattctgttctcaactaatcctctcaccagccatataaccttaagccactattcccctctttgggcctcagtttccctatctgaacaatatgaggggtttgttttacctcctacagtggatatagagaggagacagattctattctcaaccaatcctctaactggccatataaccttaagccactattcccatctctgggcctcagtttccctatctgtacaatatgaagggtttggtcttctctccaaaatctttgctcctgtataggtcaaaagtcagcaaactatggtccctgtgtcaaatccagccatcacctgattttatatggctcatgagctaagaatgattttttacattttttaattgttgggaaaaaaatcaaaagaatgatattttataatatgtggaactatatgacattaaattaccatgcccaaaaatattgggacagccatgctcttccaattactatatgctaaatagtaatagtaaattactattttctatatatggctactttcatgctgcaatggcagagctgactagttgtgacaagaaccatatggtttgcaaagcctaaaatatttataatctggccctttacataaaaagtttgctgaccccttgcatagatgtggaatagggggacactaataggcttcagataaactagacactttggaagcatctaaagacccttaggaggttagtgtcaaggagaggaacctagcgcagtcccacaaatattcgttcaagaaagacagctacatttgaaggcccctgctctggcagggtgacatattctggctattaactgtgccagccacagtctgaggttcattgtccctctttgtctggagcaatcttgacacaccatcctaaagctaaagtcatatgtttctccactggtggagcagtagaacacatttgtgaagaagacagattttatagttggaccacagtttgaattcttgcttgctgtgtgatctcagggaaatttccaaaggtctcttaaccatagctccttaacagaaaattaggatggatactcactcactcatttatgcaaataagtattgggtgtctactgtgcacatttacctcttggaattgtttaagtaattaaaggattatgtatataaagcatttaacagaatgcctgactcaggaatagagcttggaaaatgtttaaaatacatctcaaacaattattattcttttgtttttaaattacagtaacctcaaaactcttaaaaagctgtttgaataaagttatataatgcatacaaaggggcatttttagccattattgtcatttttgttcttataagcaatgcttctgaagccgttttcagtggagcacttaacagcaccagtgtgctttaatttcaggccaggagataaaaaattaagcagggctctcttaaaagaccataacaaagcttcaacaaatgcaacaacttctctcccctgtcttgccactgctactctgtcccccactttccagtgactaatggatgatatctaagatacattagagctatctgaggatcgatttttattttttaatagtattaaaaatacaatatattcacatgataaaacagatattacagaagggtataaagtaaaagataaatgcccattctttccaattctatacttcatagaagtaactattttaaacccttttcctgcatttggttatttaatggtttcctttacacttctacatcatatatttatgtttctttttcttgctttatcaactttaactccatatctgacttcccattagaaagatgacaaatcagctcatattacacccccaacatccccttctcaatgtttgttagcctatatgctattatttggaattcttctgatgattaccttgtattttttacatagtgaaccttgatttttgattcaccagcattagagctttgtcaaaatacagatatccagtttcctctttagggctactgaatgataatccttggggatggttattttgcaaaagtgcctcaaggtattctgatacgtccctcagaaccactttctgagagcttacagtttattggtcaatttctttgcatttaataatgacagtagacacagcattctttctcaccgatttattagtcacacatggggcaatgtgaaatgctacataggtgcagaagaagcagacaagaacacagtgacctaatagccctaggaactcactcatcaccaagcttcactttaggtgagaaacagtcactcaaagagaagcatctggtaccagtgctgggaggtcagtggaaggagagtgggtttagacctgcattcttgtgctgaatagctggaaaaacacttgactaacctgaaaaacaagtactctgtagattaatttcattttttttttgtcagtagtaacagtatatagagcaatggtcccagcatttgggaacatgttgtaaataggcaaagtggctcaaagagagtagtaatcaaacttcgtagttaaaatttttaatagaatataattagcaatgtagtatttttatataatactatataattaatagcacaaataaagcacataaagaaaaatgttctaattaccaaatattaccctctaaggttttttttaataaaatggcaaagaaaattagaaaattatttaattaaaccttatttaatgagagttcccaggggaacagaatgagtgaattgaattttcccataaaccagtgggcaaagagttaacacctttatttcccccttcttagtcaagaacacagttgtgcaggttcattttcttgaattatggagaaatttagtctagtaactataatagagtcatttcttagtgattaaaagcattgtagagatgcaagattattattcccagcatgaaatctgaaataggagggaagatgtcagctattagatgagaatatagttcatgaccacaagttatttcctaattttgtttcttttacttaacatcatagctatgagcttgttttatcattctctgtccattttttcttaggaggggatgggggttcagttggggagtcttattagtttgatcataagtaattaaggtttggctgcactaaccttgttgtcagacattctggtgacaagattgagtggcatttatgttgagcagttgaggaaactcggccatttcctttggcctccattatgtctgagatggaagcagtcagtatgaaatgcccaggaccttgttacagattttcaagagacagaatttgactgcaggagatactttccatttcaatctcccagtagttactttatgaacatgttctttttaaagtctctaagaactatgagaaatctttcaactgtgctctagcttttaaccagtgctggggtaagtgctctcttagatggtataacgtcttggaatgcatattgggtacaggaacctagttctgatttcacctttactaatggcttgctagaaccattgtgcaaatcagctacatctgtgaaactgtaaactgtggctgtggaacacgttaaactcaaaaggtattttcaacctgaatttctcttttcaaccaattacaatcacccactggtatttgctgcctgctggtcatatttctcctggataattggctttctttcttgaggaaagtctctggcttttatttgttcactcaacaaatatatactgtgcacctactctgtgccaagcattgctctaggagcaggttctaggacacatcagtgaccaagacaaaaaaggttcctgctcttaggaaactgacatttcaataggaggaaagaggctatgggaacacatgagtaaacaagataatctcaaatggtgataaaaactctggagaagctctaacagggcactgagatagagcagactggatagggtgctgggggtaactctactatgttcttccagaagcagttccctgaaacaaggattcaagtacaaggggcttcttgggtgccaatcctaaaaaaccagggaagggaggcagagaagggaagtctgcctacaaagtttcataaacaagatgcctacactgcaggctactgaaggagaacagtccctgaggggatcccaacatgtcagtgtagaactcacctcagggtcatgccatgcaggggagaggattctggggcacttatctactgactcttcatctgtcattgattgaaagctgcttctgggcatattaactccttaacatgtctaacttagcctgcaggtaggcggagtagccaggtgtttgcagttggtacgtaaagtagaatacccatgtagaaaggggagtggaagcgaacaggatgctgagattgtctacaacagggcaagaactagttctttagataagaagtcaggaaacacctctctgagagatggcagtctagctgagatccaaaaaatggaaaggagccagacagggaaatcacatttccaggcagagagaatatcaaggacaaaagctctgagtgtgactaagcttgctttgtttataaaaatagaaacaataaaaaatcgcagaactttagaggcataggggtgggggagggttgtttttgaatcataaagtctattcttttagatagaaaaatcagagaaagccaatgagaaattcagaaacatagacggtatcctaggatcccaagagggagctgggaccgctgctctaattccttggctcccagttcagaacttctccatcgaccatggatcccctgctcattttcccatttcattcattggaatttggtggtttcccccaagccatggagctgaaagggaattgcctgtatgatcccactcaaattccttgggcagttttccaagatacgatcaatggcatatgagtggaagatctgcatgtgacttctgaaaaaagttcttcatgaagaagttgtgcattccattttttttcttcctgctgggcaggcccccaattatacctaaaagaaacccaagttaacacaaggctctatgtgaccagctttgggctgccaatttgacctcctttcccaccctttctcttcaaactcactgtgccacaatcacaccagcctccttactgtttcttgaatatgccaatcatcctctcacctctgggcctttgctcagaatgctcttctccaaatatccccatagctcagacacaggcatcacttcactcaggtccctaagccaagaccacctccttgcggaggctcatcctcatcactccttccaaagcatgacactgcccctccccatcctcttacctcactttatccttcatggggctcattgctaccgcagagtatactatcccagattatactatactatgctgcatatttacttgttcatttattgtctgtcttccccactagaatataagctccataagggaagaaacttgctttattcactattagaatagtgcactatgacttttcaaaaatgtttgttgaaatgattaatcagtgaataagtgagtgagtgactgagtgaaccaatgcctaacagaggcccttagttctggtgctctctctgttactaactccctaaatgacgcctctgcaagttgattcttctactctgcctcagtttctttatctggcaaatagacatataatgtttaccttaaaaaaggataaactgaaatgaggccatagatatgaaagtactgcacattattgaatatattatacaaatgtaagatttccttttacagtcgaagccttcttgagttttagtaaacttcaccaaatggggtggaaagtgtcattataataaacaatccttcatggttgctggaattgatcaggcctcatggagtggtgaaaatttaccctgttgtatggaaaagagcacagggtgaggatggagactgggatcagaactcggcctcttccacagacttgctggtgtccttgggtaactcataggagcttgcccagtgaaattcagattcctcttctctcaaaatggttgggtattgggatggtagacgagattattccctccttagaggtttctaccttgtactatatatctgcatcatcataataatcacagccactatttattgatcacttggtctgccccatgcacttgacatgtgtcattgcattgtatgtttaccccaacaaccagacctccattattcagacaagaaaactgtcaagtaacttagttaatagtggtataactactggcttatgcatagcagcgccagcactccaaactaggcatactggctcctgagctgtgctaattttgtgcacaaactaagtaataatcaagttcaaaggaaaggaggcctaactgtctctccattgagtaggtttcatctggtggaactgaatggaaaatcctgtggttttggaacaggttaagttgatttatccaggcagcatgttctaacttctccctcctccccctctcacagggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaaggtgagtggatgggcagccagcagcaaagggccagcctggtccctttgcctgccccagatttctgagctgcattagtctttacaaaggaatcagttttctaaagcaaacaaattcagggaaatatatttgtaaagattattaggtacaaggtgcaggggtcagacaacccaaaatgacatggttttaaggagggagacattttatttatctctcctgtgaacaaaacttaggagtcagcagtcccagacttgtaaaatggctccacagttatcaaatacccaggcttcttgtaccttcttgctctgctgtcatccacatacggctgctgcctaatagtacaagagggctgcttaaactacagccattgcctcagcattctacccagtaggaagaaaaaaaaacatgcaatgcacaacttcttcatgaagaactgttttcagaagtcacaagcagatcttccattcatatgctattgatcgtatcttggaaaactacccccagttggctgcaagggaagctggaaaatggtggttctattctgggcagagccaccatgttgcccagctcaggaggatgctcatttcattgtagattgagcttctttgtgtagtgaggtggcccttattctgctcagccatgtgcccagctaaaaatcagggcaacctaactaaggaatatccagcagatctctacctgggagagtccactctcagtaatcaggcagactctctgcttctcacttcccagcaacacagctctaaatactgccaccaaaatctattttgtttgttatttgagaatgcttgggaataaggatagcgaatgattctttttctgaagtcaaaccagatagcttgacagtggccatatggaaccctgtgttgagaaggatactaaggccaagtttgtttatctggacaaacagtgaatctttgacagactttctcttgccactcaatccatttctttttataaatggcaaaccgtataacggagatacttcttatcccactattcaaactgatttaactcttcaataatgaagacttatttcaatatgatcttaagcaaacaaaatcgcaaatatgctttcaagcaatgagaaaactacataggaattaattaagtaatgtgcaatgattgcactccaatttccaaaagactgagcagatgacaaaaataaccaaatgtaatttaattttttttttttttttgagatggagtctggctctgttgcccaggctggagtgcagtggcatgatctcggctcactgcaagctccacctcccgagttcacgccattctcctgcctcagcctcccaagtagctgggactacaggcacccgccaccacgtctggctaattttttgtattttttagtagagatggggtttcaccgtgttagccaggatggtcttgatctcctgaccttgtgatccacccatctcagcctcccaaagtgctgggattacaggcgtgagccactgcgcccggcatgtaatttaactttttaaaaaagaagtgagagaattaaatttaaaaaattagaaaaatacccattcattcgttcttcaattctctattgtgaacttggagtgtgctaggcaacataataagtattaggaacaaattagtgaagaaaacagacataggttccaaagccaggatatattttcctggactgctctcctgattttgtttcatccacatcctagtcccctttttgtcaggagagggtataattgatagttgttgtgagaaagaatgaggggaaagtttacaggatataaacttaccacttaggtaagccatatgtggaaaaaattaggagctcacccttctttcattttctttttgcttttacttttacaagagatgaaagagttaatcgttcctcttggtttccagctgatgactgtaatgccgggataaaccagctgatttttcatgaactgtatccagcctgcagatgtgttatatgtaatctatgcattttttcccaaatgaaccaacattttaaaaattgcaagattgcacacagaaacctagaatcctggcttctcttcaaaaattataactggcagtactgaactcacagttcaaggaggtcagcattgactagcatggtcaagcagcagcacccatctgcttgaatatttatgcttctcagggacaccatccctgattcaccactgtctgccccacgtataccatgcatctggcccactgcacacccttctcatcaccagaaaacacattcccaaatacagcacccaaacctgccttcctgtcagctctctttgatacctaactgtctccattcctcccactagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtaagaccaccaatgtttgccccatctcataggagcctactgggggatttcagcatcaaattccaataaaacacagctattctaaagaaaaggaagaaaatgcctgaagttcagaacaaccactgcattgttggtgttggtggttcttagcatacattgaagctcatataaaaaaaaaatgatatggaacagtcatttcttgtagtgtaaaagctgtattttctccttagcaattttgctgaaaaaggagagctggtgattttctgtgtatgggaaagggacttgaaatacacaaggatgaaactgaaccatgttaatggtctcctggaaacactcccctcttgccctgattttctggatttcttcctttgctctctgcacacattgtatgagagcctggggtatgtggaccctaaaaatgtttctcagtacttctgatactaccttcttgcttctcagcatttcattcatcaattatgtttgcacttaagaatagttaaagggcagggatagaaaatggccacgccaactccaatcaattggctatacaaaagcttctgaggctgaatccagatacaacagagagaagcataaatattcaattagtgatatgtctgctgtggaagcagcatgagacagtggtacatgtgggtgtatatttaacatgcctggtttagaagattttggggacttgccctcagctttattgctcttggggctcctgtagatctctaaagcacctcaagcccaggctatgattctcaaactgccaaggaatagcactatatttttgttctgatgcctcctgctagagaagctgtatttccgaagggacagggagaggatggccgtgcttgctgcaaaggaataacaaagcattggccacaatgacaaaccagcacagcaagattatttggcacaaatgtccctcaggacccaccctccccaacaaatggagttgcctgcctaagaccagctttacttttaagacgacattcagcagaagatgaatttgggctccttggggagaagaggagcatttctgaatgagagagaaatgtacagcaaaatgtacaactattcccacttgtttgccaaccacacgtgcacagctctagcaactttcacaaccaggagaaagagatgctgaaggaacctcaccagctgttcctcagccctgatgagtgcctttctgtagagaagaatatgtaggtctgtcctttgaaatgaagctaagcaggatttctactagctacatgaggaacatgctaaggaggacctccagctgccatttctgccctcccctggtccctgtgcagggtggctcccaagtcactaggcagcaacaacagacaccaggcagcttgcaggggaaaattgccaaatggacagtgcctgcgcctccctttctacccccaccccagcttatttaaaatgctcttccagactccacagtcgagacagattctgtttgcaatgtgaggctggtttcaaaaggtcccagagatttgtcctcagcttcacaacccttccaactcccttgcctctcccatcttaatgacgtcctgaaaggatagtctgatgccaccatgacagtgatgaagcctgggaggcagttcagggtggcaggaaggactctgtactgggaggcaggagagctggactccacgtccagctgggcccctggctctctggatgaccttgaaacattcacttagctctcctgctgccttccctttccttccccatgaaaatgaagggggtggagagaggacctcaagtctcaactggctctgaaaattcaaacagtctaattttttttcttatggtctaacccatgtccttctggttgtagtgtatacttagcacactgcttctgccctcagtagggtttgaaaggaagcagtttccatagtcaaaagaacaatgacctcttttattttgtcttggagccaagatatgtgtgtgcctgcccttcatcagctgttctttgaggatctatggtgtgccctggcttggagccaagcactgaggacaataaaagaaagcaaggcctgcgctcaaggaactcctggcagtgtctatggagaaaaagagaggaacaactatcccaaataaataaataaataaacaaacaaacaaacaaaccagaacattctgaccttaagatcagaggttcaaatcgattcattttccaatctttgttaagcacctagaatgaaaaagattttgttgaaagacaccttagagattactgactcttcttttccctcactttataatgaaacagcaaatccagagtgggcagtgactcacccagggtcacacagcagcttagtggcggaggctggaccagatcccagtccagggctcctcttcccccagttaggtctgtgctatgggcccaggggcccttgcttataagcattgacctctggagccttccatccatagtcaggactactcttcagcaatggctttttctagacccatctcttgaaatagccatgccaccagggagctgggtaaatcctgatggtatccagtcttagaaacctgaggcttggaggctcaggtctctactgccttcacctctggccttcaggtcacatagtgggagagaacctgtggtttagcttgtgttagacctgggttgtctataagttaggccaagaggtccagcacagcctacctggagggcaagcatgctagggagttaaattctgaaaataatatgtatggtgtgttaaaggcttagtatacacaaagctctaaacatttacacatattatatcattggatctttgatataacaccttgaggtaggtagttttattaaccgtggtttgtaaatggagaagccgagcttcagacaggttataaaacttcccaaagttatacagctagctagtggtaaagttgggactccaaaccacatttagatgatgcctccctctgtatgcttcactgctctgaaacctcaagggcacggccaaacagggaagacacaagagctatggcccagcccccagcagcacatggccttgggtaatatctgtgcaccccctcccccttcactccgctgtaatttccctagcagcagaatgaagataatcagctgcctgcctgccccctgcttgccatctagggagtcattcagaatattaatgaacccacatcctggaggccctcagcactccaggaaggatgctcatatgtcgccttctggacggtggagaagactcaactccccaagtcgggttcttaacataggggaggtaataggcatttgagaatatgattttttaaaagaaatctgtagattcttttgcttagaaaaatgcatatgtgtacatacataatttctgcatgaccaggagtagagagaacatacatactcctagaatccatcccagggcctcaaatttagaatacctcccctaaatagtaatcatccctcttggtctttgtttttgcaacctgccagccaacaatcaagcatatggaagtgaaggtatgctcagaactttgctagatggggtctggggttgggtgggcaatggagtttaagacgcagtcctgcctttaagggctaacacaggtgggcttatggtgctgtggatgatcagagcagaatgccatcactgaggaatgcagacatcagcaaggctttctgtaggaatgtgactggcctttcaataggatgaccactttattatccaaaatctatcatccaaacgggaacacttaggagtgaaaggaaaaactactatcaattattccagaacaagagtaccagaactctcctgcgttagtccatgtgcattgttataaagaaatacctgaaactggataatgtataaagaaaaaggtttcattttagctaatagttttgtaggctgcacacgaagtacactgccagcatctatttttggtgagggcctcaggaagcttccaatcatggcagagtgtaaaggaagagacagtatgtcacgtagtaagagaaggagcgtgatagataagggaggaagtgacaggctcttttacacaaccagctctcatgagaactgagtaagaacttattcattaccatggggagggcgccaagccattcaggaaagttccgcccccatgatgcaaaaacctcccaccaggcaccacctccaacgtccagggtcatattttaacatgagacttggaagggacaaatatccaaactatatcacgtcccaggcaaactgagatgggtggtaatggaaccgttaaatgtatggtaaatttgaacatggagtaaattgggttttggaggttctggatggggatgtcaatgatacccagcaagagacgaggtagggtgagggtacaagaaaggacttgcacatgtcacattggcctgttaaggaattagggatagaagagctgggttccaaccgtggctccacgcagaactatctgggggatcttggactaattgcttgccttttccagatctggatttttcctgtctgctaaacagacataatcctcctagtgctgcctccctgactggcttgtcacagggctcagaattttaagaaagcatcgtgcttgtgggccaagcatcgtggttcatacctgtaatcccagcactttgggaggctgaggtgggcagatcacgaggtaaggagtttgagaccaacctggccaacatagtgaaaccctgtctctactaaaaatacaaaaagttagcgggatgtgtagcaggcacctgtaattccagctacctgggaggctgagacaggagaatcacttgaacgcaggaggcagaggttacagtgagccgaggttgtgccactgcataccacaccagcctgggtgacagtgtgagactatgtcaaaaaaaaaaaaagcatcatgcatgtgtttctttgaacttcagggaagctgcatgagacagtcagagccaagattattcttcccatgactcaggtaggaaagtgaagcttaggagggttctgagatttgctctggccagagtacctagaatgtgacccagcaaggacctagtctacaggcctcacagccagtgagcatccaggaggaaggatccacctgagggcaactgcaagggggatacaggagccctgcgtccagtttgactgctcggctgtctccttcaggactgcctttcaggatccaatgagggcaggggagagcagtcactgttgacacctgacaaagattctttgcttgaccaaactttagtcaggcttctgaaccttctcctaggcccatctgtgcaattcttgtgaaatccagttttggcaaagaacttgctaagtcggtttagcaagaaccctgtccaccacgtccaccctctttgccatgatcatcttcttcagcccccaccatcccccagattatgtcggatcatcctcgtccatcttcagcaagaatcctcttaggccattttagccagaattcctcttaaccccgatgcttgctgttagcaatttcctatccactgacccccaccctgctccttggctatatattcccacgggcccatgctctattcagagttgagcccaatctctctccacctctgcaagacccattgcaggggtctctatacctattgctacgattctgaataaagtcttcttcactgtgctttaacaagtgtgctgattaattttttctttaacacagctgaagtaatagagacattaacccgcattctctcagcaccaagcaggaaaggaaatatatgcttcagcctcccatcagcagcagactctgagctggcacccagtaccctttacaggaagcccaaggttaattctccatctttcatggagggagttgagggcgccaggatggcgacagaagttccgggagcaggaaccaagaagaagtgcctgggctccatcaatctgacctcagacaccctgggatggggggagagagggataagtgcccagatcccagagctcagacctgatggatggggacagtggtttcaagatacacatttctgagaagcttcttcctctgtctctgagtcctgactctccttgataaatggtttggggctgagccattctcttgaactctccttgctctgccatcatggaatggtgtttctgggatgtctctttcgcattctctgatactttgttttatctcagtgcaagtaagacttggcttccccaactagatactaagagccttcagttacccttgacctctcaatgacttactgtgaatcctggagtcaagcgccatcagctctgagtctcaataatctcatctgtgaaacaggcaaaataacgtctgctctggctactcactgggtttctgtgaacatgaaataagcagcttcttgtgagatcaccgtgacagtgcaaggggtccttgggtcactagaactgtgcaggtaggacccttgaccttattggaaactgaggaaggcagtaaaagtgtcagtgacatgatccttctttcttctgaaagagtccccttgtcttagacaacctaccagccccaaggcctcaattttagattttatttttcataacttttacccactctacacagcacagtagtagtagtcgtcattatcatcattattatcatctaaataatataaactatgcattgaaaacttatgtcccagacaatgtgctaagtacttcttggaggaggaaactaagaagcagatagtttgagcaaggaacctatggtcatacagttagaatgagcagagcacaacctgggaaatgcccagcagcaatagcagaaagcaggtagaaaacactacattgcacatttttgtgttgtcctcctgaagcctagcacaatagcactggcctgtgtttcggcgaacacttggtaccttaagtgaagataccagaagttaccagaagctccagattttagacctgcctctgccactggttagtcataagacttgagcagatcactttacttcccagaatttggcatctcccatgtaaataaagatcataatctctaaatggcatacttcagggggttcctgtgactagagatgaaataatatgtgtgcaagtgtgtcataaacatgaagtttttagaaagtaatattagtattaagtatcaccattaacaacaataataataacagctggcattttttgaatactcatcatgcaccaagcattgatcaaaaaatatctcttttaatccttagaacaaccttaagacatagttaactctaattggttccattaaacaaatgagaaacttagtcatagagagattatgtactctgccatactaatatgccatgctgattattagtatgaaaattgagactggggctgaaaagtagatgcctgtttggataattaatgacactttcagtttgggcaaatcagtctaccagtctaccatctgcacatctatccaagtctgtttctttggaatgagtcacttacatggtacccaccaaactaacactatcttgaactggaaataagggaacactaaagattggcaagagattactgaggtgataagaaggtgaagctgctgatggactggaattgctcctttcttttattctttgtagtagaatctgtactttgttttctctctgaaaagcaaagatagcccagacatttatggagctggggatttctcctgatttcatctaagaaagtaaagagcatgttgtaaaatttgctcagtgctctgggcctgttgtgacctcctcactgagacttcaaaccagaaggtgacaagagggtcaacctcgaaacaggaacacacacacatgcacacacacacgcattctctctctcactctcaaacacacacaacccccaactcttcttatacgttctaacaacagaggagctagccactgtcagaaaaaaatataaaactctgcaaagcttccttttaagccatttgaaggagggaaataaacagtgctgggtcacagggttggatttgtatttgtaacaagtagacacctcacctcactggccttaggcaagagggatctgaggacacatggtggatcactattagggaatgtggttgcttgtacctgagctgatgatacacagctagactcagactcagtttgagagtggtcttggatgacatttatcagtcacctacagagcagcaagctcaaccttaaatatcttggatctccatggtcaccatttgacttttgatatgaatttgaagatagaaggccatgaaagtttgattttgcccatttgtggagaagtctcacgcggcatatttgagggttccaatacaattttattttagccaactgagatttctttaacaccttgcattctcttatctgaacacaatgggttctccctaggtgctttgaagttttcacaccactttcacattagcagttatcatttaagataaaaaaagggcagagatttttggaaactgaaggcttagagagctaaattgcctgagggcacttggctattaaggattaagctggggttaaatccaagtctttcaattgccaagtattttattccctggactcaggaataaagaagaaattcttaaaggaattaagaagccatctccaagcatagcttaaggcttcattcataaagctggcttcttgtcctgggtcttctgactcattagtgatggtgcaccattttctttcctttgcaggccccccatactttcttcatcttcagatgtgtatctgagaagggcagtggtcatagtggttgtgtgatgggaggtgtttggttagggatggtgcagacatttcacattagtatgcactctgacccattgttagtatttgcctaaagaaataggtaaaaacaattgtcaggatgaatcccaatttagggaaaagagatctgtaatgcatcccttgcctgtggcaagggagtgaagagttttagcattcaggatactccaagacatcattccatggaacactcttgggttctgaatttctacttcagtggaaaaagcaaacacacataaagtacatctgagttcactgcccaccacttggttttgttttccaggtgcgatttgaaggtttaacaggaaacgtgcagtttaatgagaaaggacgccggaccaactacacgctccacgtgattgaaatgaaacatgacggcatccgaaaggtaaggtccccctttacttctgttctgcagagagaagaggctgagcagggactctggccagagctgagggcctgtgagtccaccttttctggactggatctttgaagaaactcagacaacacagattctagacttggctctgccactaaccagctgggacattgggcaagtctcgttcttcctctgagaatccattcattcatttgcaaaattaagtttaaaaaaatctctacatttgtcccaggatgcttgtgaaaatccaaggtagaggaaagcacttctaaaacataaagtaattgatgtgtataaaatgccactcccattcctgagggtttctaaactaagaacttgagaatgatgattattgatgaggttaactatctcttcctaatcgatagttggtcatatccactctattatttatacaaaagtaagggtgaaaatatatatgtttacatatatgtataatgtataatatgtttgcatatgaaaattcttagaatagcattcaaatccttggaataacatttcgaattctaccagaacctatgtgcccgggcctctgccgatttcttcacccttaacccttgatacttccttcatctctccactccagtcattctgtttgtctttcacctccctgaatacaccatgttctttctcatcattgagccttcatacatgtttcctctgcctgggacttcctccccccatctccctcctcttgcctgccaatccctcctcagccttccacactcaaagtaaatgtcattccccagcgaagccttctctggcctttcttattatgcttcatggaagcctctacttctctgctcatggccttcatcacattgctaattccatttggtggcgtagcataatgactgggaggcattgtacagcatggcgtagagctggtagggtgccatggatcagaatgctggctctggaatcctcaacactgaatcctggcttcaccacttactagtctggggttccggataatttatttgagctctttgttccttaattctcttatctagtaagtggggatcaccttaaccatgccaacctcatagggtcattgagaggattaaatgatctaagagtgtgcagaagttctaagtactggaactggcccattgaaagttgggtcttaatctctcagacttaatgctctctatgcctgtgctgtcagataaccttgccactagccgtatgtggctgtttaggttgaattttaaataaattcccatttaaaaatcagttcttcagttgcactatctacatgtcaagtgctcagtagccacatgtggctagtggctaccacatcaggcagcacagatgtagaacatttacatcactgcagaaagttctactttaaagttctctttgtccactctccgtcctcacctcccttaaacctgtcttctctgctcttatgtctagaaccgcatcttctacctcacagccaatcttatctcattcattaaggctatgtcagttgtctattgctgctgtacaaattaccacaaacagtgacttaaaacaacacagatttatcatctcacaattctgtaggtcagaagtctgacttgagtttcactggactaaaatcaaagtgttggcaaggtcatgtttcttcctggaggctccagagttaagtttgtttctttgccttttccagtttcttaaaggccacctatattccttggctcccatgttaccaagctttctccatattcaaaaccagcaatgttacctctctctgacccttcttctatcatcacatcttctcgctaaccacagccttccagagcccatctcccatctctgactgggagatctcctccttcaggaatcagctacagtaacctgccttgacttacagcaggtaccaaataagggcaccctatttggctatgaatgtagccactgggaacgtatccacttcttcagcaaacttttggcatgttgattgtacacagacactctttctgggctcaaaaacccttgagaatgacatttatccagaaatagtccaagtctgagttcatttttgttgtcccatggtcttctgatttttgctgctggagaagacatttgctaggtcacttagctcttataactttcaatttccacatctgtaaaacgggcacagatcatgtctgcattagcgcctgatcactgttcagtgaatgttacctgtgttagtggttattaatagctatagtaaatgttgaagagttagcacacggctgaaatctggaaaacactgaggtggcttgtttatttctttcaaagcatttagcagctactgttaagagtactgcctctggaagggacaccaaatatgtgaccatctccccaaggccatcttcctttcagattctttttttgtttttttggagacagagccttgctctgtcgctcagactggagtgcaatggcatggtctcggctcactgcaacctccacctcccggattcaagtgattctcctgcctcagcctcccgagtggttgggattataggtgcccatcaccacacctggctaatttttgtattttgggtagacacggggtttctcacgacgttggccagactagtctcaaactcctgaccgtgtgatccattcacctccgcctcccaaagtgctgagattacaggtatgagccaccacccccaggcttttttttctttctttctttcttttttgaggcagggtctcgctctcttgcccaggctggagtgcagtggtactatcatagctcactataacctcaaactcctgggctcaagtgatccacccacctcggcctcccaaagtgctgggattacaagcatgagccactgtccccagcccctttctttcagattctgagaactgctggtatcacctcctgccttgacaatgaaaacatagatgcagcatttttgtgtaaggcccaagcaggcaagcctattgctcctagatagaaaattgttgaccatagacctgggcttttcctcagaatcctcagaatggccttttgctctcagggaaaaaagaatattgctatttcctggatagaacaaattggcatttctacattgtatatgagtagttatgtgtttgccataattaaaatatggatgtcgaactgttttccccaactctggagtagtggattagcttaaaatatagccagattattttctacacgttagtggtcactgggtatattggggatatactgaaggtgcaacaagtaagaatagaagccagagacttctatgccatttctgccatcatccagctgtgtggccttcagcatgtctcatagtctctctgggtctctaaaataagtgagagacattgggctgtgcaaaccttaattcctctcagctctgacaccttggatgtcagtgccatctgctgcatttttaccatcctctccctactcacattgttcctctcctggctggacttcggcttcctctgtgaaagtagaatttccactggggccttcatcaattgacaaactgtcctttggtatgaaattccccagttgttactcccagaaccagaggccccagccctttgagttgaccctaactattgcccagagactgttgggaggctttttatctcttcaagacttgctcttcatcaagaacttctcagaagtggaggcactgtagcaagattaatggttctcaagcctcagcaaatagaagaattactgggaggccttatttaaaacgcagattcctgggtcccagcccctgggtactctgcttctggagaacagagatgaagcctaggaatctgcaccttcttgaatcctcctctccaacccacagattttctggttggtgcgtaaagagtttgataagaatcactggcaactactaaggaaagaagatggaagtaaaaggaatacaaataatataatataatataatataatttataatataatttacaaaaaaagaaacactgacagggtggctaagagcttgggctttagaggcagacagaccaggattttaagtctgctttagtctttactaggcacatgaccttgaacacattatttagcctccctgcaagtcattacatcatctctaaaagggtggtaatactctttgcctcccaggatcactgtcaggattgaataagacaatgcctgttacaccactgcttgtagtaagggattcggaaaagtagctcctggcacgtagcggacattcagcccacatttgtttacttgtttgtacttttaaactcccttctataggccacagggattttatatcagcattgcatttgggggagtcaggctgtgtaagcctgtggaatggataaatcagcaaagagaaataacagagtaccttaaaatccatgagcaaatggttgtgctttagttttcagatcccagggctgtttttaaacttaccttccaatggccaaatcctttcttagaatgtgggcttaaacgtcctttgtttatgggggatttgcctttcagaaaatcaattcctcacatctgtggcttcaggctttttactcaatcagcctcctaacaaagtaatttttctgattttcaagggtgacctagttgtactggtttcagtgagcattacatggccttacctgattgtgtatagtaaaaaggagctgtttcttccagatttggagcctcagagaaactctcctgatcttcaggcctatttcctgttcacccatgtgccaatataccctctaggtacctggatacaatttgacatcccactgaaatgtgggtgttctaagcatccattcatcataaagtttaggggcttcagataccaggatgggtacttgctctactaaaatgggatccttaggaaatcccgttcaaggataccacttcactatggggtactgatttagggtctctctctgaataaaatatcttgtcaaaatctggtagaatcacaaattctgataaatggctgcccaatggagaagtttagggaaaattatcttacatttttcatcgaagaactggtattgttgatttaaccgtcttttcccatcaccattgttcctatagcaatttttagactgggtggaggaatctacttctcatttcaattcgatttgagtggccctgccctgccccaagtttattatccccacttctgaccctgtgtataactagaatgaaaagactgggcaggaaacaagactaaagggacacaaagtcctgctgatatcaaaagtaatcttctaaagtcccaaagaatttatagcttgccattccatatgctttttggaagttttgctttaaatccttgttacccaattttgaccatactgaatcatgttatagcatcagatatagacatagcatctcagatatagcctaaacctcaccacctctctccatttctactgctgagcccagagcccaggccatcttccacacaccacacagtagcctccttaccagtcacgagtcctgctatgttcttgcccctctacaaggctacttttccaccacaagacgaggacaataattttcaaatatatatcaggttatatggctcctttccttaaaacttttaccactttcctgttgccagtaaatatacaacatggccctcagagccctcaatgctgcttccctgtggcatcagctctcactcctctttctctagctcatttctctgcagttacactggcatctttgcattccttgagcacagcctcgcactttcctcaagtcacttgcatatgctattcctttacctggcattttctatcactagagtttcatgtgctgtgtgcctccttgtcattcaggtctcagtccaagtgaagccaccttggaaacgacatccttgaccaagcacttttaaagtcactcccactcacccagctcacagtcacaatttcctttttatttgtacttttcatggtgcttattccttctgatatatttttattggttgattgatctagattgaggttggcaaacttctgcctactggccaaattcatcccaccacctatttttgtacagcccatgagctaatggttacatgtacatttttaaatggttgtaataaatcaaaagaagaccattttgtgacatgtgaaaattatgagagattaaaatttcagtgcccataaagtttttctggaacatagctatgctcatttgtttatatattatctatatctgcctctgcatgacaacaacagagataagtagtggcaacacagactatatgatccacaaagccaaagatatctaccgtctggccctttaggataaagcttgtcaacccctggtctggatatgtattttcttcatacttctctacctcctaaatgttctaaaacaccaactctttaaaagcaaggaccatatttgtatttttattatattcacagtgcctagaatatactgaaacagagtaagcacatacatataaaaggttgtttattacatcactgggaagtttatcaaatgtttctgtgcaatcagagagcacactatgctagcccatatttcaaaagatctgccaataagtaagggaaaaaaatgcctgcaaatttaataaaataacacctcaagcagaactcagataaagttacacataaacttattaacttcaaatcttttaagtgtgttaatttagataatcctaggtgctgtaacagataaactctgaaatctcagctgtttaatgcaaaagaagcttttttttgttcactcagtgaccacttttttggctgagggttctggctaagactcaggctcatggaccctccactgtctacttgggtctttctggatttcaacatccagctaacagataggaatgaaagaaaatggcaactctgctggagatttttggggcatcagcctagaagagatgcacatcacttctgttgtattccgttggccagaacccagttacttggctcaatcagaggtaaaacaagctgggaaatgtcattgctggccaggtagccactctccaccaacatctctacaccatggaaggaaaataagaatgcttgggagtcagctaattatcttggccacaatagacaacttagtctttaaaaattgatactaaaggatcttattttttgaggtaaggggctgtggtctcagaggcagcctggagataccaatttctgaatttgatttgatgactgtgcaatatagatcaattgaattttcagttctatgatcatctccttttaagactttctccacttaaaaaatctgatctgtcatctagattcattttctacattcaaagaatctttagaggtagatggaaaacacggagatcaaaaattataactggccccaggagaagacctctcactgtcagaattgtttaaatcctctcctgactggtaggccccaatctttaccaactactaactctgatttacttttagaaagaatcaaaattcctgcatatcctcagtagagaatcaaagtgctgtattataatccaaccatttcccaaagaaaggaaaatttgctctaatctccaaagtgcaatgtctgttcaaaaatctttgccagctttcttttcatcaaactgtggaaccagatttctcagtctactagtttacatgaggcataggcatgaggctgagtatcactcagcccactgaccctggcaatattatgttttatctccctacaaaagagttagaaataaaataggtttgtttacaatttctaactattctactagcttttgatatgaaagtacctagcatataagccaagctataccacatttttttagagatcccaatttaacaatagtgctaaaattaataagtagtgctagctttgaaggacaactatccttaaaaattaaggtgtctttctaagccatatacatctggcttacacagattcatcttgcttttttttcctatcttgtatgaaaaccttgggattttacggcagttttataatttttaaaccacataccctgaacattctatacataaagaagggttatattgtcaagtgaatttcaaaatgctctataatgcatgcttcttttgcagataatgttcaacagcaaattgaaaacagaaatgtcttgtagtatagaaacctgttaaccttcaactaggcactaccctaatgaatatcattttttagcttactgacaatatgaaccatacactgtgctaattgttttacatgcattaactaatgtagttctcatagcagcccatgaggcaggtaccattgttacatccactctacagatcagggactgaggaccacagaggtcaggtaacttgctcaagctgatagttggtaattaggaaagcctagcttttaaaccaggtctggcctgaggccagagaccaagatcttgaccactgggctccctcttttttaaaataatacatcttaatactcagtggcttttagaggaattggttgcatgtcaaaggaagcaacttcctttctactgatggttgtgcagtttgagtaggaatatttaaacctgtggactaattgtgaagaaggaagaagaaagacaggaaggaaaggaggaagaataggaggaaggaagggagaaaggatggatgacagggaagaaaatgaacaagaaggaggagaaagggaaaagaaaaaaaaaccttaggaccatctatgaggggataaatcatatttgacagatattttcccaggtttgtattgattttattaaataatcttacctttgaggtccacaagacctgggttctatgttctgccactaatctactatataacctattgttttgttagatcatttaatctccctaagcctaagttttcctatctgtaaagcagagaaaataatcctaagcctgcctgcactatctgcatagtgtaaagatgttataaaagtactgtggagatttaaaaaacaaaacaataccaaaggagaaaactttacatcataatatactaccagagtgcttttaaacatctatttttcagctagaaggctccttgagaaaggcaactcttgcggggaatcccaataggtgaaatagataaaaagcagagctgaccattagagcaaggatgaggaagccagagctctctcctcttcactgcccctcaccaccttccatgagcggtgaaaggccccacaagtctcttagggttccctagaacacagtccttgcaaaagcgagggaactgagaccacactgtcttgagcaaattctgtggtctctgcgcctctgcttctccctgtgaaaaaggaaaaagttggacaaaatgattcttcagtccccttccagttctgacattctagaaacgtgagtttctggttcttctgtcattagaaagcaatgtctccttccaccttgactaacagcatccctcacagggaacatggtacacatgcctgcactgagggtaagcctccatgcagtatcctgagagacatgctccccgtcagacctccgagctgtctcagcatcgatagggtgcaccatgtccatgctgggtcactgctgcctggatgcattcattctgtccacaaacatttcctgagctgcttctctgggaaaagatgttctagactaagacaggaactctggaacaagtatgtttatttcagtcttgtccatgagaaactcatagcaccatggagagatggggacagacacacaaacagctagacccagtgttctaatgggaacgtacacaaggtactcagggttgtgtctggcatgcagggggcacggccctggagttggtctccctggctcatatcctggctccacggctaccctgtggccttgggaaagttacttcactttccacgtctcgctttctgcatacttaaaattgaaaggataattaactacccacttcgcaggttttgtgaggatgaaaggagttaaaacataaaaagcactttaaaaagtccctgaaatgcaagcattcagtaaatgataactaatatgatttcaagtccagagcccaatcccttcttaggaagaacagcatagtggctaaatgcagcctctggagagagattgtcagggttccaggacaagctcaaccactttgcagctacttcacctcgggcaagttaacacactcccacaggccagacgaaatggcatgaaaactgttgaacacttagcctctgacatagcaagagcatcattagtgctggcaattattgttgttaatggctgcgagattacaggaaaaactatttccaactgaaggaactgggaaagacatgaaggtgaaggtgacatttcagctgaccatttggcaaatgcctcagtttttgtgagcctatgctgagttctggctgttgatagacctgttcatcccaatgcatatgcacttctagttctctttcctttttcctttgtatctagagccagcagaatgatcacaaaacaaaacacaattgtctaaagcaaatagagattagagacagagataaagagagataagtataggaggtatagctttagggtgtgtatgtgtgtgtgtgtgtgtgtattaatcaagtcattctactgtttccaaactttcaatgatcccctgttgccttgaggggtagtctacactgcttagcctggccttcaaagccatctgctacctatacccagatacctactgcccttttgggctaactctatcttccacccaggacccacagaacttaaacatctgggcagattcctgtcttcatatcttggctcatattctccctaacctgaaaggttttggtccagaccattcatctctcatgatcataagccctgattcctcctgttgcatttttccctgtgtaagatcccacacttggcttttgcttctctgaactccttaggcccactcacttgtcacttctgcggccatgtcatgtcttcccatggtagaccagaggcgttctcagagcaagccctatctctcagacttctttgcatctcgtcaaccctgcctgacaacaagcaacactaatgttttagctcagagccttgtgcacaatagcagttcaattaatatttcttgaaagaccttggaaaatgaattagtataaataacctactcaaatttgaaaaattaatattgtcaaccataatttttaggcactcctatatattcaatattgtaatagtttatacttggagacagaagaaatttttaaaaataaaggataaacaaccatcataggaagttaaatctagatggaaaaatacagttaacctaaaaataaagtaaaagaatgtaatgtttaaatcatatgattccaactatagttcagaatgagttcactgaagtgcagggttagtagacatgggggaaagaggggtttgaccctgtgaacaactgcagggaattaaatcccatggtcctggcttgcattgtacaaaacagactggctgtgtaaacagttaagcccttatccctcagaggtggcaatttccaaactgaaccaattattgtggggattttccctgggagcaaaattgggggcacctgaaaagcactgtgcttcttattatttctgtttaccaatattttagagctcggtatgtccaattcttcatgagctccttacttgcctgtctctggtattgactgggtgacccagagcaggccagttcagaggaggctggcccacctgacacctccactctcttctcattaacagattggttactggaatgaagatgataagtttgtccctgcagccaccgatgcccaagctgggggcgataattcaagtgttcagaacagaacatacatcgtcacaacaatcctagtgagtactcagtccttcatcaaggttacttgggattcaagctaggccagcacaagggttttccaccaggactgaaagctggcctttcttcttgccaaaactgtgtaatagataaaagcagcaagtcgaaaagggaatgccctgaaaatgagaggctctgagttttcactctgtatctcttagtttcactgtctcatcctttgtacccttgggtaacttacttactttctcttgagccagctttcccatatttaaaacataagaatgacactaaattgtgctggttttcatctgtcctccctcagtagaagctattttcaaagaaagtccaatacataaagtagctgtaagtgaagatgctgtaattttcagtgactgatcatgagaaacctggagcctgtttagggtctatttctccttcaagatgaccccagaggtatttccaaaaaaatacaaaatatcctggaacataatttgaaaagctgtatgccatatctcagtgataaaacattcttattttaacaaagtttgcttccttaacacaagaagcttgtaatggggtagggagtgaagacatttaggaagtgaattgaggggctagagagccttccccagtgttaaccaaacatgatattatgctatgccaaagtcctccctacccatgggtgaacccataacccacattctgctatctccccatttctcttccaggaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggagtaagttcactgcagggtgggaaattagagggcggaggcagagggtttgacaggaaatcatttggtggttgggtggccctgcccacagatgtctatgaaaccctgtaattgagtgttgttgctgctgaacagatgagtcatccaaaatccaatttcttcagacactctttgttcaggttactggtcccaggtccctcaatcccactcagagtcttgtgacgtcagttgattgtcgtccaacacaggtgacagcatagctccaagatcaattttcttgaggcagactgctgagttgtctatacaaagtcacttgtggctctctcagtatcagtttcttctctgatattaaatgcatctggagccaacctaactttctagttacttgcctctctagtttcatgctctctcatgaaatttccaattcagtcaaatgccccttaattactctgttccctagagtgctcccttccactctccacccctaagatactactccttcaaaacctatatcaaataatacttttttcagggtgtgtttctttctttcttctcataataggtatgaatgtgccttttaattgttctcgccttcccctatagaatttagttgctggttttttttaatgggtttaccctgccttatataacggttacctgtgtaacaggggtaggactattctatctttatagtgctcaccacacttgaaataactccatgcacaattgctataaaatcttcaataaattacagcagttttgaaaagctgctgaatgtcccacattgttttaagcatttggggaattattgagaagcaaaagatttgatcttttgcttaatactttatgaggtagaaaagaccccatcttttaacattttatggggtagaaaagacaatgtgagaaaatagtaaaaggtagtatagaataaggagtctatattgtatggctcagctaagggctaactagagtttgtctagccctcagtggggatgtgaaacttgaaaaatgaccatatttaaacagaccgagaggccgggcacagtggctcacgcctataatcccagcaccttgggaggccgaggcaggtggatcacctgaggtcaggaatttgagactagcctggccaacatggtgaaaccccatctctaccaaaaatacaaaaattagctgcacatggtggcgggcacctgtaatcccagctccttgggaggctgaggcaggagaatcacttgaaccaaggagatagaggttgcagtgagccaagaccatgccatcgcactccagcctgggagacaagagcgaaactctgtctcaaaaatgataataaaaaacatatgagagaaaagcagcccaggaatttttaaagtataaacaataggatggtggtggaaataagtaaggtgtgagaggagaatgagaaaacgcatggtttttgttgaggacttgggttgaagagtagtcagggatacatatgagtaaaaaatagcaagaggaagagtgtggatgattcagtgggcattgggagatcacgaaggtatttgagtagagagacaacaaaaggcaatggaagaagcctccagctgccttgtgcagggaagggaccaccacggcttcactcatagaaactaaaacacatgccaagccccaggtcaatgttaagtgctcataaggacaagcagccactgaggaagatgataaatcttgtttcatatcagggcaagaggagccatgatggccctgagagacatacaaagggaattcaaagaagaaaaagatggaataaaggaaatcttcctcagggaggtagcttttgagatgacatgtgaaggtggttattgagttggggaatgggatgtgcttctctcctttcttattccctttaccacctctcactttgggaagctccatggacaaaaggtagagacctggatagtacatgctgcatctggaggctggtttccatgggaactcccatcaagctcttaaggtcatccccatggcaactgctgtgcacttttcaccttctctagcatttatcttcaccttcacctcatgtaatgtggtttgcttggttaaaagtctgcagtgtgggcagaacaatgccaggatcatccccagtagccaacacagctggtggtgagtcactggcacagcagggctcaggccagctggagttacctatgggtgcctcagcagccaggcctgcctcagtagcctcctccttatcaggcctgttcctctgcccagtaaaaactgttctgaccaggtgtggtggctcatgcctgtaatcccagcactttgggaggctgaggcgggtggatcacgaggtcaggagatctagaccatcctggctaacacagtgaaaccccatctctactaagaatacaaaaaattagccgggcatggtagtgggcgcctgtagtcctaggaattcgggagctgagtagttaaggcaggagaatggcgtgaacctgggaggcggagcttgcaatgagccaagatggtgccgctgtactccagcctgggcgacaaagcgagacccgtnnnnnnnnnnnnnnnnnnnnaaaaaaaaaaaaaaaaaaaaaatgctatgttctgaagactctgtgatggccccagtcggatgctcagcctttctttttagtttggctttccttttctgttcccttggggaagaaccaagtgatttggagaagcatctctcaaccaccaaccaccagagatcaagaaaaattcatttggaggcttccaaatttattctttctgtggctttctaaataactaagtcgatcaggctctctcttatcttccttttgctccctctttttccgtcaataatgatagtagtcacatttcatcgtgtagcgtgtgccaggtgctatgttgaatactttactcacattctttcatttactctgcatatcgacttcatgaggtgggtaagattactgtttacattttatagatgaggacactgaggccctctaggttagataatttggcaaaggaaacacagctagtgaaagcagagtcagaacatgcagctctggcttttgtactccacactgggacatactgcctctgtagaaatcccaccatccaaatgctaggcggtaaaaccaatattaactgagagaacagcaaatgtctgcatttgcagatgccatatgctgcaaatgaagtttctgctcctcacatggtatatcttggtgcctccttcacagctgtctttactgtctgtcctttgtcttggtaaagcagaaagagagtgagctttgcagacagacacctggatttgagttccaactctgccaacttgctggccccgacttttccggggccacccctgtgaaacaaggaacgtgaattctttaccacaggctgtgatggggaatattcatttatgcagggcctggctcagagcagatctccatttctgatagttttattcactttatgcttttttctaccacatgaaaactatatgctgttttcccaggatagtttctagacatcacgtattttgttttgggatctgctaggtcagtgattctagaggtgtggtctttggaccaatagcattagcaccacctgggaacctattagaaatgcagatgttcacatctcaccccaggcccactgaatctagaaactctggcgtgtgtgtctttaaaagccctcctggtgattctgctgcacactcaagtttgagagccattgtcctaagatgtcagtttaagaaaataattttgactgctcacatttcacagtactctcatgtattttgaattatcttgaccctcacaaaacaagcctgtgaaattggtgaaacaagaattattatgcctgcttttaaaatgaggaaattgacatccaaaaagacaactgtttcatttgaggctacacaatcagccagttgcagagaagagcagcccggtctgagatccgctgtgccctccactacccagtgaagctccagtgagaacctcagttattggtggtggaaatcaacttctgaggcctctcagtcaatattaaccaagctaaaatactactgcttttcacaaaccaccttccctctctagatatgagtttcttatctgtaaaatgaagtagttgaacttagcatctcccagtatgtgtgtatcttacatacatgggtacctcttgatgcttaggaagatgaatgacccatggccaaatagttttggaaatgccacattctacttactcctcttggaaattctcagtgcattgtggtcatctaaaggttctgggaagttctgccccaagcatgtttatttttatgttattttcatgttattaaccatccttccagaaataatgttctattgaacaaatttttgaactacaaaatgaactaagctttaggacaatacggaacaggctgggtatggtggctcacacctgtaatcccagcactttgggaggctaaggcaggcagatcacttgaggccaggagtttgagaccagcttggccaacatggcgaaacctctactaaaaatacaaaaattagctgggcattgtggcacatccctgtaatcccagctacttaggaggctgaggcatgagcattgcttgaacccaggagacagaggttgcagagccaagatcacaccactgcactccagcctggggaacagggcaagaccctgtctcaaaaaaagaaaaggcaatatggatcaatgatttccagtctatgatctcttattaaatcacattaggaagcatccaacaaatccatgcaatatcatttacccctttcagagctggtcttcatccacctcccttccggataacttgtggtcaatccctccaagtcatttccattacttgtctcccccattctttttctgttggtttacaaacaaaaaagtaaataccttctcccctgtactgtcttgtatttgtaaaaattaccaagatttatgcagtgggtattaggggaaaaaacagaattgctatgaaatttacacctgacttcacattaattaatggaaagtttctttctacaagtgaaaacttaattcatcctgaagccaggctttctattccacttaaagcaccttctcaataatcccagacaatgaaagtaaccagaggaaatctctaagcaacagccaactggtgggtggtcagcaccctgacctgcatagcatctgtcaccagcttcacttctgggctgttgtacagcataagagaaagccatttgccttgaacagacctgcataggcatgtctctcatctcagaaatgaatgctatggcatctctccatggaaatcctcttaggtttccaggatctcttgatctcaggccaacaggagcagtggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgtcctcttcctggtcgccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtcagtcagctcttctcaatccctttgcctaatgctatggttttgtttgtttgtttgtttgtttgtttgtttgttttttaaatactgaaaagtaaagagatgaattatttcagaccactgtattcagtttttcaactattctttacaatcaactgtccattgcacgctgtggattatctggatcatcctgtagctgggccatctctgtctgctctctgggttgatgtgctctgtcaaggttaataggcataattatgactgatgcgttgtagctgaaaggtacagaggaaagaagggagcattgtgtggtacaactaacacttatggagcacctaccaaatgccaagcaaggttctgagtcctgtacatgccttatctcattgagtccttacaggaacataaggtggtactcccatcatgtctctttttacaaatgaggaaccacagaaatgttgaatatcttgccaatgttacacagctagtaggcaagtgagttgagattcagaatgctgtcctttcctacttctgcatggtgggaagagcactggattatgagtaagttctagcactggttctagcacatgggccctttatgcggctctcagaaagtcacctcaccctagtagatgttggcgtcttcatcttaaagagaaaaaacttctccttttctttggttctgagaaagactctggaaataatctagttccagtgatgatggaaatttgtttcttgtaattaaaaagtggaatttcaggccaggcgtggtggctcacgcctgtaatcctagcactttgggaggccaaggcaggtggattacttgagatcaggagttcgagaccagcctggccaacatggtgaaaccctgtctctactaaaaataaaaaataataaaacaataataataataaattagctggatgtggtggcaggtgcccgtaattccagctatttcaggaggttgaggtaggagggtcacttgaacccgggaggcagaggttgcagtgaggcaagatcatgccactgcactccagcctgggtgacagagtgagactctgtctttaaaaaaaaagaagaaaaaaatggaatttctcagaggtgcctcagatatcacattgaaagcacactcgggtaaccaaatcagtgggattttagccccccacatggaatcagaatggctccatttttgtctgttttatatattggacttgtgaacacaatttattttgggaaaaaaaagtgactgaagctaagaaaagagaaagggtggacaggagatgggggtgaggaaggtaggaaacctgccaatctagaccaagtccacatttactgacctcctgttcttctgactacattctggatgtgcatgccacaattccccaccaatttgcctgataaataagcactgactctatttccttttacagttgcttaatgtctatgaactctttttccagtaggcactctcttagattaccaaatttcaaaagcctacagggagtcatggctcagaatttggcctccatggacagatctagaggcataagtgcataatatcaaggtctcatagacatgtgctggaggcatctttaccacctatctacgttttgcatttcattgtcaaggaggaccaatattcctaagcggcaatggagtaaattctttctaacaagcttccctcaggacttatttggcctgctgtataacttagaaagtctcatcgttcattataatcttgtttttctttaaataagaagacagtggggggtggggggcgcgtgggagaggaggtgtgagactggctgcttggccaatactggcaaacacatggtgaagagtagagagaaccaagcaggggaagggcttgcttaaaaataaatcaggcccgtggataaacagtgggaagaaacaattcctaactagtcagcataatgtagggccatcacaacatgcaggtgtcagagaagacccatgaacttgttttttctcctttatttccttcatcagtgagcatctcatcttttcacagaacctttatgctgtgatctcagggtgtgttttctttctccccactattcctccaggggtttcaatcttgtggtccataaactgaatcttctgtcagacaggtttttgtttaatctgtacagaatttggcaatggttatccaaaactgagtggtagcttccctcttgaacaggtccgcgcattcacggttcaccccagccccaacctgaccttctttgttcctgtgttactcagctggccccagagggtgtttgagtttgtgacctctggctgcaagaggattttcaaactatgctttccggacttctgagggttccactagggtatcataggagttgacattgaggtgaagaggagactggacaacatatccagcctccctcctccctgattttcataaaacaactctactctatgccactttttcattaataaaatggaaataatagtttctacctcaaatcttgttggaaagtttagaagtatgtatagatcctataacacagtacccagccttcacacaggaagcgctataactggatgctttttttattatgttaattgattttttttaacttggattttgtctaaacttcactggaagaaacgatgccactgttcacactgatttgaaagcctaataccttcttctagagaagtccattaacaaagcagaaatagccagtggtttatgccagagaccagccacatctggattcctaagactcctcctcataggaactgggaggaagggttggtgactttggctgaaaggtctgacagacacaagagtgaactgccaaaggaagttagaactttgatccacttgagatggactttttttaatcaagccaaccttggttaaccccagagtttaggagcctgtaaaatctcccttgagagagtgagaatgtattaaaatgtttcttggaaatatatgtagaagagaagagacatatacttcatcttaccttgaaccagacaaaaacacaaggatgctaagacaatgatcaaagttagagactaagaagacaatgaaaaacatcagtagaaacttttgttgtcattgttgtttatatatttcctgatgaagtcagtaagtttcatgaccttctgatatgcacagcactatgttagacactctgggtgctgcagtagaaggggcttttaaagctgacattcatcaaacatccttccaaatgagcttcaattaactgatcttgctgcttatttaaagaaaatgtcataaacccttcctaatttagtatttggggaaatcaatttcatctgaattgcatatatctgcacttatccacaagtagctttaactctttctaatctcttcaaagttgatgttaatgtctagtaaccaaaaccaacaaaatgtggctaagtgtaattgtctgcaaataacatcaaaacctgaccatagtaatatggtaaagacaaagataacccagtaaagagggttatctttctcacatataagaaaagtggtagcaggtagtggcttgtggtgaaatccagattggccattctgtaaattatcttggccttttcttcttgttcataagatggcggttcccaaatattgtgtccatgttcaaacagcatgaaggaaaaaaagtgttgccttctatttctgtctttttggatcagaagaacaaaagcttaacaaaatactctccaccccacacagatgtctgcttctttctcattggtcaggacagtggccatgattatttctagtggcaagagaggctgagaaggcaagaatttaggttttccaacctctagagtaggcagggtaggaatcgatattgggggaatcaactggcagtattggccactgtgcctaaaatcaatgttttctgcactggcaccaggaatagatagaaataatccagaattagcacagtcaatggtgtatgccagcgaatgctactgaaatgctttaaagactcctccacccaccctttgaaatgtatattcaataaattggttttgtataacccattttaacagtgaaagttaaaaatcacttcagctatgatcacagattacaatttatttttttaattaggttgatggtgagattaaaaagggacccatgaatttacttttaagcctgcttcttgttcaaaaaaaaaaaaaacaacttttttttttaactcagtcaccccagctggagtgtagtggtgcaatctcagctcactgcagccttgaccttctgggctcaagccatcctcctacctcagcctcctgagtagctgggactacaggcacaagcctccacgcccagctaatttttgtattttttgtatagttgaggtttccctatgctgcccaagctggtcttgaacccctgaacccaagtgatctgcctaccttggcctcctgaagtgctgggattgcagacatgagccactgtgcccagcccaaagacctatttttaatagatattttagattttgaggagtatgttaaagaaggaataaaaatcatcacagacaaaacttatctttagtaccttcaactttcatttctggtccatttccccatgtgtgtggtcaagatcattcatttattcaacagatattgctaactgcctacgacatgcagggtatggttctaagtgctgaggatatgaagatatattggtgatggagtgtggagggcaggagcctttgcttcaaggagctggcagtatagagatatgagagacattaaacaaattatcgtgaatgtgtaagttgggatgtgctatgaataaaatgaacctgctgttgcaatagataatacaagaagtggaattaaacaagccttacttagagtgttctgagaaggtttctctgaggagctgatgggtaagaatgagctagacttgtataaagctaagagacataaatagccatatgcaaaggttctcaggtgaaaaggagtttactgctctcaaggactggaggagtgacaagtatgtctggcttacagtgaatcaagagaacggaggtttgagataagattggaggaagaagcagaggcctgcgcagggccctgtggtcacattttaaatttgatgttttattttaaatgcaatggaagaccattggagggttttaagcaagggaaggattgatttgcatgctaaaataccactctggggagctatgaggaaaatgaattggggcagagaagagtccagagtggaagcagagggaccaaacaagagtctctcatagccatcctgaggaaattacagtgatggaaattagaatgatggtcatcgacatggatttatggttcactctgagactagaattgacaggacttgctgatggattggatctatgaggatgaggagggggaggaatcaagggtgagtccaagagggaggaagcatttggaaaacagggaaccacagttccagggactattagctctgggcaggatcaataggatgctctagtctacccaccccatgttacacatgaggaaactgaggccagagagggagggaaagacattttatctaagatcacccaggcgatacctatggctgattggtgcccagtccaatgctaccctactgtgtagtctcagcccaaggctccattgccttcaaatgaactgagagtgagcttcttcagcttattacacccatggccccactttcccaatggcttctccatggcatcaatattttcctgggttcaggtgaccttagtaagagaatgagaggaggttagagggtgctaggagaatggaggaaaatgggaaattatgactttagctttcagaattctctcttttattcttgatcatagactgaattggaatgtgtaacaattgtctccacctagtggagataattactctcaggagaagaagtctaaggcggggggagtgatggtgctttggaggtctcctggagcctgatatcataacctcctccctccactaatttatttatttatttattttttccaagaccgagtcttgctctgttgcccagagctggagtgcaatggcatgatctcggttcactgtaacctccacctcccgggttcaagcaattctcatgcctcagcctccccagtagctggcattacaggcgtgtgccaccatgcccagctaattgttgtatttttagtagagatggggtttcaccatgttggccaggctggtcttgaactcctgaccttgcgatctgcccacctcagactcccaaagtgctgggattacaggcatgagccactgtgcccagccttgttgagggccttttaactgactcacggtaggaagatggtggccaatgaggacagcccaagccaataaccaacgatagcctgacctttgcattcacatacaagtttcatagtaaccagtatgcctttggcactgagagtctatgagaaaccttcctctttcccctctttccccctcctgctctctgtcctcccatcccagcaagagctgtgcaaacccatttctcttgctcttcttgatgtcactgtagtattgtggggaagagaaagagcctgagagtaaatattgaggcaagttgatgaaggcagcctgaaattgtcaaacatttctcattttgaaaatgcaaacgtcatttaggccacaggttcatttctacaaggaacagtgtcacaaggatgtgtcaaaaatgatgagcaggaaatgtgcgatagctaatctgggtcttgggactaggcatgggggtttctgctgggaccctctgcgtcagaattacctgggatgtttgtccaaatgcaggttctcagacttcatttcagctctctagaatttgaaactctgcagttggagagaaagttctacatgtttcacaagcctccccacccacttctgccccagggctgatgggattaaagtttggaagtcattgaactagggtgctgcccagagaagtcagcttaaaagtacagaaagcaaggcccatatggcagctagaaatgatgctgagtcaacattgagtttgatattgagtcaaaagccgtaaacatggagcccagggtccgccagctcactaccctatagtatgttacatgctgggtgagcgaggcccttggcacaggggtgttgactgtggccttcaaagcaggggcctggctgtcctgatgaccctgccttctgcaggccaagccagcaagaggaacttaccaagggtttcaccagcatatttcaccttgacagttttttcctctccattagcaagcaacaccaacacaaagggactggcccaggtgaggtgattctgcagtcatggcaggtgtgaagtgtgcatggactgtgtgggggtggcccccatcatgggagatagggtgtggaactccagatcagtggctcctactttttccattttaatcttctgctacctgatggtgagacccagaaccaggttctgctactgagcagttttacagacctttgagaagaagagtagaagtttcacaagctccaaaggcagcatggaaatgttaaaatgagtgcagtgacaggagaataaaagccttcactggatatgcaaatgaaaccatcattttctgtgtctcagcctgcagttctggccatcagcaagggggaagcataattgctgtctctagattgttctggaagtttatactttgaacattttaattgacggagagattttttttctccaaaattacaataggaaaattttcagaaagtttttcacagagctgaaagggatattgaggaccaattattcatttatttattcattaagtgtttctttagcaactgttatttaacaaacattgttcaaggtactgtgagagacatcacagaacatagcagacaaaagctcctactctcctggagcttgcattccagagagaagaggcaggcaataaataaaataaaaatgtgattaacatggccatcccaattcgataggtgaggattctgggtgacagggagaggaagggacatagccaaaatcacacagataattagtgtaggttcaatagcataggagtggaagtcagccgggggctgtggtgaacggcacatgcatgtgtcagctagagaggatagctccccctcggctctggatagtcattgccatgggaactccatgcagaccaaacaaaagcatgcctagattcagcttgtacgccaccagtttgagagccctaaaagaatggtgaggaataaaacagccaccgtatgtacttactgcatttagacacacttggaatatcgtatttatatatacatttttaagggaatttttctccttttcccctccatttttgattccaagcatgaaatctgattgctgtatttttctttcctttcatatactttggaaaatccagaccataaatggtggctgcactaaaagaaagatggtccctaaattcctgtatccagagaaacctatttatggctagctacatcttcgtaggttctgcattttcccagagacgacctcttgtttttcttttaaaccctcactggatatatggcatctgtgaccaagaaacccagttgttcacctgcaaagaagtattgagctctagacagaaaaaaatgaaagcataactaattgaattgacgaggaaagtatgctgaaacccctatggggagcctgatggttttgaatatgagttaggtaccaccatccaaccgtggtgaatgaatcatttttgctacaccacttacatatgcttttacctctagctatgtccaacggagataataggtgaattaagtccaagacacccagcagaaaataaatggtgtcaagaacactaatagaaaccacaaacctagctgatgacagtcactgtttgcatctagtggctgaaggagaaacggcctcaaaataaggaggcatattgcctgctaaagcagagtggagtcccacccaaaggcagaagtaggaccagctgttgtcacaagggatggaggaggtggtaaaggaatttaaaaagaagctcaatctcagctactactaacccactggatgagtcactttctctctgtgtgtctcactttttcctctgcaaaatggaagtaagatggtctctagtatgtccctagctccccacctaaggctcacctccttatgattcccagcttagccaaggctccaaccaagccaagttgtgcttcattctgtctcccagctccatgctcccattatgcctttattgttccctctgcttggagtgacttttcccacctttcctgctcaactccttccccatttgcaaatgttgccttctcactctcccccaaccaactccaattactcctctgaatctgtgatttatagtcatagttataagcttgaactctgcagcagggccggctgggattgaattctgactctactacctactagctgtgtgagctttagaaaataactttcctacatccagtttccacttctggaaaacaggaaaaataataagacctacctcaaatgagatattttgaggattaaatgatgagattcatggaaaacatttgccttgcacggggggtgacacactgtaaatgctgttgttattgctgctgttgccattgttgctgtcacctacacctctctgagggcatcttaaatcttcaaccctgcactatagttaccatgtctgtttcttattgagactggtagactcatttctacaacttattcaaaacctgacatgaggggttgtatgttctaaatactcaacatatgtttgttgaatgtccatcttcacaatagctaaggactctgtcctgtttttcatttaatcaagagaaaatcggctaatagggagaatttccagctgtcactaactacctgtgtaacacagggcaactcagtcctggtccctgaatggatttggagaagaagtgggaagaattggagataaagaaataaaaggaaccagaaaataaagttaccttgtcatcctaatgttgccagctaccccactattcaggaaagctctgatctctttgctggaaaaatagtagcaaaaatttctttctttcatgtgttgtacctactatgtgtcaggcactctgacaagtgttagatcatgttactgctaatcttcttgaaaactctgcctggtatatcaacaccattttgtgatgagaaaactggggctcagagaaattaattcacttgcatgtgggtacccagcagggctgagattataacctgtgtcagtctgattctaatacccatgatttatccttgacacacagctgtcttccaagaccagcaatcttctgaaggtcccttagggctccccagggattgttataattttttaaaaagtgggagacatcctttttcctttataggattccctaactctggtttttttaatgggccttgctttgaatttttattcaatttttattattcctaagagtatctttgtctttaagagccatctcctgagggagcagaggcgagcacccaggagaacattttgcccccaccaagatcaggtgcagcctgctcagctggagtgagggagatggtgagacagaaatatgagcaaaaatgtaactggtgccactttggaaagtcagcttcagctgggaagggactgtgggacattccatagtcacagccaaagctggagagggcatgttgttaactgtagcactttaagtaggaaggataaatggggagaaaatgaggaaatagagtcagaagtgaccttaaaattgtgactgtgagagagatctggaatctatttatcctatgggtaaattccatttgtcctatagaaatgatcgtgcaaatgtgataagatgtgtgcgtaaggacattcgtttcactgttttaaaaagcaggagatggcttagtgtccatcagtagaaagctggtgaaagaaatgccagcccatcatgccaaaggaacaggaagcggctgttgaggaggatgaacaataatggttgtgctacgacctagagatcttcagggtcacagaactgggaagtcgtgggttatggtcttgctgatccaaattacaggctcttttcactgccacatgctgcctccctggaacacaggaactagggaaatgtataaccaagggttgcacaaaaccctttgttacacgtacttcatagaatcagtgctagagttcttctacgaaaggaaaaattcgtgtgggctaaggtgaacagagacttctgggaagcaatgaatggtgccttgaaagatgaaataagatttttccacagaagcaaagagaaatgaggagggaatccctgctggaggatgatcgtgagcaagcgcactaaggtggatagggagacacgtaagggagggagccaataccaatgaatacctagaaagaatcttgattgacaggtaccatagctcagcaaggtgggttgagccatgctacctgtcaatcaagatccttcctaggtattcattggccaagggctcagagttcaccaagtttaatgataaacccaataccatgacttttggggccctgtaccctgctatgaggctattaaagtgtcaccttagaaacacacagagtgtaaaataggtaatgttggaccacttcttcagctgccatcaggaagagctctaggaagtagctctcaacttcctgtggagcacctttgttgattggtgttaagacttagtccaccatgcatggaactttgccagccacattctaacttctgggattcaaagggtcctggctgggcacttgggggaacccactggccaccgctgctgccaggttattatttatctttatctcctgagcagcaggtagaagaggctgttagaaaaatgtcttcctggctggggacccccctgagattcattttctctttcacgtctcattttgggaatggaaaaaaaatcaatagagagggagtttgctttattttggttctggctattgcagacatgtatttctacagatacaagaaaggagtcatcactccgatgttttaaattgagcaccacctgggatctaaaccttgcattaggcacaaggctaactaagcattatggcagatttaaagaagcaagaagtgagttcagacctctaagtttgcgacacagtagaagaaccaaggtattcaaggagaaaaatagataataaagcagaacatgcttttgaataattcccaaaagtggggttaatagtcaataggtaaagaagagagaaagatcactgaggactaaaatgatctgggctggcttatggaaaaggagaaacttgggctggtcccaagggattaagcaagacttataggaggaattacaggtaagacaaaggggtcggcggggcgagtcaagcaaagaaggggagatgactgtgttttgaggccaaggatcccattattcagacaaacctgggtttggatcctagctccagcagctactaagctttcagacttgaaccagtaagttaaccattgagtctcagtttcctcaaatttgaaaaaaggtccattcataccaatatcacagaatcattatgagaatacatgagcaaacagagacctagtacctagcacataccagagcctcaaaaatcttgattttctttcccttccattatgttaatcacctcacttccttcccaccctatccctggtcccccaccaatcatttattccctgctaagagctttctgagactcactgacaggcatctccttatctggctgtgctgctggcccacctctggccagaggaaagtccagaggctatttccagcaggaggaggaaggctgccagatgcagtgttatgactggaggatattggcagcatcactcatcccatcccagtgttatttctcagctcagttattggataggaactgaatccacacacctgcccactttgctagtgttactcatttctctggcagtgacccttccctgccaaaccagactgtccacaagtccgttcctgctctcctgagcacctggttttgtttctttgaggtcagcattaggttcatttttctttacatctcaagagtgatggatattggctttgcaggaattgtaaatatgcagggctttctcaacagagcagctaagagcgtgggctctggagttaggcctgggcttagttctgcctcttacactaattttctttgtgattctgggcaactaggttttcgtgtcagagcctctaccactattgctgtataacaaaccactccaaactcatgacaaaaaataacagttattttattaagatcatggatttcatgggtcaggaaatttggaaaggggcaccatggatgacttgtctctgcttgtatctggagccttcgatggaaaatctagaagactgtggataacttgacagctgggggaaggaattatctgagggcttactccctcctttacgtgtctggcagccgaggcttttggcctgaatacctacacgtgccctctcctggctcctctgtgggcttcctcacagcacgatggctgggttccaagaacaagtgtcccaaaaagaagcaggcagaagctgtatcacctttcataacctaccctcaaaaatgacatagtgtgacttctgccattgtcacaaccccaaccagattaaaagagaaggaacatagattccacctttcagtaagagaagggtcagcatcgcattgtaaggtgtggaatggagggggtaggggtattgtgaccatctttggaaaatacaatctgccatactttatatataaaataaggattatatattgtggaatcattatgaagatcgaatggaataaggtatttaaagggcttagcatggtgctgacatgtaataagtgctcaataaaaggcatgtgctctctctctccaagtagaggactatatggcatttatagtcagtgattattagtattccatgtagtcagtgtttattaattttttgtgtccacaatagacaccagtgattacttttaagctaattaatcaaaacattagttccttaatgagtctatagaatggggtcttaaaatacatatagtttcttatctcatcatctcatattatactttgggaaactaaggttgaagaagttcacatagccggtaaagttagcatcgagcattttataatctaggcttggatgaagcatttttattgaaaatagctcaagtgacccttaacaaacaataagcaattttttaaaggactaatgtttagacttcaacacctttcaggttatgtaggaccttgaacatcatcataagccttggaggcaaatgaaaagagacaggaggagcattagttcttggtgcattcttattttgccacaggaaacccttcaagagatctgaacactaaaataagcccagtcactgcctctgtctttttgagactatgtaaactgctcctccatcccacgcccagagtctccatgtttaggcaatgtttgctcaatgtagtcagtaggacagaacagttaaagctagcaacattgagttgctgtgcctttgcatatccacctgagaagtaaggccaagaggaacagaatgaatgggtcatggtgtgtatttctttatcaaggctgtgtagagagcctggctagacaaggacaggagtcagaagatacaactgtggccatgtgcccatgggtaagtcacttttcttctcaggcctcaggtttcacacttcgaatgatctgacattctacaaaggaaggtgtttcctgagccctcatggccagttctgtattctccttagtaccataaagaatacatagaaataaggaacaccaagtctttccttttatgatgtgtatagtctcattaggaagataagactaacacacatgaaacagtgaacttacaaagttcaggtgtatcctgggccccaagtgccatccacgggtgacgcagataggagagatagacattggtagaaggtcagtcctcatctccatctgactcggatgggaaaaaggggagacacatgattaaaccagaagcaaatatatcagccttccctagtaagctaaggcttcttacattttaccatatatgttacaacaaaactcagacagggaaaagggaattttcttacttacacacagcagattcatattcatggtgatgcttgtttttatttaacttcaacctctttttttacttaatggactctttcctcttaaatttaagataacacattgagcaaacaaaggtatagataggagtgaagtttccccacatcttccccctttgacacacaatttattttctttttataaattttattaagatataacacacaaataaataagacacgaattataaatatacagcccaactaattttcagaaaactaattttcagtgcctgtgtaatcagcactcaaattaagaaatagatgatatcaagaatctcaggtaactctttttgtctccttcacacttctcccatgacaggagtagccgctcccctgatttctgatgcatagagtagttttatgaattgaactgtttttgaatctactgaatagaattatatagtatctattttttgtgtctggctctttttgcccaatattatattgtgaccttcatccatgtatcacatatagttgtagttcattcattctcattattttatagtattccattttgtggatataccacaatttatttattcattctttctggatgaacatttgggttgttcccagtgtaaggccattataaatagggctgctgtgaagattcttgtaaaagtcttttggtatgtgtatttctgttggatgcataactaggagtggaattcctgggtcaacttatatatattttctattgtagatgctaccaaactgttttcagaagtagcatacagatttagactcatcagcaatgtatatgagttccagttgctccacatttgcccttttccttttagcaagtagatgagttgtaggatcacattatggttttaatttgcatttccctggcaactagtacttctttcatatttgttagccatttgagtagctatcctcttttataaagtacttttgtaagtctcttggtcacttttctgttaggtcatctgttcttttcttattgttgtacaagtattcttcatatagccttgacataagtccttttttagttgtatatattgttaatattgtctctcattctgtggcttatcttttcactgtcttggcagtgtgtcatgttgaacagaaatacataactttaatgtagtccagtttcacaagattttttctttatgcctagtactttttgtgtcttgcttaagaagactttacctacctcaaagtcataaagatattcttttatagtttcttctgaaagtttcagctttaccttttacttttagatctaggtgttctataggtatgtgtgagagagagggtcaagattttttgtttgtttgttggtacatagatatcctattgaacttgcatgatttattttaatgtcatcctttcttcttactgtataccactttcacataaatcagttaccaaatacatgcaggtctgtgtctggattcttgattctgttctgttgatatagttgtctgtctttgccagggtattaccttatcttaactacttaagctttatagtaagtcttgataactggttctgagatggaagctggatgatcccatggggtacggggtgtagaagggattctcttcacatagagactcctacgagaaaatgtctgcagtgttttctaactgtgagatactatgattctgttggattagcaatgattgtggcttttctcaagggtctggaagaaatcaataacagactctatgttagtgatttttctgaacagtttcacacctaaaagtgatgggtaaagctcaggatcaggataattgtgggtagaaaagacatcctttagcatccaaacttggagcatgcaaaactctagggagtgccagaggaaaggcaaagaaggattaattatctttcatttaaattaacctaaaagaagaaattgcatttcaaatgagatagaaggtactggggggacaaaaaggaatttgccttgcattcaaaacatggttgcttttattgacccatagtctcaactcaatgtgtaaggaaagctgtgggttgcatcatcatatcgttagagatgaaaaagtaggggaaacagccaagatggctgaataggaacagctccggtctacagctcccagcgtgagtgacagagaagacgggtgatttctgcatttccatctgaggtaccaggttcatctcactagggagtgccagacagtgggcgcaggacagtgggtgcagcgcaccatgcacgagctgaagcagggcgaggcattgcctcactcgggaaacgcaagggatcagggagttccctttcctagtcaaagaaaggggtgacagatggcacctggaaaatcaggtcactcccgccctaatactgcgcttttccgatggacttaaaaaacggcgcaccaggagattatatcccccacctggctcggagggtcctacccccacggagtctcgctgattgctagcacagcagtctgagatcaaactgcaaggcggcagcaaggctgggggaggggcccccgccattgcccaggcttgcttaggtaaacaaagcagccaggaagctcgaactgggtggagcccaccacagctcaaggaggcctgcctgcctctgcaggctccacctctgggggcagggcacagacaaacaaaaagacagcagtaacctctgcagacttaaatgtacctgtctgacagctttgaagagagcagtggttctcccatcatgcagctggagatctgagaacgggcagactgcctcctcaagtgagtccctaacccctgacccccaagcagcctaactgggaggcgccccccagtaggggcaggctgatacctcacacggccgggtactcctctgagacaaaacttccagaggaacgatcagacagcagcatttgcggttcacgaaaatccgcggttctgcagccaccgctgctgttacccaggcaaacagggtctggagtggtcctctagcaaactccaacagacctgcagctgagggtcctgtctcttagaaggaaaactaacaaacagaaaggacatccacaccaaaaacccatctgtacatcaccatcatcaaagaccaaaagtagataaaaccacaaagatggggaaaaaaacagagcagaaaaactggaaactctaaaaagcagagcacctctcctcctccaaaggaacgcagttcctcaccagcaacggaacaaagctggacagagaatgactttgacgagttgagagaggaaggcttcagacgatcaaactactccgagctacaagaggaaattcaaaccaaaggcaaagaagttgaaaactttgaaaaaaatttagatgaatgtataactagaataaccaatacagagaagtgctcaaaggagctgatggagctgaaagccaaggcttgagaactacgtgaagaatgcagaagcctcaggagccgatgcgatcaactggaagaaagggtatcagtgatggaagatgaaatgaatgaaatgaagcgagaagggaagtttagagaaaaaagaataaaaagaaatgaacaaagcctccaagaaatatgggactatgtgaaaagaccaaatctatgtctgattggtgtacctgaaagtgatggggagaatggaaccaagttggaaaacactctgcaggatattatccaggagaacttccccaatctagcaaggcaggccaacattcagattcaggaaatacagagaatgtcacaaagatactcctcgagaagagcaactccaagacacgtaattgtcagatacaccaaagttgaaatgaaggaaaaaatgttaagggcagccagagagaaaggtcggcttacccacaaagggaagcccatcagactaacagcggatctctcggcagaaactctacaagccagaagcgactgggggccaatattcaacattcttacagaaaagaattttcaacccagaatttcatatccagccaaactaagcttcataaatgaaggagaaataaaatactttacagacaagcaaatgctgagagattttgtcaccaccaggcctgccctaaaagagctcctgaaggaagcactaaacatggaaaggaacaaccagtaccagccactgcaaaatcatgccaaattgtaaagaccatcaaggctaggaagaaactgcatcaactaacgagcaaaataaccagctaacatcatcatgacaggatcaaattcacacataagaatattaactttaaatgtaaatggactaaatgctccaattaaaagacacagactggcaaattggatagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagtttcataaagcaagtcctgagtgacctacgaagagacttagactcccacacaataataatgggagactttaacaccccactgtcaacgttagacagatcaacgagacagaaaattaacaaggatacccaggaattgaactcagctctgcaccaagcggacctaatagacatctacagaactctccaccccaaatcaacagaatatacattttttccagcaccgcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggactgttgtggggtagggagaggggggagcgatagcattaggagatatacctaatgctaaatgacgagttaatgggtgcagcacaccagcatggcacatgcatacatatgtaactaacctgcacattgtgcacatgtaccctaaaacttaaagtataataataataaaataaaattaattaattaattaaaaaaagagaaaaagtagaaaagttggtgttaagtagtgcattttttaaccagttgagtctaaggtattacacagtaaagagtgtgttggggcagttagattggaggtattggctaaatcacaaatcatccagctctctgcaaattcacagaaagagcaaactcatccatagccttgaaccacagagcaaacatttttctgtgcaaaatttggttacatttcatcttgtgaattttccacccctgtttatactgaaatgatagggctttgaaaagaataaacaacattccctttctgttgcatcaagacaaaaacccccacactcaataaatcaaaactgtaccagcaaaaattgaacaattccatcatttgctgaaacctctaaaaccctcaaatttgtttgagggcttctgtaaacaacttaatcaatcaatgttagcaaaaatatgtgttaggcacctacagtggactaagaactgaactaggtgagtggtggattctcaagaaaaatgtcatgtgtgaacatacacatgtatgcaattattgtttacttaattgagtaaaaaaatgcccattaaataatcgaacatttaacaatgtggggctagctctcttatccctattcttgcagcatcatagcagcctttatatactattacagttgcttgttcaacacctgtctcccacacattgcttctgaaaatttattgtgtatttaaattacctagggatcttgttaaaatgcagattctagttccatagttctggggtgaggcctaagaatttttatttctaacaagctctcaggtgatgctgctggtctgaggactgcatttcaaataacaaataacaaagctcaaggctgactccaagctccatgaaagtaaggacctttctgccttgcccacccctataactccagcacctcccaaagagccttgatgaatgtatgttgagctagtgaataagtaaatgaataaatgtcctaataaatagtattttattagcatgtaacagtacatttttacataggtagacatgagaaaagtttaacagtacgtgcaaaaatggagaaataagaataatgatggtctgatgaagtaaacaaggcctgatggagagaataacaataaaataagtaggaaagtggggttaaattataaagggttttgaaaactaggcaaaggactgaatgttacacaggaaataaagaataaattagtaagtgctcaataaaagaatggtggactgaaaatttccttttgaactgtttaatctggtgtcattgagcagccttgaaagtaaagcggtaggtaacacattgttgcattaatccaaaatggacttcataacgtcccggactagtttctaggcagttaggagaaggaaggaactgatgaaacccacctgtatttcaatggcataattcattttctcctcttatgtcagaatgcaactgctctgattaagccaagtgagccaagccctgtaacctagctttaatcatttgagggtttagatctcagattccaaggtaactagcacataggactttgtcagtcatgaggttagacttatgttcagaccaggttcaagtgagaatcctccctgcttctaggccctcttcctgaaaccttcactgtatggctcaaatctaagccctttaaccacgttgatcagactctatcacttcttccccaactctgaaggataaagtctaaacctattaatgtatcattcgaaccctgtgaaatttagcctcatctgcttctctctcttctttctctctctctctttctctctgtctctctttctctctctctctctctccatcttcatctctttctcctatattctggcctcttgtgatctgttccattccaaactcctgggccctttttgagttttcacctctctgtccttttgcctggagagtctattccatgctgtctctctaatatactccttcttcacaattcagctccaatttcactttctcaggggaccctttcctgatctcagctccacctgctaggacagcctgtagctcctgccttcaggactcctgtgtttttcatgcatttttactaattctagcacattgtctgtaattctacaatttttctccttttccaaactagaatgtgagctccctaaggcagaacccatttttttcctagctttattgaggtacaattgacaaataaaaattatatatatttaaggtatacaacatgatgttttgatatgtgtgtatgttgtgaaatgattatcatccataatcaagctaattaacatttccgtcattttacatagttatcctgtagtggggaacagggtgataacatttaatatctattatatgagcaaatttcaagtatgcaatgcattattattcactatagtttctaagctgcaccttaggtgttccggaacttattattcgttttataacttcaagttaatactctttgaccaacatcttatttcccccattccatgacccctgatatccacccttctactctcttcctgtaagtttgactttttgagattccacatataagtgggatcaggtgtcatttgtctttctgtgtctggcttatttcacttataatgccctccaggttcaaccattctgtcacaaattgtaggatgtacttcttttttaaggctgaatatatatagcacattttctttttcattcatccatccatgaatacttaagttgtttctatatcttggctattgtgaatagtgctgcaatgaacatgacagtgcatatatctttgtgagatgctgattttatttcctttggatatgtacccagaagtgggattgctggagtgtattgtagttttatttttacttttttgagggcccttcacattatttgctgtaatggctataccaatttacattcacaccaacaatatataaaaattctgttttcttcacatcctcaccaacatttgtcatctttggctttttgataataaccattctaagaattgtaaggggatctctcattctgattttgattagcttttccctgttgactagtaatgttgagcaccttttcatatacacattggccacctttctgtcttttttggaaaaatagctattcagtttcttgtccatttttaactaggttatttggggattttttgccattgagttgtaagagtgtcatatatagtttgaatattaaccccttattgggtatatggtttgcaaatgttttctccaattccatgaattgccttttcattttgattgcttcctttgatgtatggaaactttttagtttgatgtagacttgcttgttaatttgtgctttttctatttgtgttttgatgccatattcaaaaagttattgccaagaccaatgtcaaaaagcttttgctctatgttttcttctaggagttttacagtttctggtcttactttaagtcttaaatctgtcttcagctgattttttgtgcgtagtacaaaataagagttaaatttctttttttttttttttctttgcatgtggacatctagtttttccaagaccatttattgaaaagactatccttttccactgtgtattcttgatatctctttaatactgtaatggtggtatataaatcacttcttgctttagtataaaggctaaaagataaaagtaccaaaaataattatatttaaataatttgttattggtttgttatatatatgttgtagatccatttatcaatagatacataatataaaaacataggaattgtgacatcaaaaacaaaatgaagaggcaagtaaaaatgtagaatttgttaattgcatataatttaaactctaaatttcaaataggttcaaatagattgttataactcaaatagattgttacaatgctaagatgctttacataagcctccttacgtaagatgttttatgtatgcaaaaacctacagtaggtacaaaaaagataaagagaaaggaatcaaggcataccactacagaaaatcatcaaatcacaaagagaagaagaaagaaagggactacaaaacagccagaaacaatgaacaaaatgtcaatagtaagtctttatctttcaataattactttaaatgtaattggattaaattatccaataaaaagatatagagtggctgaatgaataaaaaagcaagacccaactacatgctgcctataagagacttgcttcagctttaagtacacacataggctgaaagcaattgtatagaaaaagatatttcatacaattggaaaccaaaagagagcagaggtcactgtatttatatcagaaaaaatacactttaagtcataaattgtaacaacagacaaagggcatcattatataatgatgaaagggtacattgatcaagaggatataataactataaatatatgtgaagtcaacatcagagtacctaaatatacaaagcaaatattaataggtctaaaggaagaaatagcaatataacaatagcagagaacttcaagaccccactttcaacaatggataacttatccacagaaaaatccataaggaaacattggacttgaactacactttataccaaaaggacctaacagactatatgcagaacattccatccaaaagtggcagaatgcacattcttctcaagcacacacaaaactttctctaggatatgatgcctacgcatttcccttctctgccccattttccctgatgttcacaatagcagttaagttacttatgttgttattcaccaacccttgctttcatgtaagctccccaattcctgcatgtgtaaattcccatccaccacagttctggcacccagttcagtgaccagctcatagcaggtgctcaataagtatttgttgaattaggggttgctcttaaggacccccctaagagcagagattgcccttgatatttcaccagagtaattttggaactactgaataaaaaaggaaaattgcttagccatgttagtatctagctttatagttctatctactacaagagtctcaaatggaggtgggagtatcacatgcctgtctgtagtgcaggagaggctctgtccataacttatatcagttcaccatatagttatgtaaatgctgtcttccaagccatgctatgcacaagggaaggatatggtgataaataagacacattccttactctcaaggatttcagttactatcagacaattacaatgtattgtgatttgcactatgtcaagagaagagccagaatttatggaaacatggagcagagaccttaacccagatcaggggataggccagggaaggctttctggaggaagttgcatttaacctaggactagaaggatgaatgggtattagccaagtgaaaaggcaggggaaaggcatttcaggcagaaggaacatgtttgtgagccattgtcaggaacttggatcttatcttaaagatgatgggaaaccatttaaaagtttccagccagagagcaatttgatctgatttacatttttaaaggatctctctctaacttagtggttctcaactgggcatgatttttctccccaggagacatttttggatgccacaacttggggatgggagctactggtgtctaatgggtacaggctagtgatattgctaaacaccctgcaatatacatgacaggtccccaccacaaagaattatctggcctcaaatgtcaatagttcttaggttgagaaatcctgtaagctgatatatgtaaaatagaccattacagatttaaagaagggtgaccagttgggaggatattgtagcaggaagagccgcagacaaaacccctcagatactgagttaaagaagaaaggggtttattcggccgtgagcatcagcaagactcctgtctcaagagccaagctccccaagtgagcaattcctgtcccttttaagggctcacaactctaagggggtccacgtgagagagtcatgatcaactgagcaagcagggggtacctgactgggggtcgcatacaccagtaattagaacggaacagaataggacagggatcttcacagtgcttttttatgcaaataaccaattaggtcaggggtcgatctttaactaccagggccagggtgtagcattgggctgtctgcttgtggatttcatttctgccttttagtttttacttcttctttctttggaggcagaaattgggcataagacaatatgaggggtggtctcctcccttaatattacattagtccagacaaataattatgaatttggatggggtgactgctgtggaggtggtgagaaataatctaatccagaatacatatttaaaaaataaaaccaataggatttctggtcaattgggaaatggagcatgagggatagagaacagttaatgttttaggtctcagtaatgcaaagaatggtgatgtattttactgagatggggaacatttgtggagtgacaggtgtatggaatggagagaaatcaaaaattcaatttccaacatgttaggtttgagatgtccattagacatacaaaaggcaatatggaacaggctcatgagtctggaggtgagggagaagatccagactggacttcagtattttaggaatcatcagcatacagtatttaaatccatgggactgaataagattacatgggactctagtgcagaggagggagccaagccctgagcccttgaacacttagaagtcataaagagccatcagaagggactgagaaggagcagccagtgaggttacaaaaacacaggaaagtctggagttttagaaaccaagttaaaggagtgtatcaaaaacgatgccataaatacctatcaccattaaaggagttacgtaattctttctataaagagactgaactcaaattccaatgcctttttatcaaaatgcatatgtatatgctggtatttatgccctctgttatcatttccataagacaagagaagaagcattaaccaactgaaacctttaattaaaattcacatagaatgaagttgggaagggaacctgggcagaggcaagagccttttgcttataagcaagatgtgattaaacccactgtgatagtgattcatagttcctgtttatcaaggagacaggctcagcctctagccttatgtatgatcgctggatgtttgggggtagctgaacccagaactcattttaatgacatctccctggattcaaaaatgtttttattcttctctaatgctttaactttgagagatgatctgatcctgaatgttatctttgatggctcaaagtacaattccctagagtgaaatcagatcgtacctttgggttctcttaattttccaagacttttacacctctgaatgaggattgccctgaaaaaaatatagtggacgctctaatcctacatcaatcaaactccatctctccttccacccctcctcagttatttgcataaaatactcaatttggttggaacacggtacacacacaacctcttgaccatgcttcaaactaagatagatcctgcaatggactttcagggtgaacttgaacaaatattgggatcattagagaatggtgctctctttggcctaaaccctggttctatcagtaaaatatgtggaagaacaaattaagatcagggatgtattgggttaggctgtaagcctcgaagttcaggtcaatcttcaattggggtggacggggaatgtggtgatatgaagtaaatgcataatatattatcttatcatagtaataatcactaccttgtttatccagtacctgaaagcattaatctcatctcatcttcataacaaccttttgagttaacaattaaggatactccatttttctggggacgtgtctggcaaccccggtgaaaaaaaaaaaaaaaaaaaaaaaagggatactccatttttccacatatgaaacaatttggagctcggaaagattacataaattggccaagaccacataattagtaaatggcacaactggagtcaaaccccagtcaatgtgattgccaattactgtgtgatccttccaaagcaatacgatggaaacaaccctcagcttgatttgccagtcaggatttgccatctaaaactggctagaacattaattttgagggtgactttggaaaaagtcatttaatctctcagcctcagcctggttttcctcacctgtaaaataatcaggacgaacttccagtacttgtgtctgattctaacttgttatatcagaattttaagccctttcatttgcaaaaagtgtctgtattttcagaatacagtcatctattattgtatttgattcttacaacaactatgaggcaagcaagcattattccttcttgtgttttacatacagatggggaaacaggcttgaaatgaagtaggtaccttgtccatggttaatgcagctgctccccagtcaactgctctaatataccaggtacctcgcctcctcctttatctcaggcatttttcactctcccagggcctaccccatttcttattcccaggaagatttccattgctaatttaaaagttaactgctaagaggctaaaggaagggtatacataggggcccctatccccaccagggtgctaaactggggctgagggacaggagcaggccagacccagctccccaggaacagcgactaagaaacagagacacagaccaagaacccatccagacaggatgcagagaaaggaaactttctgtaggacattcctataggttgggaagtgcaaggttgtggatgtcattgtccagggaagtctggtagctggttctccatcagttattctgggaaaactcctactaaaatgttttctcttctagtgcttccctcctcagaaaatgtcaccactctcttctgagacaccccaaccagaaacctgggagacaagagtagggaaagggtatcctcggggttaaaaggtgaactctggacatagactgtgtgttaatggaaatacacctaaccttgccaagcttcagtttccccattcataaaatagcgctaaatatgacttccctcatagtgtgagatgaggaataaatataaacatcttgtagaattcctggaacaaaatagtcacttaaatatggagccctcaaaaaactagtgagctctattcctcaccccctgcatccaatcaatcttcaaatagaaattctacctcctgattccatttgggtttgttcatttttcctccacccttgctgccatgatgtaatccaggtaatcatctctgatctgggctcctataatgttgcgtgttcatctccataccttctttttttttttttttttttttttttttttggagaaggcatttcgctcttgttgcccaggctgaaatgcaatggtgcgatctcggctcaccgcaacctccgcctcccaggttcaagtgattttcctgcctcagcctaccaagtagctgggattacaggcatgcaccaccacgtccggctaattttgtatttttagtagagacggggttttaccgtgttagccaggatggtctcgaactcccgacctcaggtgatccacccacctcggcctcccaaagtgctgggattacaggtgtgagccaccacacctggcccataccttcattcttgtttccaccttaccctaattcattctccattctgcaaggcagggatttctccaaaaaaaaaaaaaaaatgtgaatgggctctattctccatcccttaccaccttgctgctgcaaactccttctagcacccagggccctgcttggcttcattcctcactgccctgcacctttccaccaaggatctcattgtatcacctctgccattcttccactgggggaaccatttatctctttcactctcactcctaaggtctttggtttttgttattttctctgcctgtaacaacctttgccagcatccaaactttctgtggcgaactcattcttcaggtctcagcttagaaagtccctcatctggtaagcctggaaagtgtcactagcacaaggcctggcacatagaagcctcctgataaatatctgttgaataaatgtcaatgacagcatcaaagctgactcaatgttgactgaggacaggctaggctcccatctgcgccagggttcagcttttaggttatagacaggattcagagctgtgagatataaaataatacaggctttttcataacattcccactgggtcaagagcatactcacagtaaattacaagtggtccactcagcccctgaagaccaggcaaatacctgagacatgtccttcccctttaatcttttctcaacttcatcctccttcccacaggctttcctttctcacttaaacccaatcagtaagacacatgacatctctcatgggaagaagatttatgatatctctggaaaattcttttttaatctgccatagctttaaaaacttgagttttcatggctgctaattagaactgtcagtataagtcactgaaaaaagtgcaatctcttggaaaacaaaaagaaagtaagaaagtactctagccatttccattatgatttatgagacgtgttgttgatgatcttattaatatctttttaaaatatatgctgattgctaatgttctctataataaactggcaaagcacatgcaaatccctattgatacactagttttgggaacacatgggtggatataagcaaagaacaaatgtttggcatctaaagtgaattttgttttcaattttgtgttccgcccaaggaacatttgttgactgactaatgtattagggattgcaaaggattcaaagttgaagatctcacccctaccctccagctgcttacaatctagtacaggcggagaggagaacagcttcaacaacaggtagcacatataaaccaggtaggcagagtgagataagggagacaggtgtggagggctagatggagaactgggcacagcagcagactgcatgcatgaggtcagaactgagctgagcctgtcctctgctgcactctcagcacagtgtcaggcacatagtagcctttcatagtcacagcagggacgaaggaaggatagaaggacagttgggtccaagttctaatcctgtcacttagaggaatgtggccaaccactatcttttctgactcaagctcttcatctgtaaaatggcaactgggggaaaatacttcttcctagggagttgctgtgggagaggaacttgtggttgtcatgaaagttgtccaccagatatatccagctctcttccttttatgcacaaggcaaaattgctggtccatttccatactgatgctagttgcagacattgtatttcatctggccagtgaactatgaacagaagtgatgtgtgtcactactgagaagaagctttaagagccagtatgtatgtcactggggatgttccagatggcagtttctctgtcattcttagccccaggaaagtgtggtaggacaagaacctccaaccagcctgccatagatacgtaacctgagcaagaaatacatctgaaaagacaacaagtcttggcagggatgtgaagaaattggctttttttttttttttttttttttttgagatgatggagtctcactctgtcgcccaggctggagtgcagtggcacaatctcttctcactgcaagctctgcctcctaggttcacgccattctcctgcctcagcctcccgagtagctgggactacaggcacctgccaccactcctggctaattttttgtatttttggtagagatggtttcaccgtgttagccaggatggactcgatctcctgacctagtgatccgcccacctcggcctcccaaagtgctgggattacaggcgtgagccaccgctcccggccagaaattagaattcttatacactgtgagtgagaatgaaaaatggttcagccactatggaaaacaatatggaggttccttagaaaattaaaaataaaactaccatattatccagcaatcccacttctaggggtacttatacaatataattgaaatcagcattttgaatatatattagcactctcatatttattacagccctattcacagttgccaaaatatggaaataacctaaatgtacattgacagatgaatagataaagaaaatgtggtgtacacatacagtggaatatttttcaggcttaaaaaaggaaattctctaatatacaacaacatggatgaaccttgaggacattatgctaagtgaaataagccagtcacagaaggacaaataccgcatggttccacttatatgagatatctacaatagtcaaatgcatagaattaaagagtggaatggtggttgccagggactgaggcagggggaaatgaggagttactaatcagcaggcataaaatttcagttaagcaagatgagtaagctctagagagctgatgcatagcattgtacctatagtcaacaatactgtgcactgaaaacattttgtaagaggataaatctcatgttaagcattcttaacgtataaaactaaagctttttttaaaaaaaaaaaaaaaagaaaaagaggaaatatgcctagtgtgttaagccaagatctggggatttgcaggctgtttgttatcactgcatagcatatcacagcatacagaatttaacagagaaacccctttatacaacctaaagtttaagtaaatataatagctaggaaagatacgaaaaaaaatatgttgctttagaagagattgcacctggctgagggggtccagaaaaacttcttgaagaagttgtcattggagatggattttgaagtgaggaagaatgtctaaaggcacatatggggaagcaagataagaagaaggtaggagtgtgcaggaaggaaagtactcagaatggacagggcggtggatgactaacaatagtcacgagaagtagcataggttaccactcactctgtcagtcgctgtcctgtgtgacttacctgtacttattcttattcattttccatcactgccataacagaacttaaatcttacagcggcttaaaacaaaacaaatatattatcttacagttctgtagctcaaaagtccagtatgggctttgcagggctaaaataaaggtgtgagcagggtgatatttgtttctgggacctctggggagaatatggtgttttgctcattcaggttgttggcaaaatccacttcctgtgtttgtgagactaagatcttggtttctttcatggttctcagctaagggctctttcctgctcctagaggatacccttagtcttcgacttgtggcccccttttgctcttctccaagccagcaatggaagatcaaccttctctcatgctttatatctttcctatgtcttcttctgtcttactccttgagcaactcttctgccttcctctttcaatcttaaggtccaacatgattgcattgagtccacctggaaaatcttcctattttaagatccctaaccttaattctgtctgaatggtctctttgccttgtaatgtcacatattctcaagttctagggattagagcatagatgtttttggggggcaaattttctgcctatcacaccttactttgtgggtgaggaaattgaagcttagtgtgcttaggtaacttgtccaaggacaccacccagttcttggcagaatggcttttgatcccaagcagcctgaaagtgagcctttattcttaactgcctcttcacccagaaaatagagaggagaaaagtggagaccgaggctaaaatgatagattaggaatttattgcagacatcgtcaaatggcagacacaaaaaaatggcttaagggagtattgtataatgattgtcagtcaccatacattagttttccattgctgtgtaatgaataaccacaaacttagtagcttcgacaacacccatatattacctcatggttctataggtcagaagtccagtaggctgtgacttgattctctgctcaggttctcataagactggaatcaagatgtcagcctgctgagctctcctctggagcttgggggttctcttccaaactcctttcttttattagcaaaattcagtttcttgtagatataagactgaaatccccattttcttgctggctgccactggggaccactctcagtttcttgaggccatctcagatacttgcccatggcccctccaactcagtgataggaccctccctcaaattaaatccctcccacttcaaatctctctgtcttcctcttcttcctccagatggagaaaattcttcttttaaaagactcatgtcatagattaggtacgcccagataatgttcctgtcttaagttcaactgattaataaacgtaattacatgggcaaaagcaaaatcccttttgcaattgaacataacataatcatagcagtaacaccagggggcagaggtcatggggcgatcttagaattctgcctactgcacatcctatgcataacggggtggataatctcatgctcattggacatatgtggagcacagaggttaaggtccaatggcagagctggacacagggcccaggtcctagtgatgaacataatatcatgtcccagctaggaagggctgcttctcctctttgagaactggggaagaacaattcccatttcctgagggtgaggatgaagttgaaggttccttggtgcctctttcaactcagagcaggcccagagccggctgtgtctccaattatctccttgttagagggagggcattctgagtgaggacccctgagaaaaagggggagagatacaaagttggcatttcttatcgataataattcaggcaaatttatggcaacagttcaccaagagtggaaacctgtctagatctgtgagaacattagtcttttataatactttaaagaaaaaagtttgttattttaactttgtgcaataatttgctctataacaaatgctttcctgagtaaagattctgaggaaacatgatttaatgaccctgtaagaattatggatgtatttcgattccactttcccaaaaatgggtgctcctcaagtgtttgaaatcagtttattcactcagaataaatgatcccttgtgcaatcatgtttttgctatttattagcttaagaagtattttccctacagaggaaagcgttacaaatttcctacttatggagtttcacattcactcaacaaatattgagactgtacagttattaggttctagagaattatgaagaaatataaaatcctttaatgatttaataatttagtgtagtgctaacaatgaataggaggaaagcaaggagtgctaccaacaggaaaagtagaggagttcagagaaatgagaggtgagcgtaggaagcagcagccaggcaggcttcttggaggaggtggcacttggagctggactttaaatcattcaatccagagtccataccctagcttcggaggcaatacttgacttagtccttccttcactctccagactcatcctgtgctgccaatcatcttgaacacatgaaggcttttcctgcttcagaacctttgctcttcctgtttccactgtctagagtgtgttcctctagatttttctcacgtctagattattctcaaccttcggctctccgcttaaatatcactccttcagagaggctttcattcactgtcatgtttatgttcgtcccttccttctctcttcctgactgtatgcctcccatcaagttagaaattacaaaaaaaaaaaatagactgggcatggtggctgacacctataatcccagcactttgggaggccaaggtgagtgggtcacctgaggtcaggagtttgagaccagcctggccagtgtggtgaaaccccatctctactaaagatacaaaaaattagctgggtgtggttgtgcatgcctgtaatcttagctactagggaggctgaggcaggagaattgcttgaacccaggaggcagaggttacagtgagccgagttcacgccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgagagtggtaactgcttctaccaggtatctacacttgtccagataagcacattgtgcttgtcctcacgacagcccttttaggttgttcctgttcttatccccattttctaggtatccccatttcacagctaggtgaaaccgaggctcagagatgtgaaatgacttgcccaaaatcacacaagttaacaaatggcagggggcaggggtaggaagtctgtgcggctgctgaacttccacttaataattctctttactgcctcggaaagagctgagtgtccctttgaagaattggctggggagtttctgagtaaagagaggaagagagactgtttcctgcctccgactgctgttctgctagctcagttggggatatgtgggagggagggactgagtgtgcagggaactgagtagggtgaaaaaatacctggcaaatggggattttcaatgggttattttaagtaaaatcgctccttttaatatgtgccttgtgctggagttaacaaacgttaattaaagcagaagcgcatattgttattttatctcccatttgcttatgggtcggggtatatttttaaaaagcccacaacatcccacatttaaatatgttcccagtcctaagaacttcaaatgccagagatatgtttggccacagatgacaatgcaggcccacacctggcccactgaggcagagaccaaggcccttggagcccatctcacctctgaaaatgagctgatggatcagcagatagtaagagctctggaggtgggggcctctggatgcagagaaaccatatgttttggtattatgggccgtccggcaggcagctataaaaagagaatagcttcttctaagaacttaagcccaaaaatacacagaaggaaatgggaggaagtcccatttataacaagagtgtgttgccaaatattcttttgtgtctaggaactgtggtaagtggtgcttgagacctgagaaggtaaatctcgagaaaggagggtggtgaccctggtctaagctggaccccttctcagcacagtgaaaaatcacatgagtggaatcagatggatctgggctcacatttcaaccccctcacttgttctgtgaccttaaataaattatttattcactctgaatctgtttcctcttttaacaaaaagggatgtgttagtttgttttgcatcactataaaggaacaactgaggctaggtaattcctaaagaaaagaggtttatttggctcacagttctgtgggctatacaagcatggcaccagcatctgcacagctcttctggtgaggcctcaggaagcttttactcatggcagaaggcaaagaggagcagcgtgtcacatggtaagagagggggcaagagggaggaggaagtgccaagctcgtttaaacaaccagcagttgcatgaactgatggagcaagaactcactcattaccatagggagggcaccaagtcattcaaagggatttgcccccatgacaaacacttcccaccaggccccacctccaacattgacaatcacctttcaacatgagatttggatgagacgaacatccaaactctctcaggggatacacccacctggcccaaagaaagagatgggaattagataaatgtcaagtgtcttccatagcatccagctcagagttggttctcagagaacagtggctatgatggtgaatatgtttggggcaaagtgaaattgttgcttgttcacattcttgtccaagcttccacaccatagtacaggctgttcctgctccaagaaatgcctttctttctgtttcagaaagctcaaagccagcctgccctgcagagcccagttacgtgacatctctttccatgaaacctttccaaagttttcccagtggggtgtagcctttcccacctctgcatgtccttagcacttaatcagtgaccatccatgctgttcactgcagcacaactatcagttgtttctgtgtgggtcacatctcttctattaaattgattttctcttaagtatttcccatcacgcttggtgtgtagtcagtcctcagtaaacatttgtgtaatcattcatttattcagtgtatgttcactgagcacctattgtgtgccaggcactgtgctagtgctgagggtgtagcagtgaatgacattgataagacccccgccctcgctgaagttacacattagtggagggagatagatagataataaatgaataaacaagtcagttggtacatatgtaattatataaagatcacatatactttgataagtgctatgaaagaaatgaaaaaaataagagaaaagatgggtgatggaggtaatgatacttagagtggtgcatatgaagaggtgacatttgaattgaaacctgaagggtagtaggaggcaggtttgggacaatttcagggaagtgagttccaggtaaggggatcaacaaaaattgcaaaggtcttgaggtgggaaagacttcggtgttttctagaaacaagaagatcaaagtggctggaacatagcatggaggaaaagacagtacaagaggagacaagacgcgggctggctcagggagtgccttggtagaatatttggattttatcttctaagtgggacagattttaagtggggtgggaacaacatggtcctacttatagtttaaaaagatctctctggctcttgtgtgaacatggattgtataagaacaagagaagaggcaaggaaatgttatgctaggatctactatctggaatgctgcctatgaagatgaggggatgattggactggatgggctggatgtgtgggtgagggaaagagacaagtcagaaatgactccctggtgttaggctcaaatagcagggtggacagtggtgccatttcctgagatgaggaaaatggagaagaatgagtcttctatttatttgcacattttttgtgagggttcattgagaattttgaattggatacttcaggtctaaggtaccaagtaggcagttaaatatatacatttaaaaaacaggataggggatagagatctaaattggggagttttcagcctctgtgtatacaggccatgtgtccggaggagatcatgagagcaagactgtagacagggataagaagagggctgaggcttgagctttgggcacagcaatagctcaagattaagcagaaagaagaaaccagcaacggagacaaccagcaaagataagccaacctgtgaggcaggaggagacccaggagagagtggggcctaggagcaaagagaagtgttttcagaagaaatcattgtcatcatcatcattatgagtaacatctttagctctgccgtgtctgtgctaagtgtgagatgtgacttactaacttcacaagtcatgagatgggattcattatctccctttttcaggtatgaaaactgaggcttagagagagtcctattccatttgtgttgctataaaggcttacccctggctgggtaatttataaagaaaagaagtttatttagctcacgtttctgtaggctgtacaagaagcatggtgccagcatctgcttctgatgagggcctcaggctgctcccactcacggaggaaggcaagggggagctggcatgtgcagatcacatggagagagagggagaaagagagaggaagatgccaggctctttttaacagtcagatcttgtgggaactaatagagcaagaaatcactcattaccaggaagagggcatcagacccttcatgagggatccacccccatgacccaaacaccttccaccaggccccacctccaacactggggatcaaatttgaacatgagatttggagggacaaacatccaaactatatcagagagtgaaccaaagaatgaatgaatgaataaatgaatgaatctacacccatttttttgcaaactgcccacactacactcccatagcctacctaactggaaaaaaaaaataggaacaaaggacgattctctttgaaatatagccctgcaagtgctagaatagtacaccagcttacagagtactgggctttccttagagcttgttgtctaacctccagccttccaaccctgagactcacccccagagtccagggccctcccccatctggagtgctggaacacagtgaccggcagctggggcaattaaaatgaatcactccagctctgccagggaagagctgagtgatttgcagctggtgacaaatgggatgatttgccactcagacgcagcatcttggatgaagtggcctcatcagtggaattgttgcatttggccagcactaattaccctggtctaggaacctcgatgcccagtatcaagtgagcctctctctgaacacagctcagctcagtaattagtcaagatggacttttttctcccagtaatttagagacaggccatctgagcctgtgcctttatgcccgttttcattcctttttataaatagccatttgaagaagaggacaaagggaaataggttgcactcagtgacctcttgagctcagttgaatgaaggcacacaggaggtgtcccttctgtccccttcctcttggggatgacacgacgtgtttttgaaataaagaagaatgtccatatccaactccttgtcagagatgtcctagaggggaggctgctgggatcaagagttgattgctgcttaataactttccactccctacacaggccccaagtgtctgctttcctgaaggccccctgccttagtgtctgctccccctgcccctatacccaggttgctgctcctcacactgtgtgcatacctccatcctgaagggcagagagtaactctgccagccactttgctacctgctttattagtatttttctttttaattcttaagaatacctgtaagatgagtacaaccattactccattttgtaaagaactaagcacaggccgggcatggtggcttatgcctgtaatcccagcactttgagaggctgaggcagccggatcacgaggtcaggagatcgagaccatcctggccaaagatgatgaaaccccgtctctactaaaagtacaaaaaaaattagctaggcgtggtggcgcatacctgtaatcccagctacttgggaggctgaggcaggagaattgcttgagcctgggaggcagaggttgcagtgagccgagatcacgccactgcactccagcctggacaacaagagcgagactctgtcaaaaaaaagagaaggagaagtaagcacaaagagatgtagcgatttgcccaaagtcatacaaccaataagaaacaaggcaggatgcccttcagcttcatctgaaccctgagcccattctcttgacaaacaatgacagtgccctctgctttctctctaaggatcacacaataataattttcaaacaaataatggcaataggttttctgggtgtttgtgcagaagaactaataactggatagatggtttttaaaatatgtcaactactgttgcatattagcttagatcaaaggtctctgatattcgcagtagagattgagagcaggagtcagcaaactatggcccccaggccaaatccagcctgccgcctgttttggcattcaagtgttactggaacacagccatgcacttgcgcttacatattgtctatggctacttttcactctgcaacagcaaagatgagtagtgcaacaaagaccataagacccacaagcctgaaatattcactacctggactttgacagaaaaagtttgctggcctctgtttaaaagcaacaaatctaaactgtgacattagaagcacacatttaaaggcctgcaatgaatcctaatcaataaccagaacaagaaatgcctatcggaaacccagagaatggtcccatcagatccttactatcttccgttagcatcaagttatgccctaaatgatacatacactattttgttaacaaaaggaaaaaagatcctttgcaaaaagagacagcctgcttccagcaccttactcccagaccatgtccgaattcatttacccagaaggcgtgaactgtccattgagcatctttcctctcccacagcccctgctcctgtggatcacttaatgctatcacttggatctcggcagtcagcccgccccttcccatttctgtgggctctgcagtacttttcacccatcatcatcattgttaatcaataaataccataaacaatcatgatagtaacaccttaaatcaatacagccgagtgattatattgtaatggaagaatgatagtggtttaatgggaatacagaaggggtggctcagaactatgctggcaaaagttggggaagtttacagaggaggtgaaatcttactcacctcttctattttatatctatctcctggcgttctcccacccctgcacctgtctgcttggtgatctcccactcctacttcaaaatctagcacaatatctcctcttctggtaaattttcctgacctctgctagcagagtaattagcaagcccttctgtgttccttccatgctactttcttacttgtcatgtaactaagatagtagaataattattgtctatgatatttacacaagatgatgatgatggcttaacagagtgttaaatatactgtgagctaacagtactgtgctgagcactttgcaggaaatccatggtgtctaacattaaattatatgttttttaatcagtaggctccactgccttcctatcttctctatcagactgtgagcccatggaagggagagaccatggcatattcacttttatctcctcagtgaccagcagtgtctgccatataggaaatgcttgcaaagtaaatgaataaatagtatggtactcacaatcctagagattcccgtctcctggttcttcaaccaaacactaatctatgtaatgctatgaagagattttatagaggcaattaaaatctcaatcagttcagtttaagacacagagattatctaggtgggtctggcccaatcaggtgaactcttaataagcaagaagtcatctccagctagtggaggttagagagattcaaaaaatgagaaggatttgacaccctattgtgggcttaaagatggaggaagtcaagtgatgagaaatgcagcaacctctagaagatgacagccagcaaggaaacagtgacctcaatcctataaccacaaggagatgaattctggcaacaaccagtgagcttggaagtgataagaaccacagctccagctaatgccttggcttcagcctagtgagaccctgagcagagaatctagccaccctaagacagacctctaatctacagaactgtgagataatacatgaatgttgttataagctgctgtgtttgtgtcattgtgttatgcaacaatggaatacaaatacaagcaggaacacaatacaacaatggaataaaaatccaattatatcagatattggtggtcagactgctgaccaaaggttccgctgggctttgaagaagtcagtgctgctgagatccaacatcacaggagtcatgagttaaagaagtccatgtccacccataaatgaatcagaattaggtgagggaggtagtgtcctgcagtagctaaagtgctggataagaaatatgaaatcccagtttctagtcccagctctgtcattgccttactgtgtgactctgggctcgtcatcttaggtctccgaattatagttctcttatctccaagatcagaatattcctatttctcccatccattttacagggctgtaaataaggttgaagtaagataatagattcaacaagccacataagttatagccaattctgcaggaaaaaaaaaaaaaatcctcaaatacccaggggggtttgggaaaagccatgccaagttgcaaggctaataaaattcaggtgactaggcagacagacctccaagggcttcagatcacagctgtttcttccctgccaagaaaagtgctgctttgccctgtggctccctgggaggataatcatcttcataaaaagtaatgctttgtgtttcaacagaaatttccaagtgctttcccctgtaccagtttaattccagcagcttgtatcagttaaaggaaagaaatggactgagtcgttctagttttgaaagtgttggtttctcacagtgaaggagggtaagtctcacctattatacagagcaggaagacagaggcccagctaggcaggtgactcaccaagttgtggagatggtcagtgaaagagaaaaggctctcattcccagccctggcctctaataattccagcttcctgcgtttagtatggagctgggaaaatgtaactttcctggatagaggcccagcttcacctgagccagttccaaattgaaggtagggaggattgccttgccctcaagttcttatcttgtgaatcacatgcaaatgaagcattgggattaagtcagactttgaacttcttcccctagctctccagttattccaaaaatgacagttgctggctgttaagcagcaaactctttctttggtatcgtcattcagtaggcggggatgtagggactatcgttcaaggtaggctgctataaacaacaacaacaacaacaacaaaaagaaaaatgtcaattaaaagagaacagggaagaaggagtcttaggtgtgtggaacttttgtgggaaggctttgggcttcactagatgatcctgaacttgggatagcttcgctgggttcttcaatttagggatgttagaaaaggaggcagccatcctgaatacttggtttgatgccatgactccagacactttggaccataagcagttttggattctcctcagcctgacaattcttcccacggtccaaaatccaatgtgcatggagatgccaggttataagacagactatttatgcattcatttactaatgagggcctgctccatgctgagcactggagatacaatgctacaccaaagaactaaaagattcctttgctttcatggagcttatggtgtaagggaaaaaagacaatagaagaggcaaacagatgccatagttctgctgctatgagagctacatgaggctctgagtcttacggctgaatactaaaaatgtaatgattaggatgaggtctgaaggatgaataggggctgatgcattgatcaggggaaagagaagcatgtgataaggatgggagtcttttgaatatgaggggccaaacaaagagcagtatgaccagagtacagcaagtatgttgctgggtgacaatggagagtgagccaggggccagatcacacaaggcctcgaggctcatcagagtttgaatttattccaagtgttaagagaaaagctttggtgagttttaagcagaaaagcaacatggtgcaattaatatgtttcaaaagatcactctggctaccttgtacaggtggccttgtacagctgggcagtaggggcatagaggactggatggaggcaagaagtccagttcactctcaagtgacatcaacaagatggcagagccaggcacagtggcacacccctgtactcctagctacttcgaaggctgaggcagggggattacttgagcacaggagttctgggctgtagtgtgttatgacaatcaggtgtccacactaaatttggaatcaatatagtgacgtcccaggagcaggggaccacgaggttgcctaaggaggggtgaactggcccagattggagttggagcaggtcaaaactctgatgctgatcagtcatgggatcgcgcctgtaaatagcaactgcactgcagcctgggcaacatagcgagatactgtctctaaaaaataatacataaaacaagatggcagaataggagataacctgctcatatccccctaacaacaataagaattctgcagccatccacaggaaaaaagtctctctgcaggagctttgagattcaggtaggaggttataaaacactggcagagcccaagacctaagaaggctgttttaagagtgtagaacagcacccaggtagcaaacttgagcatgctcttaggttcaaacctgtaaacaactttgttcctcaaagggcttggcttcagccctatttggctttgagcctgcaaccaaaaccatctgtcaatgggtccaggagaaatcatgcaccttcgtgcctctgcagaaagttttgtctgcctgatgacactggtcttgccagtggatctgaaagttatctggcagtttggctccagccccccaacagctgcaggcccagcttattaaagcttgcacaaggaaccagagggaaactcactcatacctcacagaccaggaattgcctgtccataggaacctctgtgatggccaagaagattccatcccacagcagatccagagggggcccagtctcagctttcacccctcttgctacagttgggaaactcccccacccatgcaggaaattagttgggaagtacacacatctgggctactggggtgagctcaccagcatctgtgccacagtggatcctgagggggcccagtcttggctttagttccacttaaactgcagtaagagaactgccctggccatacaggaaactgctgggaagcatacatgtctgcaacactgtaggcagggttgccaacatctgttccacagctcctctcactatagccaggaaattgtcccacttatgcagggatctgtcaaaaaacacaaagccatatggaccagtgagacaggcgtctgaactcaggttcctacccatctttcccatacagctccagtacccgccttgactcttctctaggtccaaccaagctggagtaccatcccaacctctaagccttcacaagacttacagagaaccctagattaggataccctctagtgttgaaatagctgcagcagtcacagactctgacaacaggttagattgtcagagtcacagactctgacaacagatttctggacaggccaactgaaggatgagcacaaacaaagccagattgcaaagactagaataaatatctaattcttcaatgtaaagagattgacatacatccacaagcattaagaacaatcttggaagtatgacctcacctaatggacaaaacatgacaccaatgagggaccctaaagagatggaaatatatgatctgttggacaagtgattcaaaatagctgtgttaaggaagctcaatgaattttaagaaaacacagagaaaaaattcagcaatttaacagagagattgcaacaacaaaaaaatctggaactgaaaaatacaaatgaatgaatttttttaaatgcaatagaaagcataaacagcagaagttaataaggcagaagaaggaatcaagagcttgaaaacagtctccttgaaaatacagccaaaggagaaaataggaaaaaagaatgaaatagaacaaagaaagcttatagaatctatggaatagcatcaaaagagcaaatatttgggtcattgaagttcaagagggagaagaaaaacacaaaagggtagatggcttatgcaaagaaataacagagacctatccaaacctaaagaaagatataattatccaggtagaggaaggtcaaaagtcaccaatagattcaacccaaataagactatctcagacaagttgtaatcaaattttcaaagatcaaggacaaagagaattctaaaagcagcaagagaaaagaagcaaataacatgtaagaatcccaacacacctggcaacagacttctcagcaaagactttgcagaccaggaggaagtactcttggtgatatattaggagtactgaaggaaaagataaaaacttgctaaccaataagcctgtacccagaaaagctatttgtcagaattgaaggagacataaagactttcctggacaaatgaaagacccagaaattcatcaccatcagacagtcttactagaaatcttaaagagagtttttcaaacgggaagaaaaggacactatgtgtaacaataaaacatctgaagttataaaactcactggtaaaagcaaatatacagacattcacaatattctaatattataatcatggtgtgtaaatcacttacattattagtacaaagactgaaagacaaaactatgaaaaataacaataactacaataatatgttaagaggtagagctattgaatgtttattgtaagcctcatggtagccacaaagcaaggatttctaatagttaaacagaaaataaaagcatactactagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaattatataacggtaaaggagtcaaatacagcaagagaatataataattataaatatatattcaaccagcatcagagcagttaaatatgtaagcaaatattaatagacttaaagagaactatactctgcaataaaataataggagaaacttcaacactttccacaatagagagatcatccagacagacgataatcaaagaaacaccagactagttgtttctagatgcactctagaccaaatggacctaacatacctttatagaacattccattcaagagttgtaggatatacgttatttgcaacagaacatagaacagtctacagcatatatcacatagaaaacgagtatatcacatacatatatcacaatacaaaacaagtattaacaaatttttaaaaatcaaaattatgttaagtatcttttataaccacagtgcaataaaactagcaatcaataacaagaggaactttggaaaccatacagaattacagaaattaaacaacattctcctgaacaaccaatgaatcaatgaggacattttttaaaaattttaatttcatgagacaaatgaaaatgaaaacatgacatatgaaaacctatgagatacagcaagaggaaagtttatagaaataaatacctatgtcaaaaaagtagaaagatattaacaacctagcactgaacttcaaagaccaaaaaaaaaaacagaacaaactaaatctcaaatttacagaaggaaataaatcataaagaccagaacagaaataaataaaataggggctaaaaacaacacaaaagctcaaaaagagttgctttttagaaagataaaactgacgaacctttagcaagactgagaaaataagagaaatgactcaaataaataaaattataaatgaaaaaggagacgttaaaattgataccacagaaatataaaggatcataagagactgttgtgataactatacacaacaaattgtaaaacctaggaaaaaaataagttcttagacacatgcaacctatcaaaattgaattaagaagaaatagaaaacctgaaaagaccaataacaagcaaggagattgaatcagtaataaaaagtctcccatcatagaaaacccaggactgacggcttcactgccaaattctaccaaatagttaaagaagaactaatttaattattctcaaactattccaaaaaaattgaaagggaggaagttgttccaaactcattctttgaagccagaattaccctaatcccaaaaccagacacaacaaaaaagaaaactacaggctaatatccctgataaacatagatgcaataatcctccacaaaatactagcaaaccaaattcaacagcacattaaaaagatcatgcaccataatcaagtaggattcagcccagggatgcaagaatggttcaatatattcaaatcaataaacatgatacatcccattaatagaatcaagaacacaaattagatgatcatttcaatatatacagaaaaagcatttaataaaattcagcaaccttttatgacgaaaaccctcaacaaattaactatagaaagaaaatacctccacacaataaaggccatatatgaaaaatacagctaacatcatattgaatagggaaaagttgaaagcttttcccctaagatatggaactagacgaggatggccactgtccccacttctattcaacgttgtactggaagtcctagcctgagcaatcaggcaagagaaaaaaataaagaacattcaaattgaaaaagaagaagtcagatcgtccctgtttgcagatgacatgatcttctctatagaaaaccctagaaaccctccaaaaagctaatagaaattcaacaaagttgcagggtataaaatcaaaatacaaaattaatagtatttttatagtctaacagaaaaatacctgaaaaagaaatcaagaaagcaattccatttacatagctccaaaaaacacatctaggagtaaatttaaccaaggagataaaatatttctgtggtaaaaactataaaacattgatgaaagaaatttaagaggacacaagcaaatggaaagatatccattattcataattgaaagaattaatattgttaaaatatccatatcacccaaagcaatctacagattcaatgcaatccctatcataatgtcaacaaccttcttcacaaaaatagaaaaataatcctaaaatttgtatgaaataacaaaagaccctgaagagccaaggcaatcttgaacaaaaagaacaaagctagaagcaccacactacctgacttcaaaatagtctacaaagctatagtaaccaaaacaggatggtactggcattaaaacaaacacaacacacagactaatggaacaaaatagacaacccagaaattaatctacacatttacagccaactgattttcaacaaaggtgtcaaaaacatgcaatggggaagggatagtctcttcaataaatggtgctgggaaaattggatatctacatgcagaattagactagatccctatctctcactaggtaccaaaatcacctcaaaatggatgaaagacacaaatataagattcaaaactatgaaagtacaagataaaaacaggggaaacgtttcatgatagtggtctgggcaaggattttttaaacagaacctcaaaatcccagacaacaaaagcaaaaatagacaaatggattgcatcaaactaaaaagcttcagcatggcaaaagaagcaatcaacagggtgaagaaacaagctacagaatagggtagaaatatttgcaagctatgtatcttacaagaggttaatattcaaaatatataaggactcaatagcaaaaatgcaaatacgtcgattaaaaatgggcaaaaaacctgcatagacttttctcaaaaaataagtatacagatggccaacagagtgtatgaaaaagtgctccacatcactaatcatcagggaaatacaaatcaaaaccacagtgagatatcacctcacccttgttagaatggctattatgaagtagacagaaaataacaaatgctagcaagggtgtgaggaaggggaactcttatatgccgctggtgggaatataaatagtgcagccatcatggacagcattatggaggttcctcaaaaaattaagaataaaactaccatatgattcaacaatctcaccattgagtaaatatacaaaggaaattaaatcagtacatcaaagagatatctggcactttcatgtttattgcagcactattcacagtaaccaaaatatggaatcaacttacgtgcccatcaacagatgaatagatttttaaaaaagtggtatgtactcaatgaaatagtattcagccataaaaaagaatgaaatcctgtcatttgcaacaacatggatggacctagaatacattatgttaagtgaaataagccaagcacataaagacaaataccacatgatctcacttacatgtggaatctaaaaaaattgatctcctagcagtgcagagtaaaacagtggttccagaggctggggaagtgagggggaggggtgatgggaagagatttgtgaacaggtgcaaaggcacagttagatggaaggaataagttcttgtgttctattgcacggtagggtgactatatttaacaataatgtatatttcaaaatagctcaaagataatattttgaatgttctcaccacaaataaatgataaatgtttgaggtgatgtacatgctaattactctgaattgatcattatataatgtatacatatatcaaaacatcacactccaccccataaatatctacaatttttatgtgtcagttgaaaacaaaataaaattttaaaaaggaaagaggtacagtttagaggccattgtggtcatccagagttgggaaagctgctgcagcttcaaatgacctcaacacttgtatctgccacctactaagatgaaaagagcactgggatagttctatgtgaagactggtatgattttcagacctgttgtgcactggttctggggcactgggggagtgattttgcccctttgtaactatcttgcttgactgcttaatggaatttgtatatcctggtctacctacttatgattttaaatcacacaatctcataaatggaaaagtgtaaaaggaagcaactggtccctaaccccatgtgaaccttgaccccttctctgtcctccttagagttgcattcccagcacttggtgtcctgggggaccaagagtcaccaccaagtatatctctgtaaatggttcactacttgaacaccttcagaaatggagaaacactctcactctcaggatagccatctcaatgttgcacaccctacctatcaaaaatatcttcctcatatttaagtagtatttgttttcctgaaacttctacaaagttctcctaaatcaggtcacatagtacaagcctcatgccaactcttcagtgaacatgtctcttcaagtctcttcatcaggttaaatgttccttgttcctgcaactgctcctcatgcgacatagctttgctccgctctcctggtctcatccattccaacaagtgttcctctcttttattttcccctccgtgtgaaacgcctaggagcattcttttccacatagcaagcaatgacatatatttgttggatttcttggagtaaaccctgtctgcctagagtgaaaagggatctccaagaaatcaaggtaaagtgaagtgtcaagggatgtaggaataacacatataaggtcaacacagataagggttttgcaagcagtgtggaacaacagagcagccaacaggcccgcgtactgctgtcccgaggcacagtagactcttgggtttcttggtaaaactcatgggttgcattggtgatttctctgattgttaaatatagggtttcaattaaacactgtcacctattgaaggctctgagcttgaggctgtcagagcacttgtcagaacgggcttaaaggtacaggggctccagaataacacttccttgataaattgaacaggatggaaagagaaatgaaatgcaaataactttaccaccataggattcattatgatatgatgccctaactgcttaccacataaaatcaccacaagtcacatgcaaatcatcttgtaatatcttgggaagccctggacttggaagtatcctatcagatcagagagataacagtggaactctcggctggttatgtttctcttcattgtttgggagataagagaggggaatagcaatctgaaaagttcaaagataaatttctcacctcataattgattatcatatttgcctttttttatcttttttatttcaaccaaattatcttccttgggtgagtgggggaaagaattgtgtctgcacacaatggtggcattccccacaatggttggactatgactattctgattctatttccaatgtattcttccttcctttccttctagtccactattttggtggcctttgccagccaggagagcaataataaggcagtctgaaaacatgtctaaaccaatcaaatgtttgcatcatgtgtataaatgcatttgcattcatacatgtttgcacaaaacatttgctgtgtatgtaattgcttatacatatttgtgatttttgtgggcaagtgttgacatatctgtgtctttgtcatcatgtgtcttgctgttatatatgtgtaaaagggagtgtgaatacgtgcatgtgggctttatcacccctgaaggacagcaaccccacagatccatgtccgtaataaggaacaaaatatggagtctctctaacaacatttgaattctcacatcttgctgacagatgagaagggtgcaatagggcctgaccgctctgctgccaagccccggacccgtgctcagtccctccccagagctttccacagttgatgtccatgctgctgatgcctcttccctttggcctgcaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcagggtagggacatcctttgtcccaaggcactttcacaaaagggaaccacaactgtcattaaaatgtccttctcattatatagcctgagataacaggcagccagagcaagtgcttaactgactgtaagtcagggaaactcaggacatttctaagctttctaccacccccctgagaaatctacatttctacatttgtagaagcttcaaagctcctgcattgatttggatcccttgcctgtatcagtctgtgctaatgctctgagggctgcaaaagacatcaaatacaatttcctctctgttatcacggaaaccttatagtctagttagtaatcaattaggaacagcttacggacaacagctggacctgatgctctttgtgtcccctcctatctcatagaaggagctcagtgaatgtttgttgacttgatgaataagaggatagtatatgggaaaaaaaaaactggaaaaggtgatctattaaatggtgccaggagagagagaaaatgtgaagtgggagtggaggtggtgagatgtgttttggcagaagacagtgagcggaagcaaaggagcagagagcttaggagcacagccttcaagttcagcagatggaggcccagaacctggctccatcccttacttgttctgtacacttagcctctgtgacaccatttccattcatccatgtaatgaggagaacaatgtctatatcagagcttaacaagactaaaagagatagggtatctaaaattagaggcaaaacaaggaacaatcagtggaggttccatataccattaggacttcaaggaaatgcaaacctttgggagtcattctgaagaatgggtagagactaaagccatacagggtagacgtgtaaacatttatagatatcacaaagccagggtagacctgtaaacatttatagatatcacaaagccaggccagacctgagtaggctaagtacaacctagacaaaaggaacaacttggacagacacccagaagcaggaaaacctgtggtttccctggactttagggatgtttatcccaggagttgaagaaacagtacatggaactaccatctatggatcaaataagaataataagaaacatttgctaccgcctacatatgaaccaggtcctgtgctaagcacaccctacacaaattatctcatttaatcctctcattaaagatgagttagagattgtccctattttatagctcagagttaggataggtccccattttatagatcagaaaattaaaagaatcacctaagatcacacagctaattagtagcagaaggagcagagacagcacgctgccatattgcctcaggcaaaagagaagggatcctgtacagactcacctagttatctcactacaacttcttggagcaaactccaggccccgaacaaaccactgtgggagatgctgcaggttcttgaccatgggctttgtattctgtatgacagacaggaaagggaacaaagccttaagcatcattgatcctaactccaaggctaaaatcatcaattttcaatgtgtcagagcaggaaggtgccttagaggtcacctagtcagaggctgtcattttagagagaggcattacttgcttaagctcacccagccagttaataaaaaagccacttacaatctcattacaattccctgacatttttagcctgcaacaaaagtgtgaagaaggtgcctgtttctacttgtccataaagcctgtcctatgccccaacccctgctaatgcagttagggaaccatctaattcacttaacaatgctctcatccttatagcatagacaacatgcaccagtcctcaaagtacttttgcacctatggtttcatttttgtttcacctgtgacctcaggcagaagaggtatttgtggcagccactttgcggataagaaattaaaacttgggaaattcttttgatgcaagtgtcaggggtgggtaccaaatctgagttttcttgttccaatccaagtattcctgtcactgaaccacatggtcttaatgtggtggtgtcattaaactgacaaacatttttaaaaagatcactcaggatgacagctgggcttgtggacacatctagtctaactgtaccattttatagttgggaaaactgaggcccagagaagaaaatggtcatgccctacctaatgagaggcacagctgggatttaaaatttcaaaagtctttgttaatcactacgtcaattgacatattactgcctcttgtccacagcacaaagttaagaacctggaaccagggcagtgcatattctacaagttctgtgcccaggcctactacattggtgacaaattggttgtagtccatgtacttactttgacaggtcagtagtggttgcctagagattctgaggtcacatctgggcttgatgtgaaaggattctttgattgatatcagtgtctctcatgtatacaggaagggaaactggtaccaagaaagccaggtatgaggcattcctaccctaaagtaaaacctgaaaaaaaaggcataattattagtagtcattgcactacttacagaatgccttcttgtgccaggcactgggttatgcctgtgttctcatataatctccacggcaacactgtgaagtgcacagtattattactattttcagaagaggaacactgaagctcagaaaggttatgctacttgcccaacgtctttcagctaataagatataaagcctaaaatgagggaggcagctggttgcagtggaaaggcacaatgtgtgcaatcaggaggtcagggactcttggctctgccactaacaaactgcatgacatttgacagtttattgccacatcatgggcctcagtttctttacctgtaaaaggagagtactgccaagatatgtcccatgcataagcctttccatctctgtgactctgaccttggataattatcccaccaggagtttggtgggtggggagataaggttacctaccacccccacaaggcaaaaggaggaaatagtgagacaagaattcttctactccagtctctgaaaaagctggcttcttgtccccatgacagcccagaacttcttggcagccccagcccagagatgcttaatcctccatcgacagtttaattaagatgtatgaagagtcatgggagctgcggatgataggagagatccaagaacaaataccctgagtatgcttccaatcttccctgccactcatgctaccttcacattcctggagattagattttcctgatagttcatcccaagtgtctgtgtgcacagccttaacatttggggcactggggtgaggctgagaggacatattaattttctgcatactgttgcccagaaggctcctcagctctgcctgtcaacagcccagttccctgctgtgtccatactgtcaggtcaaattgcatcttgcaattgccctgctgtgtgttttgttgatttgtgcctggaagattatctgcaaatctggtcacagctgaatttatacattttcctgtttcctgtgagagaatattaaatacattggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttttgcatcaacctaatacattctgaggacaggtctacccatgatccagaaattcttcagtgctttcttccaataatgaaatcagattccactgatattcagctttctatttcttctggttagtataaatatggccttattgaacaatagataggtcctttaatgtatttaaaagtcaggcagggccccagtttcttaattctccccttgtttaggaggaatataattactcagaagtaattaaaagatctgagctattctgttcattctgaatttgcaagatatttgtactttggaacctactggtactaattagagcctcttattttgcaatcactcataatttgtttcttcctgagctaatctcgctcatgaatgtgtgatcaagctacactcagctcttcattaatgtgtgcaccgaccccaattccaagcgcacttaattccagctttgtttctgtccctaccagaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgaggtaagtagccaagatttgcttccttggtactccctctcccctccctatctcaggaatgaagcttctgtgtctgctacaagcctccaatgccacaatgcaagctgttgagggggctcttcttcaacacctatgggcctgaaagattccagccacccaagatcttcagccctgaggttggaaactgacctgggggcctcagcttgctgtgactgtcactgcccatgtgttcttccccatgcctcaccttcctcctccaagtgcgtgaaacatcaatgaaccttgtgcttttgtcgtgtgatctgtaacaccccatcctttaccagacacccctgcatccaacaacgctatgaacagagttctccagcaacctgaattctttgacagaaggtggtttataatgtttgtctcaaaagaaacataaacatgttgtccaaatgaaaaatcaaatctttcgagtcctgagactctggctgtggaaatcgaaatagcatctaatgaatagcaccaaattaattatagcacctattcttacctagagactgatttatttagcaagatatagacggtttggtaaagaagcagagtggactttactttcacgaaaagaaatcctgatattcattctcaacagctgaggaagagtcctgtagacatggagtcacaatacctagatttaattctgactgtcttacaaaaggtaaaacatatcatcttccagcccttagtttcctcatctgtagagggaggataattggcccagcccttcctaggtctgaagtggttgtgagttcaaatggtataatttatgttgaaggtcactgaaaacagtacactgtgaagtcacctatgagacattatgtcaattacagaaggattaaatcatttgggggaagagttgcatttcaggaagggtaagaaggattaataaagtttgcaaaatgatggagagggattcctaacccatctggatatgacatctgggtctacctctgcctccactttattcatttatcttaataatactaagccccaacattgttctggggactgggctagtagctggagctacaattttgaacaagatagacatagtccctgtcctcatgccactacattcttgcaggagagacagacattaaagaaataattaacatttaatgacaattctaatagatactaggacagtctataaaaggggacctagagaacatctacttcctgcaatgtagcagaacaaaattctcactatgaaacaacgagatatgctggataagatataacaaatagccttttaagtgcaagttaagaaattcctaggatcaaaaagaaaaaacaaatcaaaactagaactaaaagcgtaagcttattattctgggactacgctaagcaaggcaaagttataaattatgtgacaatctacatgagcaacaattaacagtacaactaaaaacataaggtaatcaaaaacatcagaggtgggggaggggggaatcaaaggacattccccagagtaacacacagaaagatgaaaagaaaatgtaacacagagtttaagagacatgaaaaagaaaaaaattgagtctgctgtgagttccagacagagacaagagagaatgaagtggaggcaatattttaaagaaattttctggaatttatggaaagcataaatcctcagatttgaaaatcagtcttaagcataataaatagataaaaatcagcagctgattcaattgaaagcagaacaataaagacaaagagaagatctcaaagcacccagatataaaaaggttcaatttggtctgcaggatgagtggggcatggctgggaagacaggtccaaagatgtttttttcaagctgcagtttgacagattaataggagttaactaagtgaagtgaggagaagggaagaaaagagtagttgaggcagaataaatagcatgtgcaaagattctaaggcaagaaatcattgcacagtcgattaaccaaaagccactaagtgttcttggaacacaggtaataatacagaggagaaatgtttaagctgagattggaggatgaggtggggaagaattttataaagaacttttgtctttattcaaagaggaatgaaaatactttgaagaactttaagtaattatcggaaaattgagagaataaagatacctggagaagtgtagacataattgaatatgaactaatgaagacaaatcaaatggcctggtatttatcagtcatgtgtttttgcctggttgaatctaaaagactctttacaagtttgagcaaagttcaaaggggattcagatgatagtgtttggcaacgaagaggcttttatctcagaaacttattgatcatcagcctagaaagactcaaagtagagagtgagtttttatagttccaggaacatcagtgatacctcaatattacaatttactgaaggtttcgtgagtcaaggacatccacataaatacatggatgtgaagttaagaaaacaaagcacagacacataacataatttgtccaatcaatagagtacctctgtcatcccatcccacacatagtttcctggaacaaggtaacaactcaggaaatactgtatatttcctgatactggaaatactggagtgacatgaacctaaaactcaggccatttggcactcaaatgactttccactataataaaaaccatcattgagtcagtgcctattaagtgccactcaccgtggtacatgcattatctcttataacccttgcaacatgactatgaagtaccattatttccattttacagatgaggaaacagagtaagagttaagttgcctgatcaggttgacacagctaataaggtagaagccagatttcaagccctggcagtctgacttcagagcctatggctgtaactcactctaatgctgcactgggctttatgaatgacagcaccattaaaggcaggggactggacttgggccaggtcctttgcacctattcacatgagccaaataaccaccaacttgggaattaaaaccagacctttgaagtccagagcaaccactcaccactctgaaggcaaaaggtgataatggacactgactttaacacacccagcaccattcctttgaggagtaaccctgcttttatggatttgcttgctgaaagacactttctagaacaaacaatgaaaataattctgcttcataataaaaaactaattcttttgcatacatctctgtaaacacataacaagccatttattgatttcaaaaaagagagcaaaagaaaaggagagagaaatgaaaaagcaacatgtttcaaatacagatcactgacgactgaactgcaagtcaagaacacccaaatgatggtcatatgctcctgtcttcctacagcgctcctttctctccagtgcaaacctgatggtagtcatggggccatcataattcctgattcaaaaacaaaagagtaacgctcgtcttaaaagggcctcaggtgtctggcctaggaaagttcctctacccttaatgggattctgcttctcatctgtgcattaaaagggaacactgctagcaaccaataatatagaggttccacaaaacacaccattaaagaatggttgcagaaaatatgagtaaccacgcctctcctacaccccaaccccccctcccccccccacacacacacactccagccaagtttccattataactctttttcacaccccatatgatgccatttgacccaagacatggtcaaactccaaagagttatggcaaaccaaataccacaaacacatgtgcctgttccagcaatcctagatccactgacttgatcccaggaaaccattctgcatgacagaggtggacagtaaggagaagagtaaagacatttgtgcttcctttggacccattgaagaggggctgatatatgcttaaagataacctggcagaagaagtccaattttgttcaaattattttgaatcataaaaaatacttttttaaaggactgtttaactactcacaaggctgcaaactctttggaagtgtttacactacaaaaaaagtgcttgagtttgttccaggtattattataaacttctcttcagccctatcaaaggtagggtttttgcagctttcacaggcagatgtcctccaggcttactgcctgtagttgtatcaagagaggacctttctggctgtcctcctccactacttgctctccataaagccagacttcactgtgcctgtggggcattcactctcttacagcctgcctagaacaagctccagatttctccaagacagatcacccagttatgcttcagaagatcagataactgacatctaaggcccaaatgttcctccaaaacttgccaagtctacttggcagaagccaggccatggtccccatagagtgttaaaaagctgtgttagtgacagaatggggcttttgtttatttgtttgtttcttctgctctggaaacaaatactctgatgaagcaaggtggttcaatccttgattttccatttggacaggtggtgtttctttgaaacagatgctgtttgttggctgtcactgcatgtttgggggtgggagaggggctgttatgtttcacaagccctcaggttgtagataaagacctatgcagccaacgtcactcactagggaaaggcaattggtaaatccactaattatgatctattggcccttttggtgccaacttaatgtatcttgctagcctaaactgaaatgtcttttctttattatgatgaatacttcctttgatgtgttcaaatttcctaagtgagggggcttagcccacgttttatcaacctaagaaagaatccacaccagattggcctcagttaaaatgtcacctgatgattctctttcacaaactacctaccaggagtttaacggatttgctaagagttagaccctaatcaggacattggtcaaagtctggtctttagctgtgactgtggttacatggagtcttctttggtctctgtgatcatgacatgtttgtcttctgtcatgtgtcttgtttatgccagatgtatgggccaagggggcaggagtgcagtacagcttcaccctgcagcttaccgggtaatgggcacccaggaaggtctgagacccactctctgtgctttccatttagcttcaccgattggtttccaaataccttctcacacaaagcactgtgcataatgctgcagggaatggcagtgagagatgcaatcccagtgcttaaataatgcatcatcaaatacagctcatgagcagaattatgtagatacctattatcctaccaatgccataagagagccagaaacactcaaaaaaaaaaaaaaaggaggagagtcaacgtttgcgtggtaggatttgcaatggtggaagaattgtggaagaattgtgatagatgggaagtggggagaggaggcttcatattaggggctgaagaggaaaagagagcaaatgcagaaacggaaaaaaaaaacatggggcttgttttcaggaacaacaaggggtccactttaaccagagaattcattaataggtaggagtgattggctgcggtcatattgtgaagaatctcaaatgtctctgcatgttttactatgtcagtaggagccactgaaagtcatttacagggagggacatgattggacaggctcctggagattaccctggcggtggtttgcgatacgcatcagagagaggaggatcacagggaaggaagtcatttagaaacctgttgtggtcatcttggtaggagataatgaatgtggtcatgagttacaacgggatgcagacacttgggagaagtggtgggctctatgttcgtcactagtcatatccttcactttaaagctgggaggtttggaaaagaagtctgttacgtaagctttctggggcttttgtgcccctgcctaaggcttgactgggtacaaactgattttggcaaggacagaaaatggaaaaatacgggatttacctcccaaacagaataattgctgccacctcaattttacctctgaaatgcctacctggttaagaaaggcatccctggaaaggacacaagctttccggcacaccagcaagaatgatgaaggccgtcgatcacctttacttactccctgctgcattgactatatctggcctttatcaattttttcatatcacatgagctcagaattgttcatcaccattttagcctcactggcattcccattgagtatatttttttctctcttcacacaaccctgtgctggaaaatatctagcaaaagttgcttgtgtatattggcatctggctaaagaaaaggagggtggttaaggctatgagtcgggaagaggtatcaccaaggttttgtagggaaggctgtcactttcagggacagagggtttcctcctagttgctcatcccccatactgggacgataaaacatgcttgtatcttccatgaagtccagtaggccttccctggaatcctttttttgcctaatgctaacctgagtgctacagaaggccatagagagttctcttcttttagagaatcacattgacccagaaaataattgggaaacaaataagcaagtgcttttttgtgtggcattaagtcgattgctctaaagagcccttcccaacttcggtgtgtatcaaaattacctagggagctggtttaaaatgccccttcctagactctaatccttgagacttctgattttgcagatccaggaatatgcaatttgaacaagtcccccaggtgcctctgttctaagtaaacagcagtccactctgggaacaagggctagaagaggtcagggaggcgatgtgctagtggtctgaggaggcagaacatgaggaggaggccctgaaggaatagggggatgaatatgatgggagatgaccaggaatcctcatggaatggttcacaacccgaattcctggagtcagatcacctccactcaagtataaggcccgttaccttgccagagtttgacctcactgggtaagtcactagaacttcataaacgtctgtcttcttatctgaaaaattggaataataattttgtgcagctgctttgatgatctgatgaaatagcatgaagtgcccattacagaggatacttattagtgttcattttctacccctctcctcctcccattagacctactaaaaagtcacttttgagccaaagaacttatttttttcttttttgtaaaaccaactgtgttcatcagaaatgcccatgagccccaccctcatccccctcacacacactggctgcattagaaataaaatatctctgagaacaatttgtggtcctcccccacagagaacatgctaaaaaataaagccctaatatttctttttctccctccctcccactctcacaagtaacagcctgtcttcccatagtatagtactggtgcagagcctgctgctgctgataaatacagtatgtcccagggaaatgacagtccctttcaattagtccttgcctcctgatgggtagccagggatgcttgttgtcatggtaaccccatgaactctgtgacccaggtcgggcctgatcagagacaaagccctctgagtggagaggctggatttatttgcatcctcagaagagctggagagaaaggaagagaaggaggaaatggggggataaaaggagagagagaaaaaaatgggagggaggttgggagtgagggaggttgggagggagagacaaaggaaggagggaggcagagagacagagagagagagagagtgtgtgtgtgtgtgtgtgtgtgtgtttcaatagagactggaggtttgcaaaggagagaagctttctcaggtcaagacatgtgggatgcatttcagagagtaccaagaaagcttcctaagagactggtgcgctagtccggtgcaaaagtccagacaaaggagtggcaagcgctttatttagcattttaggggtggtgataagacttgttgttaatattattgaacactgactcatctcaggcactcctaagaagtgatgtgcattatcctatttaatcctaacaacaccgtggaggtaatattgttttcaccttcatcacataattcaacctgattccagacctcttctcacccattaggcaagaatgccctctcaaagatgtaaggagggaaattatgaggaagggatgattattcagataataaagattatttaatcaccaccccccaccacacacacacacacacacacacacacacatacacgcacacacacaaatagcattggtcctgcccaaccaatatacaaataagaaaacaggttatacaatatacaaataagaaaacagcagaaagctttctttctgctctatttgaattccctagggaatgcttgcttgactgcaccatttgtacttgtggggaataaggaacctctccaggatcagagccatatcacaggtggatgtcttaccctataactacataaaaatgcaaaactgtgcatctgatgcatattaaggttcccctgcttgtccataacagattgaaccaaaaacatccctaaagatttttatgctcctgaaaattctatatgttttttgtttctttcagcaatgtaaaacaggtcattttaaaccaactgtgccataagtttagagggtggggtaggggagccttacattcgttttataccaatgatgtgctgggcaatgcattcagtgccctgtgatggtcatacattaatccttccctcatcttttgatttagatattatcatttccctttcatagtttaaaaaactaagattcagagggtaatgctttacccaggttctcaaagtgatttgtggaacagtgcttaggtacaaaccctgactctgaaatcctcattctttccacagcccacctttgtgctaatcaagactcgcatcactgccttaaaaggtggcatcctcaaaacgtccagggaaaacatcaggggacatgagatgtcagatggcctccacaaaccaagcactctgtcttgaagcactaggctaggctgcagatccacgctgcttatttgttttggaggattctggtgaaatcacaaagacaaatgggcagtaactctggttagagcccattttttatttatttatttatttttgagatggagtttcactctttttgcccaggctagagtgcaatggcgcaatctcagctcactgcaacctccgcctcctggaggttcacgtgattctcctgcctcagcctcccgagtagctgggattacagccgtgcactaccacaccaggctaattttgcatttttagtaaagacgggatttcaccatgttagccaggctggtctcaaactcctgacttcatgatccatccgcctcggcctcccaaagtgctgggattacaggcatgagccaccatgcccatcctagagctccattttataatgcctggttgagaagctcataaatggcaaagcaacacattaaagagagagaggaggaaggtggtgaaagcgaggtggcagggatgtatctgggaagataaataagggaaatgaatggcctttacctaggtgagaacagcagctcagtgcaggctgtgatttgcccactgaagcactgctcctcctgctgatacacaaattgcatgttgctttcttttaagaggctgtcttggtcaaaaatagcatctctttttttcctctctctccctcccatcagcaacttaatttcagacttgctaggtcttttgcgttttctaggaaggcagctgctgtaatacaaaggaagaccaggaaagagacggattggatatctgtctcagctctgccacttggggcttatgggtttggaaagcaaatgtgttttggtgttcctgagacctgaattcaaattctgcctcccgcatttacgacccatgtgatcttgagaaagtagcaagctgcagtatcaccctgaagtcaagactggtatgaatcccaggtctgctagttaataacaactgtttcttggacaagtgacttcatctccttaagacttagttttcaccaaatgtaaaaaactggaggtaactctggcatttatttccatagttgtcaagtgtgattagatgagataatacaaagtgtttagcacagtgcctggcacatagtaaaatgactgacaagtgttaattatccttatttaatgtctttgaagcttaattttctcatcttccaatcgagatcttcctatgagattcataagattgtcttgtgaatacaatgaatcccttatgaagagttcatggtgtatgaggagttcttgaatatgaatccatttttttccctgttctccttccctttcggccctccacactcaccatctcttctgtttgtgtgagtatctgacccaaattagtggcaattaccttctctgggctacaccacactacgattgttaacattgcaatatggcagaaatttcagaataccaaatgttcagctaacagccacactgcattcctctatatgcctgaaggtagaaatttccagtgtctgagaagcccagtctcggagggcaggcagaaaggaaggaataaggggtagccctgagctgaacccatgctgagaaattcccagccatctgtccctgtaacattttgtgaatggtcccacaggctaagatcatggcttaacaatcatatctaatcagcctgttcctcagagtgaaaggggcaaaagcccaggtgaatcctaaccaaaggaaccaacttcctctcacacagtaaaccagcagagtccccaaacaaagaaaatcaggcagggaaatttgcatatattattcatccttcctcagaacaaacgtctagtaaacaaagagcacaatgaactcttaatcatattctttattcccatgagaataaaatgtattcctttagaggaataaaaaaaaaaaaatagttgcattagtcaagccagtctccctgtggcccacaaacacaactttcccccactcctgtatcttcgcttgtattgcttccttctgccctccacccatatttccaggtcaacgaagcaaaggccaactctcccagagaatctagcagagaatttagcatgcaggaaacccctgctgattgcttatcacatagaccagttcctacccagccaacttccatgtacatgatgactttctgagcacataatcaaatcagttgctgtgcctggtctgtctgattcatggagaatcaggaaatactagtcctactatatagaccacataacacaaattaaaccaactgacaacttgtaggtctttggccattactaataaacatcctaaaggcaacaaatgcaagtacatgaccatggtcatgcaatttatttctaccaacattccaagtatagtattttcaaaatgccaagtcagtactcttaagggaaacaaggatgaataaactatgacattagcacttccaagattcatcatctagagcagggaccgcaacctcaaacaccccagggccaggtaaagaagacgagtaaaatgggccaggggtaaaacctatgtggttttctcatttttaatagagtcatgagtacagacaatatttctctaagaaacaaatccacagtgcaaacactatggtaaataataattatagttaatatttattgaagacttgctatctatagcaagcaatctctaaattctcatatgcatttcctaatttatgtaatcctcacaagaacccaatgaagtaggtactattaataatctcattttacagataatgaatcagtggcacagagagactaattaacttgtcaaagttcacacagcgagtaagtggcagagccagaatttgaacccagatagtccaagttcagagtctatgctcttatcaatcacacaatgctataaatgaaagctgacactgaggatcacaggaaatgatgaagactagtgaacagggctatgtgtcttatctagacgggacagtctccactcattccagtctaatgttgacatgtaggaatgttgtcacatattctcatttttcaaaagaaactagaaatctcaatttttatataaactatacaacttttttagtagtgatcacatttaagagagaaggataaagagaaggcacaacccactaacaactaacgctaatacaaaggagactggaagtacgataaaaataaatagataaataaataaggcaaagtgaggaaaacatgcagttaagaattaatatcttgcccatccccagggtgaaagctctagaaaggcctccaggaggaggcagcattccctgaacagttccttaaccagtagagagaacagccaggcggaagacggggaggaaggtatttcaggaaaagccaccgcaagcataccatacaggagtgaagagaagggtgattcatgcattctttttcaatctttgttgttgctgttttcagcagggaatcacttccccaaacaaaacctctcatggaatcccattataaatgagagatacagtggagctgcaagagataaggggctggaggtggtagtggaaagggagaggaagaagagagagggccagcagggtcaggctggaggtgggagacctgcaggagcagagttttcttctcttcctcaggagccattctctgtcactgaaggggagaattctccagcattgtgaccctgtgtatttaaaagtccacaagaaaataacggacctgctggcctcccctgcatcctgttcacgcagtccttagaattggcccagcttttcttcctttcattgaaccaggggtggctgagatgagaccagtgagctggctcttgtactgaatagtgtttccactccctccattaattgcggggggaccttcattcattccctctgttatcttttgtcaagcatctccaaggtatctgacacagacctgtgtgcctgctgctgctgacaaatgcttctgcattacaggaccagatgtggtttactgtgagctgcaaatgaactgttgacacctgcttctcacaatgtggggtgggctaggcatcacacatgccttagaaatgcttgctgtctctagaattcctgttggaggagccagacttcagatccctatccaggtctctgggctgtatccactgatcttaaccaggtttcttcacagaaccctgaagaaatttacagggccagaaataaatatttgcacattttaaactgctgtgcagttttgaggggttcaagaaacccctatggtttatctcagaaattaaaaagtactccttcattcaacaaacatttatgaagcagctactgtgttagctattgtgcagtgtgcagggttcctgccaatagagctcagattagatgagtggagatggataagggaatggtgagtttgctgtgataaaacatgcaagtacagtgggaccagaaggctcagtccattctgccttgggtcactgcaggagtatttgcagagaacaacacacatcagaagcgtgtaagatgactagggttccacaaagtggtgaagtgtcctaggtagtacatgtgccaatgcagaggtgagctttagttatgctacctagtccaatccagctacctgaatttgtccagaattactctcaaagcactttcccatctgtcacctcatttactccccactctacaggcagctggggcaggagcatgcaattattcccattttacaaatgggaaaactgaggtacagttagggtcatcaaccaccctggtttgctcaggattgagggggtttccaggatgtggaactttgggtgcaaaaaccaagactgtcccaggaaaactgggacagctggttaccctagctgtagttacatgacatgtcacataatttgatcagagatgaatgaggtactcaaatcacgccttcagactctttcctccacccagcatggagtgattaagtgagcactctgtatatatcatttgctttaaaaaaaattaatttgtgtcatttgtacagtcagaaaccaaagacaaagcctctgtcttctgctgactcactgcctgaccagcatttcttctcataagatcgcagaactctctgttccttgagtatactcaagaggggaacaccatctggaatggtcaggtgtgaagggaaatttgatcctacctgtattccttaaggaacccggggatgtctgcattttaattgaggctcctgatataaccccactaactattttcttttgcttggtcactggatagcctctaccagttcactcatcaccccaacctcctgagtcagcggagtcctatggggtctgagttgtctgcccagtcagtttaccttaaatggtccacacagccagtgatgtcatagactgaactaaagacagaggactttgagaccattgtccaaaggaagccattaaggagtgcatctaggacccaggcccaccagtactagtcctgcctaaattcagccatgcttttcctcggcagtggcagggtaaatgagccttggttcctacggaggctctggtccccactcccagcaaaagaaccccggcttagccttggaaaagaggcagaaaaaatccacccagagaaggtttctctgtcatcccctcgaaatggttttttatcctccacaggcctatgtgtgagggactgtggaatattgcttagttcagggagaagtgtaaaaagagaaaggaggaaaaggtgaactggatcttcttcacagagggagaactgtgcacccctgaaccctcaagccccatggaaggaagagttagaaggaccatgctcacttgtgcactgacccttaatccagtgcaagcaaattctcaccctaaatagcccccataaatgtgtttaaactttactcatcaatacctgctctcccctcttaagggtagatggagagttcctcgaaggcccttcccctagaatcctagtggttcccaaactgcagatatcatgtatcagtaaaattacaaaaaaataaaatggtaaagtgtggacacttgacaatattttatattgccaggaaaagacaaaggaaacaaaaaaaattaccgtctcttattaataccatttaataacagaaggaatatgttaacactaaaaattaatgaaggaaacaattacaaacaaaggtctgtcctttaaatggaaaagttccatgtcctgaaaactcactacacaacgcttatctttccttcttttcccattgatgagtgaaaactatcacaaaccagttccagctcattggatgagccgtttgggaaccactgatttaatcccagctttttatctagctcgtgaatttcctccatgttattcctgacaaacagttgtcccatgaacaacatcccaacagatcatacttttcaagtagcaattatcagagggtgctaataattccaggtttgccgtcatactaagcagcaatctgtgtccctgtggctttgtctccctgatctaattctgccctctggcatctcagagaataacgctaattcctcttccactgacaaccaacctcaagtttccatgtgagtcctgcttgctttgaagtggcccactatctccatgatccctggatccagggttaaaattttcaaccttgtctcttcctctcatataagccgttatatttttcagttaattgatatacatttgcttagaactgactgtatcattcactctgctgagtgtagatgagcttctggtctgaggcctctctctgcttaaaaacctcctgtatctcccttgcccatgggtaaagtgttgatgttctagcatagcactcaaggaagttcatgattaggactctgtcagctgttctaacctcatctccccgaaggtcccctcatcatgactacactcctcgggtggggactttgcccttttcacagaacactccctaaaggttttctaacttccacccactgtcagaattcacctctctcctcttttggtgcttccataaccctttattttaaaatctgatacagtctttcatgaactattgagaaatatttctgcctcacatactagattgcatggtccttaaaggaagaggtttacaatttgttcaagttgttattcctagtaagtacctacaatgcttaacacttgattgatcttcataaatgtttgaagtgttgacccaaagacactaactctttactctgaaggctttataatcaagttgaagactaagaccaatacacatcaaatagtagtagacaatgcagtgaactgcctgctagatgccaggcaagtttaaaggaaaggtcaatgagaaataaagtgctcaagggcagattcaaggaaaacatggggagcattgcagagcaaccaggtcttaaaagagaagttaaggagaacagcaagaagcaagcacacaggagcaggcagaggcacactggttgagaaagtaggatgcccagcagcctggtctgattaaatcagaaattccctctgtaggaggacaagcaaagcatattatcataggctgggcagaattccaaaggtcatttcatccaacactcctcagacgctgaaactcaaggtttcgaaggcaaaagtggaagtgtagacaattgctacagaattgaagcccaacattctgtcctttgcctttcataagttgagacaaaattaaaaccatctgaaatatctcccttggctgcttttttcaaactttaatttccctgcaagtatatgataattgagtttctttagagcacaaggctggatatattggaccttaatgtgcacaagttcatcctagaaattgtctttagagtaccaagtctttcctccccaagagttccaaaactaattcaatatttagaatgctcccctggacctcccagttccagtggctgaatgtcagggctcaggcattagaggattctttttgttctttggccctcttggggactaaatgccatgtatgtcaccatgtcagtgactacagccttggtttcatcccctgatgacccacaaccatcatctcccttatgctgaacatctctctgaatcttggaattttcagatgactctaactttgccaaattagaatcatgcctgattctttttttgtttttttgtttgattgtttgctttatgtttgtttactttgctcagtgccaagcacaggatttagcataagaaaagttccactagaggttgtttattcaagtaagtaattattatagccatccgtatatgaatgctttacaaaattttggctgatggtcctcgcaggtctgttttattagtcaatttataaactcaagtttatgtcttcaacttgaccatctcctttgacttccagattcgcctcttcccacaaaactgactctccacttggacatctaacaggcatcttaaatttaatgcatccactttgggaggctgaggtgggcagatcacgagatcaggagatcaagaccatcctggctaacacagtgaaaccccgtctctactaaaaatacaaaaaattagccaggcgtggtggcaggcgcctgtagtcccagctactcgggaggctgaggcaggaaaatggcatgaacccaggaggcgtagcttgcagtgagctgagatcgtgccactgcactccagcctgggcgacagagcaagactccttctcaaaaagaaaaaaaaaaaattagtgcatccaaagctgaactcttgggcttctcccaaatccatctctttttagtctctctcatctccacaaatggtccctcagtctacacaatctcaagggaaaaatcagctcgaatctttccttcaatcccccataaccaatctatctcccttactcaaaatgtatcctgaacgtacagcctctcttctttccaatccttaattcactcttacctgggctcctccactagccttctcattggcttccatgtttccccacttgcctccctttagtcccttctcctccctgcattgggagaacttattaacttggtttaaaagggtctgtcattccctggctaagaccctccaatctcagaataaaatgctcaatcctggcctgcagagtccctgccagcctctccaacctcatctccccataagaatgtgatctcttatcacccaaccctcttctctctctagtctccgcttaaatgtcacttcctcagacccatgtttcctgaccacctctgacattttctgtcatttcaccttttgtttcctttataacacttcacatattctcttattgcttgtttctccaattagactgtaagccttactagggcatgaaccatgtttgtcttatgcattagtacatacctaggacctctcgtggtgctagcacatagtagctgttcagctatattcatggttattaaagagggtttatggcaaagtattatggtttcccactcaatgtagatgtcccttctataaaatcataacaaataaccatctagtctccttctgaatgcctcctctccaagggtttcctcttaagacagccaattccatttcctttggctctattgtcatttcttttccatattgactcaaatgtcctccatgacttttgcctattggtcatagttctcctccttaggaacccatagtataattttctctaaattctctaaattaatccttcagatatttgaagacaattcttatatttgccctaaatcacacctgcttcaatgttattccacacacatgatggctccagaggtatccacatcattctggtaattgatctcttgacacactccagtttgttattgtttcttaaaattgttgtctaataatgagtgccagactccaaaggagatggaacaagttcataatggaagaccatcaccttcctttgtatgattctaatacctcttttgatattacatatatatatatatatctctcctacatatatgatataaataaatatatatgttgtgtatatatatgataatttgtatatatataattatcaacagcatcctgagctcgtgaaactaaaacaatttccaagtcattttatctagacatttctttaaaatatgtaaggccaaacttaattaacactaatctatgaagaatatctaattaactgcagtgggcaactgacttccacttttaggagaaagaaaataaagtaatctcaggaatcttttttgttagtctgtaaaatcatttccaggtaaaatctagagcttaatccatatgttgtgccatcttttgcttttccacacctctgatcctaggtaagttagagctaacgagtatttgctgagcttctattatgggctcagcatatgttataatttcttttacacataggaatctgaggcttagagaagtttactgatttacctaatggcacaccataagtgctggggctaagatttaaactcaggtctcctgacttaattcagatggtcagctcgatggtaatcataataatattgttgttgttgttgttgttgttatttatcaacaatagtagtagctaagtcatttcatgaaacagctcattgatagtccatttgataattctgagttggaaattctattatcccatttgacagatggagacactgaagctcagatggctgacatagattagcctagggctagttgtagttagttgcagtgagaatttcccagtaccagggattcttattcagagcaaggctaaccccagagatggtccctgatggcaagtggaaaatctgaagccacaggaggcaggtaggaggctaacgcatttggaagaagtttataacaaaaggaacactcacttgcctggaatacccacgtattctctgaagacattttagtctttgaggttcatcccattctgttttaattttttcgagacaaaaaatgaccaatctcttatttgcgtattcaagcattcttaataagtcactaaaactcttatttttcataactctccttttattaaaaaccttggggaagagaacaaaacattccacattgaccttagtgagttgttcctaggtaggcatgatgaaaatgcaaaactgaaccccaaatctagccaactgaaagacattgatttttctagaacagcaccttccaaacaccagtctgtggaccagtcactgcttgcccaagacaaagttctcaccagcgtgaggtaaaatgaggaaaataacagcaatgtgtctaaattcattcaacctaaagacttcctttcattctttattgttgtccttcctatttctttgattatttgaacatctttacttctataaaaggaagttgccagcagatggtagttgttctctttaaacgtttctacttagtgaagttaacatttaacacacacctatgttggtcctcccacacccactttatttttttctcatccgtgaaaactagatatctagaaactactgctaggctaagggatagcttctgctatccaagacccccagattttccaaggttcctggccttggagcctttatattttataaaggaaatattttttaatcacattcacatctttaacttttgttttgaacatgtgaaatacaaccttttctggataactctatcatgatcaataatcaatggcattggattagaatacagtgaatctgctggagggcaaatatcatagggcagttttccagaaccagaatcgcccccgggccaccattcttttagcaattcgtttctgtctccttaaaaaaaaagaagaagaccaggaaaggtggcttatgcctgtatcctagcactttgggaggccgaggcaggaggattgcttgaggccaggagttagagaccatcctgggcaacatagtgagacctcatatctaccaaaaaaaaaaaaaaattaatagaaaagaaaagaaaaaacctgctttggctccttccttgttgtgaagttgtgaattagcatcttatgaaatggcataagatgaggcttttcttatttgctgactttattctgcttgggcttagaaaatggagattcttgggtattacaactgtgtgcaaagtaaaagtttaaaaaggactgagtagtggggggtggggaaggtctaagtgagcccaggcaaggatcacacagtaccccacctgcactcagcgtgaagcacaatggttatatgcatgggctttagtcacacagagctgagtgacagcctggggcaagttaagtatttatctgtaaaatagaagtagtaaaaatgataaccaaacagggatataaggattaaatgaaataaagcacgtaaagtgcttaatacaatgcctggcccacaataggccctcagtgaaataaatattaactacaacgatcaccttatatccctgtgcattttctttgctcactttctggtccttttctgttctgttctagataggtgagtttaccaaatagctgagacacataggttatagatacgtaggtgatattgcatttagattttggccattcatttgttcatttggaaaaaaaaaaaaaactacacagcattgagcatgctgtaataaatgttgtactcccacactgcatggactatcccatactacatgttttggagaaggatctaaaatcacagagaacatagctccagggaactaatcatctgtttgaggagacccagccaacataccaatgagctagaacagcactgtagcataagagataaagtcaagtccagagaatcttccagaaaggggaacattttgaggtgaaatttaattaaatgcctttttagacagtcccttgttggacctgattgtgagatcatgagcccatcaatgtaggatataaattcctcctacctcacccattgtgggagatgctctgtgaggaccgtctactttctctaaacacttcttcacactattgaccccaaacaggattatttgcctgagtggaacagtgaggactttatttctaatacagaaaagtggtcttatagttcacagcaaaaatgagaattagaaccttgggaaccccaacctttgttctctcttttagttgatccctatagcttcccttgctgtgcccagttcccttttgtccctgcactgataccacttcctctcccactttgagtctttctacatacattcccttaaaacagagaagtagaggagacaagagaaggaaaggtaacaaaacataggcagtggctatctacttaccctagcattgagcctctctcaggaaaaataccctttgtgtgttattcaggcacaaagaccattttggcttgctttcttcccttcttcctttctttctttctgtctgtctttctctctctctctcctttctttctttcttttgagagggagagagtggagagaagaagaaacagagagagaaagacagagagagagagaggagtactggcccataaaggtacctaaaagactaaagagtgcatttctgggatctgttaatggaaattgctttcccagcttgaaaattgccacatttaaaatcccaatgtggggtaagcaaaatcataaatatgaactccttttcagacagcaaaccagcatttggagtctctctccttgccttcagggatccatatgccacagtctagttagctgcccagcgactgacaagcataaataaaaggtaacggttatagtaatcagagctgctgtgagtcaaaagtgtttcccagggagggatcaacatgcttctgataacactagagtcaccaaatagccaaggttcagctcttttaaaaacaaacaaataatgaaaacaatgaaaataaaaatgtttgctctgtcaactgtctacattcagcagtggaatggaacaggcacctgggattcataatagtaaaagggtcaggccatggggagcagtctgggtttgatggcttctttgccttccatcagtgctccttgccacctaccattggggacatcctccttcatcgtattactgcctcatgatggtctgtgaacccatctcacctaagttaagtaaacactgggcctcaacttaaggtgataccatcatcagagtaatccttaggagaaagtagataaatagaagatgaggcatgttatgtcctgaaagatggtcaactccttgtctaaagaactaggttaggtgttgaaggatgaggtggcaaactcagccaacaaaattgttccagcctgtggctcatgcaccaatgggcccagcacataaacccttataagtcacacttgaacagggtctcagagggcaagtgaggagttgtccatagagaaatttagatggactcccttggcccttgcagatggccctggatatgttatatgtacatgttgtcattgatgtggccagaaactcctgccttgggatttgccgaatactaacttgacttattggagcaggtgtctgtggtcctccaaagctgtcaactgttaagcatggtgattccaactaaaagtttcatgatcctcactgcctttctcttttaagcctaaacagcagtcatgtaaatgaagtaagattgttctgaaagcctcaggaaaatgactcaaccatggccttctgatgaatctgttttcctctgtcctgaaatgtctgaagtgtttaattacaccttaatctgactctgtcctcttctacttctcaggttttcctgaaatttgcctaattatttctttatgtgacttgattaatagaatgccaatcatgttgtttttatatctctctttctatgtctactgtgatgtgagaaacactcagaggaatgggtgagccaggtgccttcccctgctccctactttgccaagttgataactcctttgacccttgaacattaaccatgagcaccgatgcccgtctttcattcaggctgtattaaagtccactttgcaaagaaaagaaaaaaagaaagaaaaagaaatctataaaagcagacaggaggggaaaactattggggccattgctttcaaaatacccaacttctgaaaacttaggttacaatgacgcctctccataatgggagtcaatgatggagactatgccttggctccatcccccaattcctgcagtgatgttgggggcagggcatcctcaggtcaaagggcaacctggcaggctgggtaatggagctgattcaccgatcccttgggtcacgtgacttgctgagtgttctccacctgttactcatcgagtgttatttattcgtttttaaagaaatccagtaaacctggcagtgttaaaactgaacgagcaggggcttttggacaaattgaaaaacaaatggtggtacgacaagggcgagtgcggcagcgggggaggtgattccaaggtcagccccagtaagaaaaaaaaaaacctagtgggtatgaaatagcatggctggtaaccagcaactgttctcccaatacctatcctgcttcctaatactaaaaagaaaagataaattaatgtcaaagggaagccctttggttgagtagaagtagcatcaaactatcctctacttctcttccaaggggccttctggtttaccacagtttccagtccccaggaccccagcatctgctctggtcccataaccaagatatgaggacattgtgcctggaccttcttttccagaaatgttccacctcctccaactgagggcagggtctgtgtgctacagggtgccctttttttcaaagggcctgctctggatcctaggcatggaagcagattctgagatacacaccaaggctgggtgagcagccagagagcctgtggacagggagggtccccaggcacccatggcagctggacttgggccagtatcttcagcagtagatggtagacgttgctggttactcaaagtgatatagtgatactcatcttgctatactagagaaagaactgtgtgagtgtgttgggcgggcagtgacatggtggggcggggccagatggagtattttagagtatcactttgtcagtgcatatgatcttgttcaatgaatgatgtgaatgaatactgtctgtgctgaataacataaaataacattggtaatgttatttatgttatttcccccctggttgaagaggtcccgtaaacctagcggttttgaaactcagtgagcaaggcgtcttagacaagctgaaaagcaaatggtggtacgataaaggggaatgtggaagcaaggactccggaagtaaggtcagtcaccggctacagaggtcacgcacacctgtaacaaaaatgcacagtgttgaacagtgtcctccgagcctcagagaggcttggaggccttagagagctgggccccagcagggccttgatgtccaagagtccaggcagggttaaaaagtttgaatatcagcacgccagtgtttcccaaccccatggaacctgatcctaccccttcaaaaggctccattatccactgtgttctgaaaaaaatggaagcaaaccagtgaggagttatatgcaaggctgtcacctcatggcaagtactctttgctgtgggacagggccgtttagcacacaacccaggatggtccttttggctacccctaattatttacccaaaatgatggtctgggtcttgctcagggatactgaactctttttttttttaactttttttttttttttttggacaagtcagacatcaagcagctggcatgatccctcacctttattttaaggataccctttggcttacacattcaagggccattgaattggcctccaagcagggttctccatccaggtacaggtgtgaattcatgatgagttgaaggaagagagtctcatgacctgaacttgttacctctatcacaaattccaggctttagagttgaaagagagcctgcagaggatttaatcccaccctggcaaaacttcaagcattcacataccacctgtgtcgttatttgcttcacgtgttcctttaaagctactatcttcattactactttaatcgagttcatataaaaagtagcagcactactatcacaagtagaaagtcagtacttcttgcaaaaaaaagaaggcaaccatataaataactataatgacaacaaaaaaatattaaattacagtcacctttacaactgagggctgctgcttcttaaaaatcgagaggagcaagtgatcagtgttaaagatgatcagcaccaaactgagattttcttgttggctttactcagaaagattaaaagagaattgaaaagagaatgacatcctcactttgtagtcaatgtcatttacttcagtgtatcatctaacactgtctcccataccatccagaggtgggcaacactcactgtgtgactcgcccaagattgcccagtgactcaatgataaagctgggcatgaattcatgaactgagcttagatatcctgcccccacccccaccccccggcttgttttataatataatgccacactgtttcaccatcagcagggtaagtccatccattctggatgtactcactttctttcccctactgtcagcaaggcctggaaggcaaaaggactgaaaacacactgtgtacaagccccatccctgccctcctcacaggtaaagagcattggccatctggaaggacctgggaattcacacaatgatgctctgctccacttgctccttccccttcccactgaatgttcctgcactaaagagaccccaggagggcaatgtcagagggacgtgagtggagaaagaaagcccttgagaccaagagatgcagaagtcattccattacccccacgccctagagactttgggctccagctatgttcctgctcagggtcaggtttcctgatttctgtaaggcacagtaggcaacagcctggagagaaccagtgacttctaggtgaatcttctgggagttatgtgtggtccaagataacatgtccgacatacaacagttatccatatcagagactgaatgtcaaaacaccctggatcctgtccaaagtcccaaagccacacatccttaaattttctaacactgccctagaggaagggactagacaaaaacaaaagtgtttcttttaaaactctcttctggaccttgagccagaaacacctctggggacaatttcccaacacacaaggcccctgctcaccaatgcatagtccaagcacatattcaactcagagtgaaggctttctgtggggacacccatgttacactcagactgatgcttctgttctgaaaaatacctcccccttttgaagaggcctcagccttagccagtccttgggttcccctctgcaagccacatcatctcctcaatgcaattttgttttgagtcaggatgttctgcggtgcattgtacagcagccggtccctgagcacacactgctgagaaaagccacccccacagccatcactttcacagtatttgccttgctgattattagaacaatgggccagttctcatcccatgtcgctcttggggaaaatatgaaggctagggaactggcctagattggaaatggaagagcagacgttaccaattaacacgagctccttttttgcattccctaaaggtattagtctctagggagaatttttaaaaggcatgatcccagaccctctagaaactccttaggtgcctcaaatgttttgggggtggggacaagtgtcaaaggtcatttggtccagttctgtgttcagtgcttgaattccttacatgaccttgtcatcttcttcctgaatgtgttcatgtttgaggaactcaccacttcctatggcagtgcattccaccttttgacagctgtttatttaaaagctctcctttggttgaaccaaatccacctccccataattttctcactttggtcttagctaatgagtgagcctagccaaccactcagccttcactcccaggaagtagtcaactgctcagggaaacggtccttaagccaaaaatacaagttttgagaaagcacaaaagaaagcctactgtagcagaaaagctaatgggtggacctttctttgtggccctaaaaggctaagtcagattacagattcagcatgtggagggcacgtaggcttcccctaaaaatccaggtgtaaacataacagaaaattgtatggaacttagataggatatagagagaagcaaaactgcttttgctttgtacgagtttatactttctccaagaagataagaaggaatgaaagcatttggagaaactgaagcttggcctgaagttagcaggtcttgatggcaggcaacaccagtctcagtggaagtcactggtctgacggccaaaagccttggcttctccctagagctttctgcttattccataaagaaagtttcaagtctctctaccctaggactagctcagacctcctcatgaatcagccctacattcttggaagggatgttggctcagaagcacagagggaacctgagacagtcccccagtatgtggaaagaacaaggagaaatatagggggggaaatctcctttccatatgagggagacagcaaatcaagacaacaggttaaggagaacagatgagtgggggggtttcatcaccactcgtcaccattcgtcaccatagcaacaagcccagcgattctgcaagacaggagttatatttttcttttcacctgtcactcttcttggtactgtcactctctttccccactcctggcgggaggtgaattgtgacttttccacccccccctgacaagctgcctagcttttctggtgtgcagctgctatggaataggagaatggggtaccctgaggggtgctcagaagactcaaactccatctctcccctgtccccgatcacagctgggaagtgtgtagctgtgaaatgtgagtagctgtttatacacagatccacgaggaagctgcctcttttatggacactgcagaccagaggaaccagagctgtggtcctcaaataaaaggaatttttgtccctgccccaggatttcccattttattcccacagagtgagacaaagagagtcagtaaaggcaactaaacagaagaccatggcctgaggcctccttagaaagaccgtatcaaaaagctaatgacacgcttaaagggaatcagaacattttgtgtaaattgaaactcctcagctatctggactaagactacaccaacaccagtccttcatcccacatcctattaaataaatctgaatttaggtggttgtgttacctgtgatattggtggcaattgggcccaggttctcccttgattccagaggtctttcctgattcctctactacagagctgtgtcagcataaacagtgatcaatgacattgtgcatccttcaaaaggtggcagttcctataccgtctagctgtcctctttgtaaaggatgtatcccccctcacacacattgccatctccctgggccggagaccttcttctaaagtgaaggatgctcttcacctccagacataatcagtcattaggccctccttctttgcctatatagaacatgcctttccaccccccgtccatatgaaaatctcaccctacttccttcctagatatactggaagtgaatgctcctccttgtaaaccagggaggcagataccctcttagggccttttgaagataataacagaaaaagatgcccatcactcccttgtccttggaggctatccacaaccaaggtaaacctcaagaagaaaacagcttggtgaccaaaggggcaaggtgtgctttggctattgaaagactgatcagctcatgaagtcagcagcctccagctttcttttttaccacctgccctcaggcctgtccctctacctactccttctgagctccactgtcaaccactctttactaaggtttgagctgataatacatgcctcctaaccccacccctacccctgtttaaacagaagagtttcataggaacttctgtgaactgtaagtcccccaaggactctaaagcattactctccagaggaagaaatacatgccttctgaacaacaaacagggagacattttgagtgttctaaaaatcatgtgaagtgggaatttacctgttcagccaactcttgaaccaagcactgaactcattttttgcacattacccttatcaggccattatagaagagcaggagaaattttgcccctttgagtcctttgaataatcatttctactgcttccaaagccaggctatgccttgccaagtgtaacctatattcaagagccatctgctttagcaatacaggaagccaccaagggggcatgctttagataatcctacagctctgctggccaaagctgctactggaagggaagggatgctgctatttaccagctacagtccccaagctcagtcctgctgaatcctgtacaatgcaccaactagaactagggcagaggccactgacttattggtcaataagcgattcctttccatatgccccgattctaataggcagacgtcagtcgaagagtctctagggcaatacggtccaccccttgcatggctcacctacttccccacctgaaaaggaacacatggagaggtataaaggccacatcctatcctatgccaccaactagccaacgatggtgtgtacctgtgccaattgaggcatttcattttaattcaatgagacatttattgtacatgaacaaacaatataaacaaaggtgttagagctgccatgacatctaggaatgagtattctcctagtagttaaagatgttcttttgcctgtgtcaagagtttgactgagcaacttgctgcgcttcctgagccattacctctcaccatgaccatcagttgtgtttgattgttctcaccacttgggaaggtgttgtccctcagaccttcacttttgaactccactggaggtgacagaactcagggatgatctcaggagaccagtggccttcctctggctccacagggtgagccctggccacctcccaccatgaccatcagttgtgtttgattgttctcaccacttgggaaggtgttgtccctcagaccttcacttttgaactccactggaggtgacagaactcagggatgatctcaggagaccagtggccttcctctggctccacagggtgagccctggccacctcccactagacatgagtacttgtcttcagactcctaggaatgaagcacccttttctgtgaccctgctcatcccaaaccagtgtaagatcttttatctcaggcaacagagatttctaaattcagccacctgggtctgcctccagtgtttttagcaagcacctccaacagaaaaatgatatcaattaagcataattattaagatttaatagagccatttttctatctcagagcctttttactattctaagccccctagtttttcttccccctaaattggcactcagagcagtaagttaacatatatatcagttggtctttattatatatacaataactgtcttattaaattgaaatcgaatgcacatctaggggaaagttcattgtaagtaccaactctcagaaaaatgctcggggacataaacaatgagtgaggccaatgggttaccaagcaacagaggaaattggggcggggggggggcggggggcaggaatggagctgaaaaggaagggacatggttttttgaaagaatgggctaagctcaaaggtgcaaattttggtagaagctgccctaaatttcttgtgatatctctcaccctagaaaaggcattgaggagtggggaattgtaattacaagttcaacatagtcagggaggcttggaaaatgtataaatacatatacacacacacttttttcctggggaatgtttaacacttggtcaatgaataaatagcctatccagctattgcaaatgttaaagagggtgtggggttgtgtgtatgtgtgaaaatatgctgctgcttggatggtctttagcctcttgactcactttattcttccccctccccttcctttccctcctcctcttcttaggacaagacaagcgctctgagcctcagcaatgtggcaggcgtgttctacatcctgatcggaggacttggactagccatgctggttgccttaatcgagttctgctacaaatcccgtagtgaatccaagcggatgaaggtggcatcgtcttcccgggcctttttcctaacctgttctgtgatgcagctgggtttcctgggagtccctttgctagaaagggtggggaatgacaggtggttgaggtcagcacaagacaggaagcaggaagctgttacgaggaaggtgacggggacaaaggcagccatgagaaaggaaggaagatggggtgtgtcaggccagacacaaggcccaagaaaaaaattgcatttgccagagtggggtcagtgagattgaaggctagtggtttacatggataggtagtgcagcgagaggcaagagtgatggctaccaaggctcattctctctgaagtttcatcagaagtgtggctgcaaaagagaggaaaggatgtctaccctctactctgtgctgaccttgtcatacctggtgaattgggtcttttcttaggctccactctaagaaatagacattgacaaagaggaccatgtgcagagaaaggtaagcagattagtgagatgaccccaaaccacatcaaatgtagctaacgggaactggagaagagaactgtggaggatttaagagctgtctgtaaaataccaatattttccaagtggaaaaagaaaacaggctagttctatggagtcccaaagtatacaacaagaacagatgactaaaggtgatagaggataaatgttaacacgatacactaaatttacttttctaaaagagctatctaaagaaaggctagaatatcccaaaaagtagcaagcttcaacatcactgaaggtatacaagtagaggatgaataactcttgacaagaatatggattcaagcatcaaaaggcagtttggattaaatgatcttcaaggcccctcaacatttagcttcagtaagaaattatttgtggaagttaatcatgtgaacaataccatgatcaaggcatcatgaggactcagagaggagggaggtgcattctatgatctccagcacctttcaccttccacaaagaatgggcacaaaataattactcagtgaggcaatctatggcatagataggaaggcctacaggaatttagagaagaaagattgaagaaggcttccaggaagatgccaaaattcagaaggacaggtgggatctagatagagaaggggaaagaagtacagtccctctgggcaatgcagccatggtgatatgctgacctatactgttaccttgatttgacaagactaacaagatcccttggtagaatttgctttattagattgtaccctaagaagcctacttttcaacagacatttgcctccaagctcagtatgcccactcttggatccatacatagcctcctgcccagcctctccctgccttggaccctcaatcctacacacacctccggggtcgcccttggagaagatatctctgaacatttgctcattctgtttagaaattctgtatttagttctgtacatgaggagctgggggccttctgtcctggcattcagcatttccctgtcagcctacctaccccactcccaccctagcaatctgctctcctcacgtactccatactttcgcccccacctcatgttcccactcatgtgcctttttatgggccgatccctcaccctgtcttctgtttcatagagcccatttaaaaggcaacttctccaagacacaacaaggaacaattaaggaatggaagttcaatgacatttcaccagggacctaggaacaccccaatcctactcttgaccagctcatccatctccaggtccctctcatgtcctctcaaatgacaagaactacaaaggcatgggcttcagactctaaacccaatgtagacctccaaggagcttggctacacacacaaggactcctagaacctactcaaagctctttgaccattccattcaaaacacaggactaaagactctcctaccttaccctccaaaatgaggaaaggttactccggtggcaaaaaaggggaacaggacaagaactaggggagctacaacctgtaccatccctcaaaaccttctctatagaccatgactcaagccagaggcccagagttggcccagtacagattataaggagttcctttcttctcattgcttgtctaagacacagtacagcatcatcatctagagtagaagctctggagaatgaacgtctgggcataaattctatcttctccatttgttaactatgtcatcttaggttttagtaactctctgatccttatttattaattaattaatttatttatttatttatttattttgagacagagtcttgctctgttggccaggctggagtgcagtggcatgatctcagctcactgcaacctccatctcctgggctcaagcaattctcttgcctcaccctcccgagtagctgggattagaggcgtgtgccaccacacctggctaatttttgtatttttagcacagatggggtttcaccatgttgaccgggctggtctcaaactcctgacctcagataatccacccacctcggccttccaaagtgctgggattacaggcgtgagccaccacaccaggcctctgatcctcattttctataaaatggaggcagtggtagtacatacctcataacattgttgtaaggattgtatgaaataatggatataaagagcttggcaaaattcctgggccccagtaagccctcagtaaataataatgacaatgataactagtatttcaaataatagttgttactagtggccagatacatcctccttaaaactttccttttattatccctatttacatgagctagggttcttaagctatatagattgtgagttccttaaggtaaggggttgtgtggacatcccacacactgagagtaagtattagtaaaattaatgtgaaattgtatccaaaggagaaaatctcttacaggatgaggcagggcatgggagggagctgctcttagttaaagcaagtattgccgtcaaaaccacccagtctaggaattacaaacaatatcatccaaggggcagttttggccccatgtttgtgctcatgaactatgacgagaccagtcatccaccaagcaggaaagctcctggacatccagccctttctctgggattacagtgactcccaataatcataaccagtgccaggtggtggtgccagagtggctaatgcctgggatcctcttaaaactgggaccatgttgaccttcactgaagtcacactatttagattaaaatgagaatctttcaaagaggccactgagtcatggcatagcttcttggggacattctcacccttccctttacaatgaagatgttaaatttttcagaagccaacatcagggtctcttggaatcattaatataatgtcttccaccacaatcttctagaattaattccgttgattggtgtgacttctacccaactcactgaggctcctaatagaatttcccatcttccaactgcagaaaaggtactttctttattaatcaacccagccttaattgttgatgctccatcaactcctctcttatccgaaagagataagacaaatgcattcaacttgcctctcagacttttcagctttgcagctctctttatttttctgtgcttagctttctccaaaagcaattagttcttttcagaagtgcagcccccaaccttacagagacccaaattggtgatgacatgggcatttgatgagagctttccctctcatttctttccattatcacagtatttggtccactcttttttttctttattttttcattttattttattttattttgagacggagtctcaccctgttgtccaggctggagttcagtggtgcaatctcggctcactgcaacctctgcctcccaggttcaagtgattctcctacctcagcctcccgagtagctgggactacagtcacgtgccactacacctggctaattttttgtatttttagtagagatggggtttcaccatgttagccaggatggtctcgatctcctgacttcgtgatccactgccttgacttcccaaagtgttgggaccacaggcatgagccaccacgccccgcccttggcccactcttaaggccttaaccccctaaactcgttcagggtcatcttctcatgtggctcaacagtgcttaaaaacatcttcctcactcttcatggatgaaagaacgagatgaagaggggcagaaaagagaaagaagggtggaggagagagagagatgaaaggaagcgaagaaggaaagatgatttttcagtaacttttatgttcaaagtgatttctacacattttcattaaccatgcaataagttgttcttacaatcctacagatgaaataaaggttcaaagaagctaagtagcttttcctgactaggtcacacaagctagaaactaaaaaaccaggaattagaactccaacatggtctccacaaagcctgggcttttggtactagccaagccacttttcctaaatctctctgtcctccttcaaccacatggcaacggatcatttttgagcacctattctctgttcttccagtcccagccacagtgctgctcacaaagacaaataaaatgtagctctacccttcagttcccctcatctgactgactatagtatttaaacccttgctgggtgttgatgggtctctttcccctttgacatgtcgatgagcaggacaagtgtcacagagatagtgggaaggcaccctacaggcatcccttccacaaagacatactgagcaccactgcgtgctgggcaaggcttggcactggggatacagtcaagaacaaaacagacactgcttcttttctcaagaagctcagagtttgatggggaagacagaacataagcaaacacttgcatgttcaatgagtgttagtgaaaaaaatgcccagtgctgtcaagtatagagcagaggcctgtcctgataaaagaatgggtcagtcagagcagcttccctgagaaactgatatttaacagattcaaagcatgaaaagaattaagcaggaaaatgaattgccagccatacacaagtgtcagagacccaaagatgtgaactcttgcccagaaaggggaagaaggccaaggagactgggacacagactgagggaaaagggtgatatgtgagagtgggagactcagagagggacttcaggcagctcataacatttcggtctaattcaaattgtcatacaacagcagaaaatacataacctaagacacattgcaaattgaataaaatctcaggtcccctgcccctcccctctgcctgggcaaacagactggctcctgaatccttagctgatattaagagcagcaaagtattattcaccacctcattcccaaaggaaaataatccccagcctctctcacccccactagagatgctgacctttcaaaattatatacagctgtgctaacatagggcatgtttaagctacagcaattgagggcttgcacattttcctggaattaatgaacagctgagagacttgataactcaaggggagcatcctccacagcaggtggtcactggtgctttgcacgcctgcctgagcaaagacattactgaagtttaagctttgattaggatattctatgtgcagaggctgagcactctcttcttagaaaagcaagtggctgagaagttaggatgcaatcactgttagggaaataaggtcccaaagggccaattttagggtctgtaagttggattttttactcatccctttgtctctgaatatcagttccaaaaacaccaccaccaccctcaaggatgaactttaagaatggctggcatgtcaaggagggataagggaaagccacattcccaaaggctaggggagaagtgacagcagtttatgacagtttagccacgacggggggcggggagtgggggggagtaggaagaatcacatttagaaggtcattcatcttgtcactaggtcacatataactgttaccttaaacaagtcagtcattgtcatcaggttgtctgtaaagtaaaagaacaaattagatcatgtggttcaactttgcttgcatttttgaatcacctggggagcttttaaaactccagatgtcaaggccatacaccacaccagcatctctaggataggattcaggcatcagggttttttccccaaaactccctggatggttccaatgtgcaaccaagtttcagaactagtgatgtagttgacattaagcattgctttccactgcaaagtttgggctccatttatcatttctcctgactttcataaatgtattcaaaaagaagccagtgagaaggtagtaaccatccatgataagggtatggagtcattgactttgagaagtgctcagcttccttgaataccaactctaatgatgtgaccttcgagatttttagttacatgcctggctaaattatctcagactttggcaagcaccaatgttgactaggttatcaatcttgtcctttaagacaaattcaggaagtaccaacaacttcaatggaatattatgaaaatatgtgagccttatgaggaacaaagtccagggtgatctgtgtaaactttagtggtcttttttccttaattaaagggatgtggcagagaaaaatcatgaatgatagacattccaagctaatctatagaagtttccatatttcccacagatataaataaaatgttattttctcttcaacatttttaggtgaggataagtaaccattaatttatcatattttcattttacatttccctggtgtagcttcaaggtagtatttatttggcctttgacttagaagaatgcaatccaggtcacactttttcttcaatggaagacagccaagggagaatgtaaataaatcaagtcatgggtttgaggaggagacagaaccagtgtgggtggtgcatcatatggggcaaatctgtctgaatcatggattttaaaaagaacattttaaaacattgtcagaactgccagtaatacaaggatagcaggggaaaaaaatgggtcaaaactgccctgtttatctctgtctggccacagaaggttgactgatttctctggtcactagaataatggcaatatgtcagagaggaagtcatagactttttgagatggatcctaggtggttggtgtttcttagacaaattcaaaagcatcattatgcatctaatttcttactggacactctgtgggatagctgaggattgagaagacatggcccttgccctcctccagaaagctgtcttacagaagacaaaacttatacactggaggcagaaccattacaagagaatgtatactgcacgagtacaagatgagaggagccagcacttacagcaggctggtgtagtctaggaaggcttcaagacgacagtgagaacagaacgcaccttgaagaagaggtagggttggtcccattgacaattctttatattgattcccaccaagaaaccaaaccccacctcaaaaattctgtgattgtttcttaatggaaagtttgagatggacagtaaaatataagagtctggatttcctatcatcaatggtctttctccaaaggaacgctcaacagaacgcttcctcttgtctaagacgatatggttctagaccttttctgtggtcttgaatatcccacttaactcatctgattctggggtgatccttggagtccttttcagacctagaattccaacattctagaagtcacaagcttagtggcactgatctgatatgtcagtctggaagtacagggtctacatgctgatgggaagcagttgacacacagatgataatctttggaatgcattctcattttctttagcacatgttcctttccaattagattttgcatattgtattattcaaacgagtcctacattcccttaacacatgccgctatagaggtaggctagaattttttctgaagtaaatcagaggtagttttccattttaaccaaacaatatcacatcctcaatttatttgaacatttcaaagcatttttcatgcggtagcaccattcttgctataataacagtgtgtaggtgcatagataatcatgtcatagacatggaggtttaaaagttctagaacactaaggagatatgtacagtcacatgactaattaatgtcataaccagaactagaatccaagtttccaaacccctttcccggaaggttttccacttagttgtgttgctacatcacacattaatcaataataccaaggaaatattccacctttagaaatcacagaatgtaagaataagaaaggatcttctgtctcacccaatctaacacacttcattgaacattcaacttgaggctaagagaggggatcagacatgtccagagccaagtgatagttttctgtgttcctgagaagtcagaattagcgttgtagaataggaaagggggtggatgggaaagcagagttggatttacatttgaagtccagtcttgactcattcccattgcctgtcattgccaaggacccggggaagaacccccggtcctcctgaaaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagccccatcccaaacccttcagtgccaaaaacaacaacaaaatgaaacgcaaccaccaccaaccactgcgaccacaagaaggatgattcaacaggttttcctgaagaattgaaaaaccattttgctgtcccttttccttttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaattttttttcttactaatatccatggtttgcaggttctgttaggccctttccttctccttacttcttatccccaactccctacccacccctcttcagttttcagattggagattcaagatttgttccactttacaagcaagaggaaaaaaaagcaaccttcaaactaattctccatgggggctctccatgttaccctccactccttggcccaaacctctgatggagatagacattgttggagaagtgggctgccttccccaagtggggcactgcttaagcacttattcagtggagaacacaggtgaaaagcaactcaggatgagggtggtggagagggcaggggcagatgtgcagtcagagaaggactcctgaagttactgctgctcagaaaaacagttcctttaatgtggaagagccatttcataggtcataggtggtatggtatatttcttcagagtcaaccttggccctgagaagtatgtcctcctggtgtgctcaggctcaacggcagtctggtggctgaaggcacttggcctcctaaaccaagcagaattttgggaagagataacagccagggagatattgcccatgattctcactttttctttgcctggcatctaagcaggaacccattgtggagtagactctcttcttctatggagcctctgacatggggagcaatgctaagcaagctaagtgtaaaagaaaagtgacagaataattttggaagaggaagcctcatcaaaagctcacacaaaatagagcttcccatggtgtgccctatcctaggtttaagaaaacacgtatgaagtttatgctgatgcaaagaacttgggtttttatgttaatataaagtgttgttttagcatgtggccagatgatgctctgtcatctttagaaagtgagataaccaaggaaataattgaaggagtatagggagatggattaagttgataatgacatttagggcaacttaagacctttgatcccaggttctaactcaaagaggctgaccttcccccagctaagatagcatgaggacgttgtattccaatatacgtatgattggggctacaaagctgaactaaagcaagattggtgaagtggcagggtttatagagagaagcccaggctgagttcagcttttgttggaagtgagaatccctgacatatagctttcttggagatcccaactctcattcttggtgcaactggcttccagctctccagcagtcactctcctaggtgcatgattcagtgcgtgccatgtgtcattagcttttactgataaccatattctggcttgttcccttaccccctacttctatccaattttctctgctaggggttatcattagcaattgacatgctaaaggttttggagcccacctaggggtaggtgcagctttattggcttttctgtggattctctcagtggacccacaccatctctatgtctctccactctcctgccttcagccatagcaaagaatccttccaaaatcaaactcttcacttttttgactcaagtgttgttgttcagtctctcgcgtgtcaatgtggtcatggttcatgaaaccggaccctcaagatggatgattgcttttaactactgccagctgatgtctc

SEQ ID NO: 14140 - DNA, 25973 bp, Human
gcctgctcctctcctctgggctggactccccctgtagcatcacagcattggaccagggctgtggggggaatgggcctgggccagggtcaggtgggtcttctgcttgcttctgcctctgccgagtctatgagtgtggggcttttggcggagcaagggcaggggcgagcctggctcctgcttccagctcaggccttgtccgctcttgcatttgcctgcccagtaaggggtggcgtgttcctgagagcgccggctgcctctgggttcttatcttcatgggttgtcatccctgaagctgtgcgttggccacctcattgcctgtggattcctcccaaccctggggtgtgctcaccccaagccccttcctcccgtggctccctcaccccagctccttccagcaaacttcctcctctatcaaagctgggcccctcctctgggaggcgttccccagtccagaacccacagggcctggtccctcctctggaccctgcagccccaactgtcagaactgcctgcctcatcgtccaggctgggcagtggcccaggggttcctcacctgctgtttgatctcaaccctcctgcaaggaggaaagagaatgggaagaggccccactctgtccgtgccctcctcgctgccctctgtctgtctgcctgctgtggccagccttctgctgaaggtgtggtctgcccttggccacctgaggggactgaggctggcacaggctggggacgccagggtgtctgtgcccatgctaaggaggccccagacctaaaagcccaagctcctcaccctctaggagacagtggggtgtctgcagcccaaacgggccccgagggggaccttggcagcagggctggggctgcagacacagctggggagacggagctccttagcctgggagctgccttttttgagtgacccgacacctaggctatgggacagcttgggacctgcacagccggttacggggctggggtccagggtttgttgggaggctgatttcggggggccgtgccctaggaagcctggcgggcaagatgagacccctgcagctttgtggcctgtgctctgtggcctctgtcaccctcaaatcctgctgtgagggtggccccaggccccagaaagcccctttctccagctgcctctgcccaggggtcctgtcctccctgggcaagttctgggaggagagggagggcgctcagcagccagtggctagaatccccattccctgcttccgggctctgggcctgggcagggcactgggcttggtgggggcagagcagccctgggaggggccgaattctgagcgggccttggggcaggggccggtgagtacgggagcgtgctttgccactcagccataatgtactttctagcaaaccagatgttagcagagctggtgtggttgcggggacgtgaaaaggctggggatagagtaggaatcgaggaatgccagagcccaggcctagtccctcagtcccttggtgtcaaagggcacagagatggccaccttgaaattcatagaaccgggtgcaagacataacagccctctgtgtggcctcagatggcagagcagggtggcagcagctgccctggcaggaagagcatgctggtaaggtgacaccatccctgtgtgtgttgtaaatgctgctctgtgctgggcctgacacccagggtgcaggttgtttcatggtttgctagggagaagccgagtattcagaggtggccctgcggggaggcagcagggagcttcctcccagggatgcagctgaccttgcgctggagccagagagccctggcctctgaccacaggatgggagggcaggagcagtggaaggtaggagttaaaacccggatggtggatgaggggcagccctgggccccaggcagctttcaggacctcacagggtagaaggcaggaagtgccggctacttggtgctgcccagggagcagggaacaggaagtcccgggtggggaggaagcaccggcggccacaggcctcagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcaggtcagtggggcggccccaggactggggctcgggaggcggcactggtctagcacctgaagaaccagtaagggggccccacgtgggagccacagccttcctcggggctggccgtgggagcccacaggaggtggccctgagcctgcaaaaggcaacaggctctgaggagagtggcctctgtctgccttgagaggcccccgagctggcaggcacagggggaggccagagagggaatgtgatacttagaaccccccccacccccccatcacatgcggccgacagggaggcgggggccagcctgctggggtggggcccaggtccgggaacttctcatgatacagcctgcagggtggccttggtgtttgggtcctaagtacacacatgttgtgtatgtgagtgtgtgtttctgttgtgagggggtaacggagagagctgtacaaggtccctgctgcccacctggggagtgccatgctctgaaacctgcaatgtggaggaccctcagggacctcagggactgccgggctggggctgtgctcgcagagcccaggctgggccaccctgcctctggccagcagtgcttctctggcatagctggttactgggcctttacgggagacttttggttttgattatgttaacagagaaagattctgggaacaggaaggaaacaagggaaaccgaaaaggaagagcagacagctgtggggaggcagggcagccagggctccaaggtggaagccgccccatctgcacatcccacgcccaccaccggccacccactgtgcgccaagctgggccgtggctgtgctgggccgggggtggtgcgtgagccaccatttactggctgtgtgactttggccaagtttcttcgtcagtgacttggggaggactctggtttgaagctcaaggtgttggatgatggggcgatcactgagaagcacagagcttggcccacagggagtgcccagtgcgctcggcacaaggcctgatcctctcccagcctctatacccaagtctgtaaaatagaagtaaagtattgagctcaggtggaccctgggcgatttagtgagctgtgaggtacagcttggcactgggccctggcagggctgggagtggtggtgatgattctgtgctcaggcttcaggacacggagacacagaagaccgcacttgacaggtcttgttggtcgttggaggctgtgtgtgtgtgaatgagtgcttgcatatgcatgagtgagtgtgatgaatgtgtatatcagtatacatatgggtgtgagtgtgcacgtatgagtagacatgagtgcatgagtgtgtatgagaacatgagagcgagtgggcatgcgggagaatgagtgtgtatatatgtgttagtgtggatggtgtgagtgttaactgtacatgcatgagtgtgacaggatgcgcatatatgagcgtatgaataaagtgcacagggtgacctggtatcttctccctttgggctggatccccagccccaacttgccctgtggctcccacaaatggggccaacctgatcaccactaacagtaagtccttgaccctgtggtcacatgaggtgctggctcccttaccacagccaggatgatcctgcaggagcccagcctcccagagcccccaccctgctcctatgcaggggctcacgcctgtgtgcatgcgagctgtgcagctcatgtgcacgtcctgtgtgagtgcaccacctgtgacattaactgggtgtgcagagacacagcgcacatgagggcctgcacaggccatgaccacacacgccacagggctcatggggccccagggtggtgggagccacagagcctgcattaaatggaacccgatggggtgtctctgtgggactgagcacttttcacctgactgctctgccccccaccgcagcagcctcaggccttggggtcacctgaaccaattgcaactttgagagaaggtagggagatgagcacagaaacagagacctggagagtgtatcccaggtgccccgtcttccctaatgtgcatgtgcacacacacacacacacgcacacacgcacaagtgtacaggctcaaatgcaaatctccacgtgtgcacacatgcaaagatcacatactttctggaagggctcatggagcccagcagccaccaccagctttggccacccaacgctggcccatgtgtctccagagccctgccccagagagcagctgcagaggtgtcaggggactctgagagtggactcctccatacccactttacactggaggaggtgggggctcaggggaaggaggggccccaggaaggatgtgaacccagatcttcagcactctccctcacagctcctgcccatgttaactcagccgacaccgcagcagcatggtgacaggtccccccagggtgtctgcctctacagaggaagggactgaagcacccagagagctggcaggtaggcctgtggagtcccctggaatgaatgaatggaatttaaccatcaggtccctggaagaggggctgggcactgagaagcacagccagggaggcctggccagctaggagtgtgggtgctccttggggatgccccctggttttcccgagcacaagtggggccagattctgtgagctgggctgaacttccccaagagcagcatggtcaccacggcctccatggcccatcatcaccctcagcctcagccgacctttcccctttctgctctcagcctggcctggcactgggctcctggccaggtatcaccccctggcacagggcagggccaggtggggcagaggatagtaaggtggcaggggtgggtttccccttgaatggcccctcctctggagaggggctgtgggtgtcagcgtctgtccctgaagcgaggaattcccaggggaggtgagggtgccacatgacctgcccttgtcatgacctgtccccctgcccagggtcagctgatgatcacctaagagccttcatcctgcccacagcgggacagcagccaggcaggaacgagcccctcacaggcctgcccctatctggccactgagctggacccatgtaggactgtaacctgtccctgtaactcttcctgctgagccttgtccaggtgtggagccaggaggaggtggtgggttccatctgtcctcacagtggctcctcccactttgacacacaggccaggtcttatagcttttgggtggcgggggcacagtggggtgtgatgccccagggtaggggctctgtttcagcttcctgtgccttccaggcaacttgcagtccctgtcacccacagggtgaacattccatccttcttttggggctacctgggtgtcccccctgggctgggtctgagctggtgaggatgggagacaatgaccaactagtgtggtcagtgttaggggcagagaaggctatgctagccccaagggagggacacaggactccagagaggttatgggagactgcctggaaaagggaacgcttgaactaactcttcctttcatttttggattgttgctagtatatagaaatagaattgatttttgtatgttgatcttatatcctgccaccttgctgctcatttattctaataattttttttttttgagatgaagtctcattcttgttccccaggctggagtgcaatggcgcaatctcggctcactgctacctccacctcccgggttcaagcgattctcctgcctcagcctcccaaatagctgggattacaggtgcctgccacctggtatttttagtagaaatgggggtttcaccatgttggccacgctggtctcgaactcctgacctcaggtgatctgcccgcctcagcctcccaaagtgctgggattacaggcgtgagccactgcgcatggctattctaataatttttaagtggattccttgggattttctgtatgtaaaataatctaatcagtgaataattgttctttctttccattctggataccttttatttctttttattgcctaattactctggtgagaatctccagtactatgctgaatagaagtagagcagacatcctttccttgttcctgttcttgggggaaaaactttcagtcttttaccactaggtatgttagctgtgggtttttcatagaaccctttatcagattgaggaacttcccttctattcctggtttgttgactcttcttatcatggaggagtgttgaattttgtcaaacacttgttcttcgtctatcaaaatcatgtggttgtcctttattctattgatatggtgtattacattaattgttttgaatattaaaccatccttgtattcctgggataaatcccacatggtcttggtgtagaatcccttttatatgttgcaggattcagttggccagtattttgttgaggatgtttatgtctatacccataagggatattggtttgtagttttattgtgatgtctttgtctggttttggtattgggataatgctgctctcatagaatgagttccctcctcttctattttctggaagtttgtgaaggatccatgttcttttgagccaactcttgatggctgggttagttcagtttcaactttaggctgtggcaacagcaggggctgaggcctgcaagtgggtgcttgctcgattcaggtaactggagccatagggtctggctggcgtaagagcacagaaggtagagggcaggagtggctgaatcaggaagggccaggttggcatgaggaggccctagaggtttagcactgagcagtgatgggaatggtgtgcgtgttgattctgtgctgggtggagggggctggaggcagaggaagcctgaggagaggaagtggagggggttgccaagaggcaatggagaggggcctggcagggcggctggaaggaggtgggatccttgaggcaggccagacaagggcactgagaacagaggcacagagatgggacagagcctcgaaggctgggtgcagtgggaagaagtccagatagcgggcctgaggtggggccttgaaaccagggtgggtgcccaggatggacagctaggtagggtcaggcccaggctgttagagccacacctgcatctggcccatcttggtggcagcttgtttgcaggtggaagatggaggaggcaggatgcctgggaggccagcaagggcctctgccggcctttggccaccccaggggactctcctgggtgaggtgcctgcgtttgggcaagcaggtgggaggtgccaaggaccagacccctggctccttggagaatccggggctggaggcccatggagtcccgcaggaaagtggagaaggtgagggcggggcacgtgcccgatcccttgccccgttgccgccctccatgcaggtgccgttttgcagaggccactttcccgagggagctggttgcaagggcccggcgggatgggacctgggcggggcctcagagccgaggctcccgcgccggccgtggatttccaaccaagctgtgtggactggcaggtgttgggggagtggagcgggaggcctcgtttgcatcgaaggcttcttgattccaggctgcaccaacagatgtgggcctcctgtcccaagcgcccaccaacctccttgcagcgtggggaaactgaggcccgcagggggctcacgtgcctcccgcgcacggtgacgcggcagggggcggggccgggaggggcgcgccgggatcctcacctgcccgcccagtcccccgccgagaggggaggagccggcggctgccaggccagggccggcgggcatggcgggctccgggccgcgccgcggagctggggccggcgggaggcgggcgcccgggacgaggcggcggcggccgggggacgcggcccggggccgtgccggtgctcgcaggggaggcgggcgtggatcgccccggggaagccggccatgcccgccgcgtggacgccgtgagtaccgagccccggcccccgagccccgggacccgggccgcgagcttccggctctggaccccgcaccccgagcccctggaccaggccgcgagccccgggcgctgctggtcgcccacgcgcttcttgggggaacaaaggcgggcgtggaccgtcccggcgggcggatgggggactcaggccggcacggggcttgtcgatctgcgggcagctccccgcgggcggactgggcacggggctccctcctccatccccactgcggggctccttcgggccgggcgcggttgggcgggcggcggggtgtggcggcgcctttgttccaaaccttggcctgtggttgggggtcctgcggctgggacccgcccctgacccctccctgcccagaggggctgtctttgggtgcagaaggagctggtggggtccagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactataggtgtgcaccaccaagctcagctaattattttttagagatggttgtctctatatgttgcccaggcaggccttgaacgcctgagctcaagtgatccgcctgccttggcctcccaaagtgctgggattacaggcgtgagccactgcgtccggctattttatttatttatagagacagtgtctcactttgttgcccaggctggagtgcagtggtacgatcatagaccactgcagcctcaaactcctgggctcaagtgatcctcctgcctcagcctcctagagcagctgggactacagatgcaccccaccatgcctgactaattaaaaaaaaatttttttttagagatagggtcttgctatgttgccctggcttagttttctttatgtatgttttttggggttggagctgtagtggaaccagtcccagccccactgggcatctgggtctgaccttagctgctccactaagggcttaacaggacactggccacaggcctgctcccatccaactccactggggccacaggagggaccctacccaggatggagtgagggcaggcacagaccaaacagtgcagggtcggggggtactgttcactgggacaagagatgaggaagatgctggatttaagtgggcaatgagggtgcctagcagaagaggggactcttaacctgggtcttgatggatgagtagaagttctctgcatgggaaggggtggaggtcatttcaggcagaggaggaagcattaaacagcatggtgtatctcaaggagagcagctggagcatgagtaaggggggctggagtagggggcagggcatgatgttgggtcctgtgggcctgggttagccccaaggcagtcactggtcctccactgactgtgtggtcctcgcttgggctcagagggaaggggagtgatatcctgggctggtggggtggatagcagccaacccaccaaatggtggtcacgaccactgctgacaacagtgtgctgtgtgctgggctgggtgtccactctgtcctccagcatctgaggcttgggatctcccagaaagtcacaccaggatgggagcccaggtcgtttgagctgggtgctcttggctgctcacttgccttcttcctgtctaggccccttataggttcacctggcactgggacttgaagtagttatggcctgaggtctcacttacctgggctggcagttttctgagttcgttcatctctacccagcccccgtggggccttgcgctcagtggctgtgtgcagaatgaaccagtggagagaaagggctgcacgtagcgctcaggatcctggggttgggtttgtggctgagtggaccaggggctgactgagtggagcccgtggctctgtctctccctggggtcccacctggaagcccaaggccctcagaaaaggggtttccttgcctgtcatggccctaccctccaagctgtgtcctggatcttggcagtgtccccctgagcgccctggctcagacatctcctgcctgaccgtagctgagccacgtgcctttgtcctttattgcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatgtgagtccctggggtggtagggtgcacagtaggagggcatgggggcagggctagccatgtaagtaagcatcctctccaagcctctgcttcctcacatggtgtgccctctggattttcccattccctctctggtggctggcacccctggagaagcagaggttgacttccctagcccccaggactgtagcagggtccggggtggtgcacagtgctggccagctggcaaggggagctgcagcctgcagccaggacctggggaccacaggtggccaggtaggtctggcctctggtgctgccctcactgaatccgtgaatgttcagtgagttagttggtcacttcgcccacagtgaacctatgtgtcaagtcctggctgggtgctggacctctggagctgcacaagacccaggctctggcccccaggacagctggctgggaggaagaagcagccctcaggcttgagagatacccaaatgctgagatactgaaggccaagagcatcagggcctgagcagcaggtgctccatgcctttgcagtagcagtgccctctgccagggactccctggtcctgggccgcctggttgagatgtccaggctggactgattggttcctgtacgggcactggttgagctgttctcctctttgcacagacagcctccttggaggagctgtaactggcttgtcccccagcctgggacagggctggggcagtggagctagggtggtttcagtgtaactttccacctaggggtggccccacaccagtggctctcactggcaaactctccgggctcctgagtctccctcttttattttattttttcgagacagggtcttgctctgttgcccaagctggagtgtagtggcgtgatcatggctcactgcagcctcaacctcccaggctcaggtgatcccctcagctgggactacaggcatgccactatgccctgttaatttttttttaaatttcttgtagagatggaatttcattatgttgcccaggctggcctggagctcctgagctcaagcgatccatccgccttggtctcccaaagtgctgggattacaggtgtgagccaccgcatccagcctattttttatttatttttgttttttatttatttatttttttgagatggagtcttgctctgttgcccaggctggagtgcagtgacttgatctcagctcactgtaacgtccacctcctgggttccagcaattctcctgcctcagcctcctgagtagctgggattacaggagtgtgccaccacgcccagctaatttttgtatttttagtagagacagcgtttcaccatgttggtcagcctggtctcgaactcctgacttcaagtgatcctgtcttggcctcctaaagttctgggattacaggcatgagccaccgcgcctggcctatttattatttttatgtctcactctgtcacccagactgcagtgcagtggtgcgaacacagctcactgcagcctcgacctcctgggctcaaatgatcctcccacctcagcctcccaagtagctggaactacagatgtatgccaccgtgtccggctaagttttgtattttttgtagagatggggtttcacatgttgctcaggctcaccccatcttttatttttagagacagtctcactcttgtcacccaggctggagtgcagtagcacgatcttggctcactgcaacctctgactcccgggttcaagcaattctcctgcttcagcctcctgagtagctgggatcgcaggcgtgagccactgcacccggccttagtccccctcttttagctctggggtagtgggagcctccaacagccctgcagcacccagcaagtcagctgtggcctccctgggcctctggtcctggctctgccttgcctcatgctggctccacacagccccccaaatctacctcttctttgtgggcagccaggcctgccctcgggtggcactctggggctagccagtgtgcctacaattttttccgtatttggccccagagtgggctcctggggagggggcagcatgccagccttgctccctgctcttccatttggtaaggcttagaggcaggaggcctggccccaagttgtcctgtggagggtcctcacagtgggtcttggcagctgcccctccaggctcaccttcctgcccttgccacctcccacagggcccctgcgctttgtcatcatccacaaacgctgcgtctactacttcaagagtagcacctctgcctccccgcagggcgccttctccctgagtggctataaccggtaagtgcccgacctgcctgctgacctcgggcccccacagccagcgggtccctcccagcagagccccagctgggcctgccccttattcccgcccaaggaaagtgctttcccgaagcagccttcgtgcccatcccctgtcctccccgcccagcctccacagtgcctcgccctctccgcgtgtcctgccctcaggcgcaggaccttgggggtgccagggtcttcctgtggctttgtgcacaagtcccagaggcctggacagcctgctctccagagtctccactcggccaccacccagtgacttctgcatctctcctccctccccaccttgccccttcacccaccatgacctctttccaggcagcccagaccccagccagcccaggccctgtcccaaacagaggctgggccctaggattccctgctccagggtcctcccaggccgggatcagtttccagcttcacgcatgtcctgggctgggctctatccagtgatgggccatgagctgccctggagggccttctgcactaacaggcaggtgggcggtggccaggtggcatgtgggtgggggagtgcactggcacagcccatggcctggggcccacacaaagggttaatgctggcacccagctctggttctggttgctatcccatcggagccctgcaccccacagcatttatctatgcctcttaccaccccttaagggcccagcccctcctgcctatgaggaaccaagggtcacatggtatcagtagtggaactgggacctttggagtgactctaggccccggcctgcaccctggccacaggcctggtagggcagccttgccagagcacccagcctggtgccaggcccccatgctggcacagagctccggggtcccctggggaaggtcgttccctttctgcagacagacacagcgccttccggcctccagcatgtgccagccatgccatgaaccctgggcccagtggcagatgcaatcatgccccagggaattgtctagcccatcagggaatgctgggcctgaggagttttggccaggctcttatgggccgtataagtgcacctgccccggtgcctggctggcagggctccccacgtgataaactcagcgcaaaccccacatcctggctgtgtgagtgggccgcagagcaggcacgagtcattccctgaaatgcactcagggctgctgctgggcctcaggggcacggagccctgtggggtaccccagggaggccaagcaggcctgggcaaatggggccagaggtgggagggtggcgtccatgtaaagtggcattggcgggcatcgaggcaggtttgtccttgtctcctgtgcactgctgctcccacgaagcccacccagcacccctcttccatgcccctccatgcccccttacgcctgcctgggcatgaagctcactactgggagcatcagcagccagggcccacccagatctgccctcttccgttggggcgtggtgctggtgccgagacgtgttcacaggggggtgctgtgggaaggccatccctatagctgtgaaccaggccgtgacccctggcgctgtgcccccagggtgatgcgggcggctgaggagaccacgtccaacaacgttttccccttcaagatcatccacatcagcaagaagcaccgcacgtggttcttctcggcctcctccgaggaggagcgcaaggtgactgggggtccgaggacgagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgcccagagcctggtgccagcgcccacacaaggaacatgctgtcctgggaggtgcccctgtgggctgaggggagccacacagccatgttgtatccagccgggtcgcctcctctgaccttgggagtcacagcagagcaggcagggcagtgaaggtggaggggtgcggtggggcccaccctggtggcaccgtgcccaccacagccccgctgacctgcagagctggatggccttgctgcgcagggagattggccacttccacgaaaagaaagacctgcccttggacaccaggtgagcccgggcccagggcataccgggcagtgagggtccctggggcgcctgggcctgacccgggtgtccgcctcccagccccgggcttggcatagaattccgtccttaaaggtttcctggaggtgccagctgggctgcgtctctctgctcctgtctacagataaacacagatacaggacaagcacagatgttcacacacagacgagcgacacgcggacacgcacacacaaacacaagcaacacgcggacatgcacacacacagagcaacacgtggacatgcacacacacacagagcaacacgtggacatgcacacacacacagcaacacgtggacatgcacacacacacagcaacacgcagacatgcacacacaaacacagagcaacacacagacatgcacacacacacagagcatgcacaggtgtgcatgcatctctctgctcctgtctacctccagccccatctgtcacatctgtttctgtgttgccgccatgggtagttcctgttaggggatcatgtgtgtttatacgcctgccaccagggaggcctggcatggcagcagctgggcactttgggttcccagccccctacgcccaccctggctcactcagagtgagaccagaatgattctcctggcggggcgccactgggcagtctgagccttggcagcctcccccgtgagctggcccgacgtgcagcagatactctctggattgggactccctggcccgagacgatgtggagggaacaaaccttcctgtcctttcacaggtggggacaggaggcccagggagggctgggcacagccaaggctgccctgcaggtccctgcctgactccgggctcccgtcccctggtccaagctgttcagcctcgggcccagcccagagtcgcccaagccctcttgaggcaggagcaggtggagacgtgggcacagtcagggcggccatccttgtgggccagaaggggcacctagtggaggcaccacagcctccagttcttctgtctgtccttgtaactgtgtgtgcatgtccgcgtgttgctctgtgtgtgtgcatgtccgcgtgttgctctgtgtgtgtgtgtgtgcatgtccacgtgttgctctgtgtttgtgtgtgcatgtctgcgtgttgctctgtgtttgtgtgtgcatgtccgcgtgttgctctgtgtgtgtgcatgtccacgtgttgctctgtgtttgtgtgtgcatgtccgcgtgttgctctgtgtgtgtgcatgtccgcgtgttgctgtttgtgtgtgcatgtctgcgtgttgctctgtgtgtgtgtgcatgtccgcgtgttgctctgtgtgtgtgtgtgtgcatgtctgcatgttgctctgtgtgtgtgtgcatgtctgtgtgttgctctgtgtttgtgtgtgcatgtctgcgtgttgctctgtgtgtgtgtgcatgtccacgtgttgctctgtgtgtgtgcatgtcctcatgttgctctgtgtgtgtgtgcatgtccgcatgttgctctgtgtgtgtgcatgtccgcgtgttgcttgtgtttgtgtgtgcgtgtccgtgtgtcgctcgtctgtgtgtgaacatgtgtgcttgtcctgtatctgtgtttatctgtatacttccatgtctgtgtgacagagtccttgtgtctgtgtgtctacatgtctgcgcgtgtccctgtgtctttgtgtatatatatccatgcctgtgtgcctgtgttcctgcgtgtgcttgtgtgtgcacgtgtgcatttgtgtgtttgtcagagtatgtgtgcatgtgtgtgtctgtcagcgtatccatgtgtgcatgtgtgtgtctgtcagcgtatccgtgtgtgcatgtgtgtgtctgtcagcttaaccatgtgtgcatgtgtttgtcagtgtatccgtgtgtgcatctgtgtatctgtccatgtatccgcgtgtgcctgtgtgtacctttgtgtgagcatcaagggacctcccaggcctggtgctcaccgtccgccccaacgcaccctgcattgcagcgactccagctcggacacagacagcttctacggcgcagttgagcggcctgtggatatcagcctttccccgtaccccacggacaatgaaggtgaggtctttctccgcatccactgcccgttcgcctctccccacctggcctcctcttggccgctgtggaggagagggaggtgtgttcggctgtgctccttgctctggccctttggcagtgcgcagtagcatccctgggctctggccttcagcggcagggtctggactcacagtcctcccagcaggtgcttgccccttgcctcctggactcagccccatgcatggagcattgctcggagactgggcctgggccggtttggctctcaccacccccctctccccatgcagactatgagcacgacgatgaggatgactcctacctggagcctgactccccggagcccggaaggcttgagggtaggtggggcgggtgggcccggggagctctgggtgtgtaggaagcaggggctgggaccgggagcagagcccctcccaggctggggatgctggcccaggtaccgctctgggtggcttccgcttccctgctgtgtcccaagtattatgaggattggagcagaagaggtgtagctgctgccacctctgctcatttcctcctcccacctcccaggaggagggacaggcacatggcgataagtggcaggtggagccggggtggccctgggggttaagcatggggaaggaaggacgctgaggagcgcgcaggctcagggcaggtccatgtccccatggctgccagcttgtgtggacactgctgcaggccaggtcgttgtcccaccccaccccatcccatcccagtgtccacctacctcctgcagcacatggcctagtcaaagagacaggctgatacaggtggtcacacgtggatgacggaagcacgagctgggtggggaggacgtgtctctgtcctcctctgtcccctccctcccttcctccctccctattgtctctccagccccctcatcttgtcaatttcctcatgtctggggctgatccttgatccttccattttccctgcgtccgccctgcctccttgttttccagcctcctgttctcactgacttggcctctgctgaccccagcccctgaccccgtatcctctctgcctcccatcccctcccaccttcaggctcccgggtccagcccctcttctcctgccgctccctccctccttccctctggggtcccagtgccaacagtccttcagcccaccagggtctgcgggccgcttgcctcagtttccttccatgcagagctcttgtctcacagtgttcaccatgcctgtcccttcgcccacacactactgccttccgtcttagcctggctggccaagccttggtgaactcagactccgtctgcccagccctgagctgcagcccagtgaggctagagatgggcctggggagccaccagtgctcctgcatgctactgctccactcaccctccctctgtacccccttcatcctctccccgagacatttctcgtccaggacgcctgtggcctccccattcccagttccagcgctcagtcctgagccacaccagcctggcgcctgccctgttccttgccagcccgtcctccaggcgccccgtgctcccagggtcctctttctcctcagctcctgtgctggccccatgagggatacccgggactcagacctcactcctctcccgaattccctgggtgacagcctgggtcatctgcaggctgcccgctccgagtcatgtccagcctggatttttgaactctgcacacattccctgaccccgcatcccctggcatctcccagctttctggatatgttctgagcaaacacgggccttcaccttcctcccagctgctcccctcccctgtccttgggaattccgtcctccctctcgctccagccgagccctgagatccttcttgacttctcttcctttctcttccttccacctctgggaacctgatgggctcctcaggtgtcctctaggcttcaggaagcgtccacaggctgccatagggaggatgaatggggaaggctgggggtggtgggtggtctgggaccctggggaaggcaggatgggagtgctgggtgctgggctgctgggtgggcaggctgtggggtgggcctaccatgggttgcactcctggttggcctggctgaccactgccagcagaggatagtgttggcccagtctctgtcagggtccaacccgggtctctttgctctgcagatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcggctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagtgagtttgtgtggcggctgcaagccctgcctccagctacagggaccctggcctggcctctgacgggcactctgcccacctcgctcccctggcactcttagcccacgacggggtaccaggtgcaagggtaggaaggttcccggttgcctccagtccgccttggtggaacgtggagcatgtccatgactcagccctgaagcttgctggaaatgctttgtttttttttctttttgagacagggtctcacgctggcaaccaagctggagtgcagtggtgcgatctcagctcactgcaacctccacctccggggttcaggtgattctcctgcctcagcctcccaagtagctgggactacaggcacctgccaacacgcccggctaatttttgtatttttagtagagacaggggtttcactatgttggccaggttggtcttgaactcctggtctcaagtgatccgcctgcctcggcctctcaaagtgtagagattacgggcgtgagccaccgcgtcctgctgaaatgctttctgctttatttctgggaagtgccaggagaccagtttgtcccccactcccacagagttacgccaatggctgtggtcaaaggcatctgggaccccaggtgggcttcctgccttgcctggcaggcaaagggtccaggaactggaggggcaggtttcgcatgggtgtgctggccggcacgcgcacccccgaatgcccttgcccacggtgcccttctcccagggctctgcgaacacctctgagatgcctgctgcctgtgtggaagtgcctctgagcagcccttgtcacactcgtggttctagttcaccaagggctgcagagatgcagatgttcggaagtcacgtttttccatgactgtggggatagcggttccagggctcagcctcacccacaggctggcctcccatgctggcgtggcccgttaatcctccctagagcctttgaggctttgctgagcaggaccggctagccacacagggaggcgtgcagggacgccatgggcgtcctttggggtcacactgcattgttcatccagttcacgtccactcccctgtggctctgagtgggctgtgatttggccatgaccggacctcccctccccacgagcatccagagcacttgttgacggtgtgatgacactgagcttgggaaccctggactcccttgccagcatccatggcagccctgacccctgactccggtgtcgggcgattcctgctgtcccagggcagtcagcacgagccctacccggatctctgttgtcctgagctttttagggtcacaggggccatagcaggcagcttgccgtcctcacacagagggtggagtggggaggggagcagagggtggccgccccgtgtctgacagtgaaatggtcctgccttcctctccctgcccctccaggcgatcaccccccgatgggcagagtttcaggagcttctcctttgaaaagccccggcaaccctcacaggctgacactggcggggacgactcggacgaggactatgagaaggcaaggctgagcggcaagcctgggtcccagtggccagtaggtggacaggtggtgggaaagccataggccagggcggcccctcacagaccgtcctgagcaaggaccccccgagaacccgggagcctagggggacacagcaccatgtaaagccccggatcccggcaccgggtggccaccgtccggggagtggtggtgcgggtggatcactccgacgttggcactgacaccgtcagcctcttgcaggtgccactgcccaactcggtcttcgtcaacaccacggagtcctgcgaagtggaaaggtcagcacaaagccctgtgtgtgctgggtcctccgccatgcccggcttcctgcttctgtgtccctctcactagcttccgtgttggggagttgctggcacaagttcatggccctgcgtgcagcagaaaccagaggagtggacctccctgctctgtcccatgcccagctggcaccctggctggccagggctctgctgggctgcttctgtcagcctcacggcagcccgacgtgctcagctcctgagacctacaacagcgagaggacagaaagccaggcttgggagcggggcgggaaggtccgtgtgaaagctgcccgaggaggactcacccgctaatatgactgtcttattttaggttgttcaaggctacaagcccccggggagagccccaggatggactctactgcatccggaactcctctaccaagtcggggaaggtaggcgccaggggaagatgccccagggcccctctggctctccacacacccaggctgtgggtgggcccaggactccacagttcctaaaccactccccttgtggactcttacttggtgtctcagctgaattctcttcccagcagcaccccccaatctattccctaatagatctccatctgcaaattgggggccatgatggccacctcccagtgggggccaggactcgggtggggtagggctcatgctctggggtggcggaggccacatggggcaggggaacgccaggtctgcccgtgtccctccgagcgtgaagttgtgacctcactgagccatgctctcccgggtgtgtcggagtggttattggtggttatgagctgttgctcatcagaggctctctgagggctgccagtgtcgtccccgctgtccttgtgcaggtggtctggagtccctccccgccccccgagggccacaggacccagccttgatggttctgcccccctatccccagcccatggtctcccgaggctggtcccgctgtttctcagggagccgtcagcctcccgcttccgtcctgtaggtcctggttgtgtgggacgaaacctctaacaaagtgaggaactatcgcatttttgagaaggtgagagggctctgagtgggacggggaccctggccgcatggcctggcaaggggcagggcagaatctccctgatgaggcataggcagcgggtagactgagactggcacctccaggataccgccctccccttcccctccaccatcgctcaccccccacccctcctgctcagcctccctcctctcgtggcctacctttgtcctccactgaccctagtggggatgggcggtcagccatagaccctgggttgcttgtcttgtctttttctttttgcggggacaggggtctcactgtctttctcaggctggtttcaaattctggggctcaagcaatcctcccacctcggcctcccacagtgctgggattacaggcgtgggccaccgtgcctggcctaggttcatttcctgaccttgtctgaagtgctctgggtgcaggctcctggacatggaggacggaggggaagtgaggtgggaacatggagagcacaggcctgatgcggaggccaccttgggggcaccaccgacagccaggggccagcctggtgatgccgctgttgatgctgctgccttgttttacagacggggagactgaggcctagagccgcagagtggcctggccctgctgacgctcccccttctcttcccccacaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctgcgcctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtgg

SEQ ID NO: 14141 - DNA, 140315 bp, Human
gatttatggagaaatattaccttgttctcgtctcagtgataccatgaggttttccacgttattggattactggaggattgtggcagacccctttttatctgacattcattgcatgacaagattttcacacatgcccttcccccacctatgcccagcttttttcactttgtgttacctatcaaatttcttttaattctattcttggggttggaacattggtgtgtgtgtgtttgggtggggtgggggagagggggcggtgctcaactatacataaaaccgatttttggccaagtgatttggaggggagtgcctgattaaacaatgcttctcctcattttctaaagggcctcttaaaatatggttcccttaaaaggcaggggctagttctcttgctattgtttttttttctactcactagccttacccttcatccccattttattcctttctagggagaccccctgcataaaactattttataacctgaagtttcacagcagctagggctacagtgcacaccatgaacaattgtgtaatttattggctccttcattctgaactcactcttgatgctgtagtgagagcttcttaaccaagcttcagtgccttgaaacacagcacaaccaaatacttcccctcccccaataaaataacctcctttgctgcattatctgcactccattaaggagctgatcagatgttcacattgtctgatgggtgtatttaaaagtgaaaagggactcccaagggactactcaggtgtgtctccttcctgaccctgctggggagggggatgaactctggactgacggacaagcattagcccttgcttgttctctgattgattctctggctctgggtgggtgaagagccatgaggcagctcaagccgagattgattgcctcaatttcagattcccacctccaaaatagactctcagatgcacacataaggagcctcctcccccaacacaatttctggaggtggagcaggtctctaagagtcacctgtggctaccaatcacaagtgttcctccttatcacaatgatgctggctgcaggagtcttcagctgggacacattaaagttcagggacagaagctattttatatctctgagtgtgtgaatgtgcaggggctggaatttaggagtattggggttagcaaagaaagggacaagaactccgacttgaggttggtctggaaggcagcttaactgctctatagactcagtaggtttgttttgcaaaatgtggctgtttggatggaggtgagatggcgactgtctccttaggctctgccaaaagagagctcttgatcctcctctgaccttgacagaatctcgaacatgttccagcctagccctggagcagggaaatacagtttgctggattcctcccttctttgggtggtaggggcagatttgggcatgcaggcgacttctagcctgcctctcattcccagatagccttagggtagctctcccccactttctggccccatcctggggtctgagcccccgccccctcctccatccctccttccctcctgcctgtgtctctccttccctcctgcctgtccctttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaaggtaatctccgtgaacaggggagggaggcgagcagggaggaaggaggggtggccaggaggaaggggggcgtggggaggcggcttttctctctccctctctccctttccaaatgattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgaggtgagaataccggagggccttatctttaattgggtttagttttgccagtctgaataggtttaaagagactcgataaagggggaacaatagattatttattgactggacgctgaagcctttagatgaagaagggagagacaaagctgcttaacaacttgattagttcatttttattttaaggtgagactgtctctcttttggtggaaggaagggctagagaactttggtgcaatttgaatgacttaaaatgtcttatttcctctcccgacaaccccctacccttctcagcaccatgcacctccctgatttaacaggagtttcgtttaccccttgcatttaggattgatgaactgagaaaagagggtaaaggctttgggattgatcattaatgtttggttttgtgtgacttgttttaaatgcgtgataaattgatgctgacggtacttgaatgagtaagaaaagcaaatgaagcctacttttaatatggaattagttgactttatagtatggctcaactcagcctagaggagaaaaaaaaatcactacaagtctgttaggtagatttgtattttggatttgaaccatgaaatcttttggttggagctagtttaaaaaaaggagaaaacatgtcttattgactcacaagtatttgaaacattgtaatatcaactttagaaggttcttaaaatgaagaaaagtggaaaagatggttgttttgccttctacacattgtcaaaataggtgttttcatagatagatagatatgatccagtaactaaaagcctaattaaaatttgtttaaagccaggggggcatgtttccttgttgacagcagcagatcgattgggtaagacaatagagtcccattattttacttccattgactgaacatattgacatttcaggtttgctgttgcctcagtgagcatgatgaaacactgaaattcacagaccaactggccagagtggcacatatattactgtatgtcatttctgccttcaggttaccttatcacccagacagaatggaaaaggacagcctggaatctttcagaaagggtagagctcttttggctaagaaactagcagatagcatgtcttaggaacatctttaattctaccccgaattggatgttacagagaaataggtggagcacgtttaaaaatatgaaaagcatgctagccatagatcttgcatattttatatagaaggatacccattttcaagatttacctttacctggagttatttacagtgagtggtcagtcactatttaggtgaccagtttgttgcatgagtgacattcattcttttccagtcgggtactgaaacagccaggcacctgctaaatctatatctcataaaataatgtgtaagttcccttcaaaaatagggcctgactctgactttttgtttccagttttcttttagtgggtggaatacacttgatcttagccaaaaggccgagaagcgataatgggttcaatacaaagtgagatgtatgtattttacactcaagtgcatgcatagacaataacttatatagattaatatgtgtatttcaagcaaaggcagagaaatactaagtatttgttatcttggtgtaatttaccctttcacacattttgcatagtctttaaataacaaaactaagcattaggcagacattgagtcaaagaaatttgaaccatacagagagtgaatatgaaaaaaaaaaccagaagggacttaacatatttttatgttaaagaaatttatgaaaatataaatctattttgactatgacttatacatgacaattgttgccatcaagtaggcaactgatgccctttacagtgtttagaacaaaactagtcctttatacaattttcatgaaaatgttaggtttctgtttgatcagcaggtgctgttgagatgaaagccatgtgtaaattttcagaaggccaaaagtgtcaattcagaaaaggaaagtgataagagaaaatgcaatcagttttcctgttttcaatttgtgcgggatttgaagagctgttttgttaaactgctacatctgctccaatatgaatattgaactacttccactaaaaataacaacctataatttggaagctactgcagtcttttgttaatgtgagtgggttatttaaaaacaaaaaaacaaaaaaataaaaaaaaaattttctattctgacaatctcttgcctaatgtgcattttcatttgttggcacttttatcctcagcagataaatggtagtatgcaattaagacctcatcttgtttgactataaaagaggtttccataggtgaaaatcctggtaataaaaaggggttcacacaaaacaaaatttattttaaaataacctgtttaaatacatgtattgaaaatcagatagttattccttacattctctaatactacaatttttaacttactgccggactgttgtaataaagttaacactgttcttgcatactgagcattccgagatttattttacctttaatatacctgcaaatgtaagtttaaactaatcagggatattttactaacagggctttcagaataatcttttccatgcttaaataaaatgattaaattatgcttgagtgcctgcatacaaaagctttagcttctatagtactgctaatcaaataagttttatggacagggaaagcaccacatagagaaaaattggatgcattttactagtgacattgctaggaaagacatgttcttttaaaattatctaattttaattaaaaaggaaactcttaagatgtcttaaataatcataataaaaataatactgcgtccttataacaagaaagtgaatggcaacgctatccatataaaacatgggcagagagaattaaactagaaggaaggaagactggtgaaatttggatgaggttcaatactgactcaaccttggattgcagtttggtgggcttgtggctatagtaatttgtctggggtgagacctgatcactgctgaggatcaattagctgagtttgtggcttcacatgtgaattgctagacacactcttcacagataaactcaaaatatttcaggaatgtataaaggggaaggcaggcacagtgacaccttagcatgtttgatattaacaaatgcagtgtttcttctaaaacaccaactcaaaagaagaggtagtttgaagaacaatgttgaatgtgagtatttgcgattacatgtatggaaccaaccaaagaagtatgcttttaaggaatgcagtttccagtttcaagcccaaagaacagttcagtatggcatgtcatgctggcatatcttaaagagagctgggcatcatgcggctatttcctccaatatagcaccagtttctgacacttttaagaaaagatgctgaatcacatatcagtgtacaaaaagtttattcacagacataatcccttcacttgggatgtgatcttctaatgagagttgtttttgaagccacggtaccttacatgacaccaacaggggagattcctgtgcctctttttgaaatgttgatacttgatgaaatcatgtccaggctcttacatcagaactactggtaaagtaatgtcccatggttgatgtttaaagtgtaagacctgcttgtttgaaagagcttaaaactgtcaatgttgcctacaactactaatattttcaaggaccaagagataccaacttaaaatcatctcctttaatagttctaattgtgattacctttataaagtaattcatgaaggaataaagcaggcatttgttttggtcggtttcatatcgatcaaggcctctaaagcaaatcactatttggatgaatagggcctttagaatatagatcttgtagaagaggaatgcagagggcacaaatgtgaagttttcccgttgtgtctccagcaatctaagcacctctaagtgccttggggaatgtgattgactgggttcattaatcttttaacacctggggcacagaccacttctaagtgtgctcagggctcttgagggctgctacttagttgttggtcttgggagagaggagaggaattgataaatactagagacctactatgagcctgtccttcaccaaccttcacatacattctcatcactgattttaagtaattgattaaccagtgtttcactttcttcatttcaaagaactccagcccattgctctgagactcttgccatagttactcttctggcttgatcttttgccccaatttagaaaattgaggtttcttcgtattccccaaattaatgacttactttgtgcctgagctttagtaattatttaggaccttattctctgaaaaattggctgcatattctcttcagtggccatttctactcatccattgttttctttcagttatcccctcttcacccccacttaggaatcagagttggcttctagctgacatatccttggatactcacaagtgtgtgctagtctatattcctcagtaccacctgatccaggcttctctattaccaaattctgttcctgcatcagaataccttcattctacactgcactgaggccatgaggatttaatctgtttttgttgttgttgttgttgaacttatccagtatgctggagtgattttctgcccagtccttagttcttgagtcttgttcctttcgtagttggtcactccattatatcttgatctcagcatttcccagttggccaggttcaacttcctggttacctcttaagataaggttagaggacttgtacaccacctttactgctggaaaaaaagagtttgtaactagtttcatagtgtaaagctttctccgtattagaaaaaaaaaaaaaaggacctggtgtctgtgtgcagtcgcttgactaataggcaaactgaagttccctttccagttcaatcactgacttgctgggtggcctggggtgcattccagccctcaggcaaatttctcagaaggcgaagggcagacttggtgattcttaggcttcccaactctcatacggacaagtctctgtgtgatactgaaagtaggctttggggctttcccagggttaggagagtgaaaaaaaaatgctttttttttttttttttttttttaaattcagggattggggtgggtgacactataaatcttcatctaactgggaaagggatcagtgtggaatattactatcattccagtcttctccatcataaagaagagccattatggactagggagccattctttccatagctatcctaaatcttagatgattgtctgaaatttttgtttttacgattcctttttcagaggtgaatgatgtaggaataaatctgtttatgtagtgaggagggaactaaagagtctgggtcttgtccaaggaaaattgcctttatgctttcgcctcatagttactggacaagatgatgaactcagcgcctaggggtgggagtgaggggctaggggctgaggtggatggggttgcttgtgtttagccaggcattcaccatacccccggtctcaaagtttggactcgcttcacttgggaaatttagaaaatgacctctttaagccattttttggagagaacctggtagcttgtttaattgaacatgggcacattatcatctggctaggaatcagatctcaggaaagactaaacaattctctttttgtctgaagaaatagtttgctattgcttctaaaataattaaataattcaattattacctattgattttgtactttagtttgtaaaactgatgtaggtgattaaaatatagacattattagagatttgattctaatttgggtggttataaatagtaaacccaggctagggtttcttttgaacttaagagttattggcattcttctggtttgatcaaggtgagcacttcctcatcatccaaaatgacagtggaagcttactgtttactaggatgtcagggattggtttggcttggaagtaatgatattttcatctgacattagaaatggatgtcagaggaagcactgttgcttcataggctgtagaaaatttttgcattggtattcagagttcaatgggaagtcaaattgaagttctttgccacaaaggagaatgtcttaagcgtatatatacagtgaactcgtagttggtactaactgggttgaatattatgtcagagaaatattagataaaatattagcagcagtaatggtaatttgtctaaagaagctcaagagatgggtggccaccgataatatgaagggaaacagtgtcagagcagtaatgagctagacatggccacgtaatgagataattagagcactaggagagagaactagctgtgagatgttattataaagagtatctgggaggactcttccactagactttttggagaatccacctagtaacacttagtgaggagaccagagcctaatattaggaaagcagatctataatggtacctaaaagggttggcacagatcatggtgccagggaaatagcacagctgtattgtggaaaatacttcaaatgcacattgacaagtggagtatcagaaattaggaagttatccccactggttataagcatggtacaagctgcgctttaaatgcagtcttgggaagttgattagactagcttaaactagaagtactatacccctttccctaacctcaagatacaggggcatgtgaactgtaagacaggtcagggaagactaatagcttattttctgagtctatgcatatgttatgtacacagtgatgagcaaatacagctgggaagaacagcagatgatattgggattggaactgggtgtttatcagactgacatagtaatcctcctttcctgtgaaagtgttctttttaagtgactgctgggattctgtaacttttgtaacttttatcatgtgtcacacaaggagtgtgctttactccacagctcctttgcccacctgtcacacattttcattctccggttcagctagatttatttagaaatgagttccgcatttgacctctgatgagaaacaaatgtggacaatgaattctcatccttttgtttaaataaaggtaggtaggtcagttcatgtctaaaggaagagttaatgtgatcagtctccattgatgtgcctaagatttgagttggctcgagagagcaggtataaaatattggaggaaaatataggtgaagagcaataaaatgtgaacaacccattaaacctgatttgactacttataaagaaagtcacatgctgttttggtagccatggtaaagacaccttttacagcatctgatagaaaagtaaaatgtttactcttgggagtgaatctgaagtacatggataaatatttagtaaatgttttctatgtgtaaagctgtgtgctagatgtagacacaagcaggtagtcggctcagttcccactgaatgataaactcaggacaaattaaatagctacatagatcgtggagcttgatcagttaccaattaaatggtgcagcaagtgagattttagaggcaggtgtgaattggaatttaagcttgtcttgagacaggtaggattcatcaaggcaaagttattgtaataggattgtggtaggttatacaataggaatagggaatgcagaagcctagatgtggaaaagactttggaggagtattggggtggagtaggggtggagagagaataaattaatactgtggctgcagcaaaaagggcccttgggtgttgagtgggaaatgagagcagaaagatcataaatgtcttgaatatcaagcattttgatttaagcttcaacttctgaattcaccagacatttttcagctgtgtcctgtggagtgcctcagggttgggaggtgggatggagggtacccagattgggcacagggtcttccatcccctaaccaccataaaagcagaatagctctgcttttataataaattgctttatatatttgattttctagctgggcgtcttttgaacagaggagtctgtgataaaatagatctttataaaaccaaggttaaaataaaaattgagctaggcaaaaggaaaccctgcatccaataacagttatgtttgcaaagagttggtcctaatgtgaggggccagatggactggaggccaaggccaggcgagaagcttgttgctgcagtttaggttttagatattgcagaaggatgaccagcgttgggtttgtgggatgagaaggaagaggcaggggcaggaggtattgcaaaggaaaaataattagcacttggatagagcagtggatttagagagggggaagttattaataccaacctggatttactatcaagtgctcttaacttgccagaagctgggaatcacttcaggtgtttgtttagaggcagctttgttaccctaccccagactcatagaatcacagcttctagagaagagcttcagaatccatttgcagacctcggtcccagggcttctggtggtcccagctgcctttcggagatggtgacagggctgtcaagtggtgggtgttccttaaaatgcggttgttacataaaagatctgttatttaccactgtaggacttggctccctcatgtgttttgcctctttccacagatttcaaactcttctttgagtttctcttttgcaggtgccctcaggccgtgcaggagaatgcaaagtggtcaggtgggctgggttctgggacccttaacttctcatttgaccagtgcagcctgctttataaatttcaaacattggactttgtttgtaaaataatttataaaacttctttgaattctaacatggtaagaaggagagaaggtagagatgacagcatatggagttaaggagtagctgatgaaagcagtgcttgtaaaccagcaggcctcagacttgggctcagtgctcttggaggaagagggagcttggttatttaaaggtgcttttgaatctagattcatttgttcagtaccccaagcactgtctgtagaccaaatactttttcatgtgatgatatttttcaaatctactctaaatgaaaagaacaaaaaatgcattaaaatctactgagtttaatagaaatgtctatccattttacaattaacagatagtaaactaaatactatgatgtgctgagccatactttttttaaatggaggagttgttttggaaaagtaaaggaatttctttaacatgttaaagagccgtcaatccttattgctcactcttagttgacccctatgtgagagattttagttattggaagaaacaacaaaaaaatctacctgggtgaggacttttaggatatggttcattaagataatattatttcaaggtctttatcttgttttgtctgataacacttaatttaaaaacatgctggcaattctttttattttttgaactttaaccatatttggagtttgtggttttgttctaaaatctgtcagaattggattttttaagacttctccctctgtagtgaattatgcttgataagaactaattattaagcataaagaaatcaatcttttttaaagaatgaaacatttatgtgtgttgatacagaatcgttcctgagatatatcattaaatgagcaaagcaaggagcagaagaatgtctgtagaatgctgtgtttgtacaaaaaaatgcatagaattctacttgtgcaagtatatacaagaatctgacaatagtgcttgctgttagggaagaaagcagggccaggaagtagtggtggaaggagcctttttgctgtatgtcctttggtactctgagtcattttacaaatcttttgcctgtgtcgcccaggttgactggtctgggcctctgcccttccagagggaagtgatgctgctcttccctgccagaaggcagtcgagtatagtgatgaagagacctaactcccaagtgctttaccatttatctcctttagctacccttttcatctagaaataattttcatctggataataatggcatggcctcatagggtggtcatgaggatgacgtgatatgtgtgaagcacaaccttcagtaaagggttgctttttcttggcatctgacttgatggctatggaactgttcatcacttccttctctaaaccccagtagtctctctttggctgcttcttcattcagcaaatgcttaatagacgatctggccctgatggacactgggggatatgaggatgttgaagacaaatgacaccctgctttgccaggcctttcctggacctctctctctcagccttctctaaaaccctgggttgcttcacgtttggacacctaagctctttctgcagggaagccaagcttggctcactttgtcctctcctaagcctctggtgacactttcatgacccttcctccccaaagatagaatttattacatccaactctgctatcatccgtgcaattcagacttctctgctggtttgtaagaccttcaaaagtgggagtctggaacagttggggtactttctaatgctttgttaaataattattgagagctcatgccttgaactcaagtgatttacttgaaactgtcctgaaatatttcactgctgagactaaagtgaaatctttggttccaacagcatgttgttttttttctcaacctctttccaccttggtcgctttcattgcgttctcttgtcaaagaatgcacaatttattgctgttatattttggcttataagttttggcaactaaaaaacatacaataaaacaaaagcaaaatccacccccacccccacctcctactccaaacaaaacaccccatcttttatttttatttttatttttattatactttaagttctgggatatatgtgcagaacgtgcaggtttgttacataggtatacatgtgccatggtggtttgcagcaaccatcaacctgtcatctacatgaggtgtttctcctaatgctgtccctcccttagccccccaccccgacaggccccggtgtgtgatgttcccctccctgtgtccatgtgttctcattgttcaactcccacttatgagtgagaacatgcattgtttggctttctgatcttgtgatagtttgctgagaatgatggtttccagcttcatccatgtccctgcaaaggacatgaactcattcttttttatggctgcgtagtattccatggtggatatgtgccacattttctttatccggtctgtcattgatgggcgtttgggttggttccaagtctttgctattgtgaacagtgctgcaataaacatatgtgtgcatgtgtctttatagtagaatgacttacaatcctttgggtatatacccagcaatgggattgctgggtcaaatggtatttctggttctagacccttgaggaattgccacattgtctttcacaatggttgaactaatttatacccccaccaacagtgtaaaagtattcctgtttctccacatcctctccagtatctgttgtttcctgactttttaatgatcaccattctaactggtgtgagatggtatctcattgtggttttgatttgcatttctttaatgcccagtggtgatggatgagcttgttttcatgttcattgtctgtataaatgtcttattttgagaagtgtctgttgatatgcttcacacactttttgatggggttgtttttttcttgtaaatttgtttaagttccttgtagattctggatattagccctttgtcagatgggtagattgcaaaaattttctcccattctgtaggttgcctgttcactctgatggtagtttcttttgctgttcagaagctctttagtttaattagatcccatttgtcaagtttggcttttgttgccattgcttttggaaaataccccatctttaggcaaactgcgaagtggtcaagccacttggatcttcatagatgcacactgtaactttttattttattttcttaccctgaagttcataaatgggctttaataaaggataagcttcttgaaattataagcaaaattttatgtatatggacatttttatgagatcgaacaatttctttgatcaagggtccgaacaaggctgaaaaccattgtagtggcttccagattttccctaccagattccctccagttgtcccttagttgccacggtctccctcttccttctctccctcctccttctctccctcctctcttcctctggatacccatatctgctttctggacagatccccagtctgagtactcttcctccaggacccttcccccgacattccttcccatccagtctggtcttttgtctgacattgtgtgggattccagctgctctactgcctgatgaatcagcttcagaaccacagatggtactgaacagtgaggtaggtccatctcagcctgagatgccgtggctcacaatgcggaaatggtaaagagtctcactgttttttcttcaggaaacctttttattgaaagagacagtttcggcagtgcagccttcagtttcttaatgcaagtgactggacaattttagacagctgtgtgtggggcctcaagggaggacttgatggaatgatgttttcatattgtcttaatatcgacttgtgagtgagctaattttgtaagtcactcttagagatctactctcttacccaagatgaccctgtgcacatgacggggcaaggtctgaacctagattttcttcaagacttcactattccagagcttactactctcctggaattcttcaaaccctaccacgtaggaattttctacatgaacagggtcagccacactaattacagcagggaatgatactaaagtacaaatggaaaactatcaaaacctttcactgcacttagaaaagttactgtttacagtacaaaaataccacaacttaggccaggcgcggtggctcaagcctgtaatcccagtactttgggaggctgaggcgggcggatcacgaggtcaggagatcgagaccatcctggctaacacggcaaaatcccgtccctactaaaaatacaaaaaattagccgggcgtggtggcaggtgcctgtagtcccagctacttgggaggctgaggcaggagaatggcgtgaacctgggaggcggagcttgcagtgagtggagattgcgccacttcactccagcctgggcgacagagtgagactccatctcaaataaataaataaataaataaaataccacaactttccaagtttctgagagacaagagacaaagggagggaggaagagaggaaagggggaaaaagagagagagagatcagttgataggagcagcagcaaccaggccatgctggcaactggacagttgttatagcctcttgagatgtgtgaccatcaaccacgaatgcagatatttccaaagttccatttttttttttccaggtggaaattgctggcatggaacagatgcctttatttggagaaaacagtctttgtaaatgattctggttctgtctcctcttattccctagagagagtctttcccagatgaaattagatttaaaaaaaaaaaaaaaaactaccaaacatcagtttatgttttttttttcatcacaccaaaatgttttagagcctgcagcttaattccacatattttggttttgttgactgatcctaggtattttgtttttatcactaatagtgcagtaattactttcagaaagaaaaagattatgattgtactgatatttttgagtagtgacctttgctttcatttatttcatatttaattatattaaaataggtactacctcttttctagtatcaaatgataagaactgagcacactggatgaaataatacttgcactgggagcactaaggtaggcgctttacaagtattatctcctcatatcatcctgataagttaggtgttattatcttactttggagatttaaatctgaagcttagagaggttaagtgacttgtccaaggtcaaatagctgatgagtaagtgtaagaactgagattccaatccagccagagtgcgtatacagtgggcttctaaatggcccgcgtgtgtaggccacagtcatttataacactttattttttgaaaattaaattatatctgcaacagagaagatatttaagagcttcctaccatttaaaattgcctggtttgttaactcactggtcatattgcgttgttgatacttagttggttgcctaccttctgattaatttgttacttaaaaatatttgtaggattttgaaataatgccttatcacaagagaaaggggcttgaagaaagaccagatcatattccattatcagttattccctgtttactcagtcagtatttagtgaacaccttttgtgtgccaggcactgtgctaggcactgggtatgggcattgttgaataaacatggccatgctcttgcagccctgccaatggaatgaatagagtgcatcaatgtagggtccaaaggtgtaagaaattaagattggatctcatttctacaacagctgacatgctcaattgtgagataatccaatgcataaaaagctgctagagtgcacttatgccttaaaggttgtatggactctgctgcagttcccagtcacagtgtcctgctgctcagtgtgggacaaagggctggcttcatagccgtggatgtcgtgggtgatttccatgctgccctatctctatacagcaccagtgggaatgggcttctgtgaacagtacctggcaggtaaaaggttgcagagcctgatgtagacccaaagtactatagtataaagaagagaaaaagatcacaggtcacagaagtagccacggaaaggtttgccaaagtcatggggattgaattgggcttttgtggcatttcattgagtgggattcatttgtttttcttttcatttggggctacaactaggttcctagtccagttccaaatgtggagggtagagtaatgagcaccccccagatgagaccctagctctcacagagcttgcagtttgggtgggggagggagaaagataaaaaagaagttactaagattatttcatgtagtgctaaatataattaagacaattaagaaacaatgttagaatgatgcagagggtggggggacatggtagtgagactttatttcaaatggttggggaaatcatctgtcaggtggtgactcttgaactaaagcctgagggttgaggaagaactggccgtgcagcagtctatgggaagggccgtgaagtcagtgaacgaagccaccagcatgagaggaagtgttccatcagggagtttatccagccagagaagagctgcactctggaagggcgtggttggagtggaggctgaaaactgtagatgagtgccaagtgatggagggtcttgtatgtgagattaggcaagaataaggactgtgtgtttctgtgtgtgaatgtaggagatgagtagttagaagagagaaggagaatctggatgagtgtatgcatggaagcttaaggaagcttgtgaaactaggataatgacatttagttcacatgacctgcgatgaggggcacccaaatcacacagtgtctcagttacttcctgttggaagttgagtatagtcctgaagtgaggcatagatggtgctctgttcactactccttcaaattagagggacacacaattgcttacaaagaaatggtgaagctttgacaaaggtaagctacagtccagtgccagaaactgtacttaccaaggtaatatttcctaagtcagatatgctataacaggttccttttatggtgattccccttggaaacaaaaactaagtgtacatttgttcatgtaaaataatagcttttatgatataaaatgtttctatgaaggaaaagaaaagagttagagttaaggtttgattcaacccaggttgatagataaaaagaggtgtgtttaaatgctcatttttggaataaccatgtatcatttactaaaggaaaaagtgccccaaatgttgatagaattctctagagaaatgtgtttaggcagtgaaaggattcctggcagtgattgagaaatacagtaatggggaactgcacttgatctcttttgaggttgattctgatgtgtgtagtctttacatcctattaaatttttgaaagataaactgatacaagaatgatttgccaaggccatatgaggttaactgaattcaaatagaaggttctctcaagttattgcattccttagaaaataaatacattgcgcatatggttaagattgatcaaaaaagtattctgtatgccaatgattacattcccatctgtgattaaggttttctgtctgcatctggttttcacattatatttctgtaacaagaatcctttatatagcagagttcactttctgtattttctattagttgcagcttgaactactgcacggatcgcagatttgcacatgtggttttcattacttcataccattgagaaaaagtaatatttgtttgggaatgtatgttttccacaatttccatggtaatacaacatgttgagccttttaaataacacttgtagaactacaaattgtttgaggcattctgctcttggtggagcttagcttttaaacttttctcagtatgttcccctcgtaatgaggttttacaaatttgagggctgagcatccagatctgaacaaagcaattattaaagatagagagattttattatcacttccatgtgacagacttcagtgcggaataggtctcagaaatacctgaacatcgtgcttattaccattacttattttattattatttcatattggaagggcatttaatgtgttggagatatgaagcacaaatgtgacactccagtcattgttttgaaaaatccaaagattagctctttttttttttttagttacccttttgattgtgatatattgtttcatatataaaatagttaagtggtgaaaatcctcatgggtgactttagatttacattgtatattgtttgaaactgtatttgtacactatgttaacatttaagaatttataaatatgcacatttaaaatactttgttatcaccatgttcctgccaattttcttcattcacttcaaaaaactctgattaaaatagatacaagtgaagttaaaaagtaaagcagtatattccaaattgagagatcatttttaattgagaaatttgtcttaaagtttatcacatggtaattttatgtgcctcaaaaccaagattaagtaccccatttttgttaaacccagacattggtctgatatttagcagtcatgagaaggaagatatagacttagactctagaggatttgtatatgctttgcctggttcgtttgctcagtagagattattaactatggctcatataggggcatgatccacttttgtcaggctctctgatggcctttgttgatggttgctgaagcacaaaatatatattatgattgaatctaagaagagtatacattttcttttttcccaatatttgtttagcctatataaaatgttttttacctttgtacagaaacattggaaataacagaattgtgcagaaaagttactcacattgccatcttccagaaataatcatatttaacatctagatgtatttactttcagtcttccccgctgtgtgcaccctcccccactccactatttgagtacttacacaacctatacgtgtacatatatttatgtatcttggttatagcattgaaattttttgctttatcatttgttaataaaattgttagtatttatagtaagctaaatgtttccaagatccagctgattgtctttaatgatctttgcttactgcaaggcaattcccaactaagaaatatctagtaatgtattttaattaatcagtacttatttaatttttaaaccttaaagagcaagaaacaactgattgcatcacaaaagaatcataatgtggcacataaactacattgattttttaaaaaatagaacctgcttgttttatttacatcagaatatgttcaccgattttaatttctaggaagtaatttggtctcaaaaaataatagctacagccttagtaattccttttgagactgcttttagaaatctttcttcccttgcatttgttgagttcctaccttatatgtgtatgattgtgctggacccttatatttcctagtttgtaagaattacatagcaatactttttctattcatagtagtgatagtagtggtctcatttttaatcatagtaggtgaggaatagacaataaatattgtgaatgaacaaattctaagtttgtcaaatatagcaggaaaaatgagaaaatttatattattaaaaggaagaaaaggtgtagaagtttgttgatttggtaaaataattcaacaatatttgtttcattaatattttttaactattctattacataaggattattcttcactgttgttttaaactatgtgtgctaataatggcaatactgaaatttcagaacagcgcaacaaaatttgaataatgaaacaaaccactttgttttgaaacaggattaacttgtgtgtaaaattccataaataataatgtctaaattgttttctaaagaaaacataatatctgacagattatttatttttttgaaacaggtaaaatgtaacattctcttagggtattgatgtgcatatctttaaaaccaatttaagaaaagaagagctttcagggtgagaatgtatccagctttgagtcagatgattggaaaattaagagtcctttagaaaacatcatgataggaactgagacaatggggattgttttggattcttctaaaatttagaagagcttgtatctgttttttttttaaacaaaacataacaaaactggcctagtgttatcatgtaaacagatgggtatgatacttcagactggttgtgatatatgcattttttttccctttgttgttgtcaatagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaaggtaaggaacagacaaatattttgattttgcaatttacttacataccagaaaaatcaatctattttttccaataaattataattgtaaagattttcttttttcttccttcttctagtgcctgttctattgtatgttttaaacatttgtctttgaaatctttgggtgtggggattgggtggggatcaatctggtggtgggaaccctgtttgatagttttgggtctgaatatatcaaatgatcaagtaccaaattttttcaccctcttcttgttgcagtgcttcttgccatgtttcataatacatctgttataagctgagcaatacttggagttaaagagtaaaaactatgccatgatttctgtgtttattgtaacgaggagatggtgttttctgaaacagtttgttgactaaataggcaaaaaactgcctttcagtttattatttcttctgatgtatttggatttttaaaaaacttttaggcaaatgtcacttcctaagcagagttcattccatagacacattaagaaaaaaggtgatatcttaatttaggaaaacagcaaatataaactaaatgtattgccatttggcaagagacttcttaaagtctgcaatatttgaaaattcaaggaagccctgaattatgggagagagttcatgtctcctgtagccagctctgttccaggtttagtggatagtggacttgtgcagaagcaccagggcataaggatccactgctaagaaaaagttgagagtcaacacaaatgttgtgtgatactggttggcactctagtggttgggaagagattttaagttctgtgactgactgactgactacgtagaaagagggggagcgaaatactcacccttggtgaccactgttctggaaacatcactgctagcatccaccccacaatgtctactcttgccatttttacaaatgcttataggcttgttcttaaagttctcaggaaggtgttggaaaataaagttgttgtttttttttcttgaaagaccagagaaaatgaaataattccctgtaggatgatacactcctttggggaagccttaatcatgatttggtttctgtgtctgtatttcccttcttttcattcctccttcttcatactgtgatgatgttcttttaatacaattaatgagagacatcaattcaaaagagaaggcaaggagttcaattgtttaagcagttgagacatctcccatgactacttctcttttcttacccttatgcactgttgttactaaacattggttttttgagaactcagatcttggttgattagcctgctaaagtcttgcatagagaaaaagaaaaggtatcaatatcttaaaggaaaaatctaataataataaccatcccgctttagaattgttttcttgtcatcttccaccagtttgggcttccacattaagcttgggcttaatgtgtctgtggaactccttgctttctgccttatgtatctgcgtggagtttgtattaatatgataaagatatctaagatgcagattaaaaatcaaaaaggatattggactttaaaagcttgaacatattgcagatacatagagttactatctttacccactcgcattccatcacaatctattcctttctggtcatgtggaatatatctgtggcctgctggcaatgaaccattgcagcatggaagatctatattgaaagcaaaaatgcatgacaagaacacatatcttaatataatttggaatgcatttatttgttattcatgtacggaacccccagcatcatgtatcagaaacacaatgtgcaatttcttctttttttcttctctgtctctcctactctcctgtatgtgtggtgtgtgtacatactttaaacatgatgtctgtatacacatatacatatttgtattgacctattttgtaactgttgggttttctttgttttccatgtggcattaaaaatttacttctaggccaggcatggtggctcatacctataatcccagcactttgaggggctgaggcaggaggattgcttgaactcaggagttctagaccagtctgggcaacaaagtgagaccccatctctacaaaaaaattaaaaattcaggcgagtgtgatggcacatgcctgtagtcccagctacttgggaggctaaagtgggaggattgctcgagcccaggaattcgtggctgcagtgagcgatgattgcaccgttttactcctgcctgggcaacagcaaggccctgtttttaaataaatgaaaaaatatactaacaataataattactcctaatttttttttcctctttgtaataatattaggtgtatagaaatatggggttcaaactcaagaagttgggaaaacagaaatcacatactttacattttagaacacctggaatccattgggctcttagagttttggagttgtaatttagaagcagataaagcaaaggactatccatggctgaacagtcggcattgtgagtgagaatggcctgaggtggcgccagagagtctggtctgcgtagcaagtttgaagcaggctggggtctcctggagatgggcctctgttagggcagaggctggggggcaggagggtgggaaatgatactaaaggggtatgccaccagcttgggtggaagctggtaaaatgagaacgctgttgtgtttcccacctggtgttttaaagcatacccaaggtacacacagtgcttggtcctctagaatgccatttggagccgttctcctgtaatgcctgccattgtagggaccagacagatttgggacacctaggagtggtagtctggcctgaggagcttgctatcataagccattgaggacaattctaagaagggtgtagtatttgacatattaaaaagatccatatgttttctaaaagatgtaagaggaagcagcttgggaggaaagaatgacaggaaactttttttgcaaagagtgcctgtttatgttcatgcatatcatggaatgggatatataggtagtatcaatttttacatattgtgtgggtttcaaaagccacatttgtattttgaaaaagaggtatttttaaaatgctgatatagatgatgctgtgcacctttatatattggtatctttgttaggaagaggaaagttattttattaagtaaaattgctgcttttagagagtatctgctcttatttttagtttttcttggtcatgtttgaggggtctgatagcattaatgggctttaccccacatggagctttgagcttattgtagcactgcacactgatcccaggtcagtgtgatgcgtgaaatcaatttatttgaatctctttgcctctataggaatttggcagcatgccagttgttttcatttaatgttctttgtgttgaacacagacaagcaggcatgcttttgtattcttctctcttttggtctctgtctctttcagccaatattttactgtatggattttgagatgaaagaagagtatatcatttatatgattctaatcattgtttaattatatatatgtatataaatataccactttcttatcttttaaaggatatgtttgatattcctgagtttggtgactttgcacacacaaaatattttagagttttgtttaaataaaatttttggtgaaacataataaaccagatcatagatggtatttgcttacattaattaccactatcaaaatttaaaataacaatgttaattatgtaacacaacaaatgtttaatttgtaaactggactatcaaaatcatttatttcttggtgagccttctttgaatttgaagatttacactttaatcaagcatgttaaaaattataattatttgagtacaattttctttgatccatcttgattaagataccagcgttttacacagatttgctgtatatgaatttttatgaagtttctgccattaaggtacttttttgttttttaaaatttggagggtaatgactgggaatagcatagagatttttatgacaaataaaatcagacctttctctggatgtttttataggcaggacttgtttctgggtcagctttaggaagaggtggagaaggaaatgagagagagtgagaggagaatgttctgttgatgctccgggcagttcttgcggaagttgatatgcagaaccatggagccgcagcttcggggtcaggctcatacccagcagccctgcttccttgtttaattacctgaaaagcaaaacagtcaggctgggagtgtgtgaaaacccagtatctctcacagccgcctggcgctctgacatcctgcaaggccagccctgtctgtccgccagcgtcaggctggctcaaaccctgggttcctttctttcgggaggcattgtgtggaagagggtttggtcaggaatttgaggttcctgccaatgctgtgtcccctgctctccccttgtggaccacactgacagacatgcttgattaaaaaaaaaaaagatctaagaatttggctctattttacacttctggccttgctatgaaacaatctgtttcagcagcaacagacgttaaccagtagagggctggccttagtttgttgggttcttattttctgagttcccattatatagtgtcctatgtgtgttgctcttttccagtcagactcattagtagtctggtgtggagctagtagctcagagattgcttttatgaggcggttttggaatcttcatctgcccatgaaaatagaatagtccacttttaaaaaaaggtgatagaacttttgcacttgaatgttttttccttttcttggaattggaatatggtctttgacatttgctgtgggaagggccatactctttgacgaagctggaggtggtgagaaataatatttgcacagtaatgtgtggccaatttgagggtaacatgggataaatattctgagaagtgcttggagatggagccatttgggagatcccatgaatataagaggattttatcttaccaagaggaaatctgtccacacagtgggctgatgaaatgtctttgctgtgggttgggaaacaaaggtggtggtggtggtgtttcctgcaaaggcaggggaaagtgtgactacatgtgcagtgatttggtttttccaactacttcattaggattctgtcatgcagactgaagggcatttaccctttagatgcacatatgtgcctcccattaatgttaataggagttatgggcatgtaaagagagcagtatatacctttgcctagtgcataagcacagctccaaggaattgattctgtcctttgcaaagaatagagattgggctttgcagggaagattttggtgggaattattttaaaaacttgttttgcatatcacatggaagtaatgtcaatattttatatatttgtttaccactccagtaaaacatatataataatttaaataattgcattagcctggtgcgccttgtgatggagctggcatcatcgtgatctattatgcacagcgtaagtagctctgccataagtgttatgtgtatcctcaggcatgtgcgtgtttatttatgtatcagcctgctgcatttcttttagagtatttctcttttcaacatcagtataaatatgaaaaaagaaaacatataaatatattttaagccacagccaatattcctaactagtgttctcctccaccaacaaactcttggcaggtttctttcaagctccaacttttttgtagttctgtccacgtggagtcttcttaaatgcaggtaacaatagtaacattaggaccatgtgtagctttaagctttggcagcagagagtgtataatgtgagaaaaatgtggaagactgaaaactgaatggggagaattgtggtttgcaggtggtgtcagaaatgaaagaatttgggtttggagacttgcactgagggtgctcagtaagtgtggactgaaatgcaagaaaaacaatctgtgagagaagagaatcggaggcagtgaattactctggaaagtgaagggaaaacatataactaattgtggacttgtgtcaatttatcaataggaatgaaaaaaggacatttaggtataatgggtaaaaaaggtacaataatccataattttaataagattatggtatatgcagttaaggagaattttaataaatgaaagtaagagtaaaaatttccatatagagtaagggaattgcattgagatttataggctttaaccattcttgagtgtatttcaacatatacagcattaaattctcttttgcctggtaaaaccctgtagggtcactgtaaaacattaatttaaaaatttacattgatataaaagcaaatatactatgctgggtattatttgaacaaatagagcagttttggagtgaacatttgtaatagaattcattgtaactaaaattcatttttgagtaactttgaattgtttataaacgtggcagattagtatgtgtgcatagattttgataatttgcaatgtggagagatataagtggagaatttattagagatgaaagtcctgtgaaagaaaatatgatgaaaaaaattctgggatttttttttttattgctgtgtatttgctccacctggtggattttgttgaaagtgttttaatccttgttaatgaaaagaacactctttagacaatttctctgaactatagggaaatcttttgttttatttttgttgctgtgtaaaatagtttaattcctatctaggtcaaaacatttatgtgtcatttgttcagttctttcaatgcattgaaagtaacttttttttttttcaaaatataatacatgctcattttagaagatttgggaaatacagaaaaataaaaaaatagggaataaatattgtatataatttcaccacccacaattgcattatttttaagaatagacattatcagaagagaaccagtttgcatttgaatttatttaaagatatctggaatgttaaatattatgccaaagtatgatgatgatgattattactataattatttttggacaaatactatccttagaattcccaggctccaaaataatgaatataatcaagttcatcaagaattgcttttattaagctgcatgtctacagaaggcaaaggtagtgagattaaaggtatctcatgtattcatagggttgttcatagcggtggtaagatctgttgtttgctgggctcacacagattgctttctctgaaaatcttaaggattcagttgtgctttgatcatcttattgttttccttaggttattctttttttctcctgcagtctctcacagctctgtaacagaaggtgaagttttgaaaacagtgtctccatatgcaagggatttggagacctttttattgtctttaaaattgtcattcatagtcctcattagcatttattgttgcaagcgtacaagcagaaaatgtgaaattggtatgtcatgaatagccccacagagctctcgagccctccgattttgcctgcagtgtggtgtgggctgggctttgagggaaagctgtccagatggctgcctgcacagagcagagctgcaggtttttgtctctgttgctgagaggagggaaagttcattggagcatatgccatcacccttgcgttttaacaaaactaactcgccattagtcaagatgaggaggtggtgacattgaaacaaaggttttctatatagtgttacagtccttgtcaaatgaataagagatgggtagttaggatgtcttccatgttacctgagtgatttttgtagctgtacaaaatatgagaaaactgtaaatggtaacttatttgcagatttacattgcaaatgtatagtttttaggaattgttttatgggaaatgcttttacttgaaaaaaaacagcagttaacatagctagtgttcagcttgtggattaataaggaagtgttttacttaaaaaattttaatataatttaaccccttgctagtgcctatgtaggaatctacctttaactgtattattatagtatgtttaaaatttgtgtttaaatagcataaaatttaatcagtgcaagtgttaaaagctgttatagcatttcaaaaaattttaaaatattagacgttgaaaataagttggtggaaatgaactacaatatattgtcatattttaaaggcattggcactatcagaaacaatttgtaataattacagatatagattttgtttactttcagtgtgatattttgtcttaaacagacttcatttttgtacacatacacataaatgcacacacaacttaaatatactaatacacatctttttattcatgtataagaggacattgtacttcaaccagagttaaaagtcaaatatattgcttgaaaaactgtcagaatgatatcactaatattttattctgtagacattgaagatggaaaaaagaatatcatagagactatttggtttatcagtttaggaagtcattatttaaaatattttaacattggaatcttcaaagtacagtcgtagagtccattattaacttactttaactgatggagatgcaaaaatcaaagtgacctgagaccatgagttttacataagtcataggtgaaggctaggggttgtgacttctagctctcagcctgccacttgccctggtagatgaggatttctaaacagacctacagcatgtcctccatgggccactgtgttctatagtgctttgtctgactagttgcatgtgattgaggcagtaaagcttttccgcgtctgtaatgtctgtataatcacctattaagataggtttcctctatccagcatgttttcttttacttgactccatctcattgctagcacttaggctctcttggacagccctaaataaccctttaacctcatgatgtttatacacccttcaaattcttaagatggcaataatgtctcctgttcttttgtcatctaagcaaagttcttgtgagttctgcgggctggctgaaagttgaggaggtgcaaatgcttgccaatcatttcccccaaaggaaatatttgagggaatagcgtaaatgtgtttagttgtttacaacagacatttatgtaagggagctaaaatgacagataacctcttaaccttgatggaatacttcaatgaactttttcacttagttttttctttccccctctatcccacttatttcttgtggttagctgtatcttacattgtagcctaactaaaacataaaccatttgtgtttttttgcagacaaagtataattggatttatctttgtcaggggacaatctattatggcttttatttaatacagtttcagatggctttcagtggcagaaacaaattaatgtacatttttattaggtgttgtatctatttaattgactgtcaaagtgatgagaagttaggaaatcatccaaaagagaggtccatctcccttagcccaacaactcacacattaggtaggtttgccttatcagtgggatgcctttagaaaacactaatagcttccagctgggtggaaaatcaaaacctttggggtctgacaaaactagcagatttgaatttgaaagcagagctaatgcctccattttattttttaccactcgcccataaaacattattttccaatatgtcagcctcatttggtggccagtggtctgaaattgaaagtgggacaagcaagcggagaaatctggacatgagtgagtctgccctttcaagctggtgtgccactttgtggaagggtctcctctaagagcaggggggtcttaatgaccattcatcaatgctcgttgggtgatcattgagtgccttctcattcagtttatcaagtcttgcacataaaaagtcagaataagccttattcagctttgttaaagccaactaggagtaaaatgctccatttgaacccattttgcccttgttttttcactttgttaatgcagccctgcttaaatgagtgcctttattgggtcggttagaatatctgaaactattaattctcttgtattgaatagttggtggcaggccagagcagatggggtaggaaagtatttggttgggtgtattgctttcaattaggatcaatgaggtttcagctcctttgaattaactcacttaatacccactgtgtgaagtcacagtgtatcacaacagcctgctagaagccgagaggaaagttgagaagacctgtggaaaggctttaactcaaattctcccttcaccaatgtagagagctttcctgaactgcagcccatgtcagtagactgctggtccctgttgctaagtcaggtttgaacagaggaaaaatttgtatttcatgaaaggtttgtggtggacataagtgaaaaataccttggaatcatacaataccataatgcctttctaatgaatgatctaaagttgtcagaaaacaacttatgtatttgcttttgtgggagcccagcattttgttgttgactaaacttactggtttggaaagtgttgatttagatgactctctctaaaaaattgccttaaaaatggactgtgttcttaattcagtgacatacattaaccgatgaggttctcctgaggaagtacttaattggtgagtaatgtattctttgttattgggatatattttagttttataaaatatgtttccttatgacagtgttttgtactggagaaaacttttgcaatatgtattgtttttctccattcacttgcataaatgcattcatcatgttattgattgtctatttttattatacaatttggatgttagagatcttggctccatatcctccttttatttatttatttatttatttttatgaacgaaaagttattctgtctgagtaactgtgtagaactacatatccaggtttccctattcagggagaactgccaaatggggttctgcttttcttgcctccatggattaaagaataagaggaggaaactggtttcttgagaaaatgctgaactagtctcagatgcacacacattcagctaggccccgctgcagtcagacttctaggtgagaatctccagggatccaggttttgttgatgtggatcaatttaaagtggcaattactgtagtcagataacagcttaaaaagcctttttacacatagaaaagatacataatcacacagcatatggaagttcaattgtctgagctgcggtttagggacttgcagtgtaccgatattaagaccccattttaaagccggatatcatccagttttctcaaaagtgtattgcattttgtcatatgattttctattttagaagtgattcaccatgcatattgatgaaaggttgggtttcccactgtgaaaatgttttctttctaacataagtatagtactaaaaaaaaaatcagtggcatgtagcattaagtggcttttcaaaaatactctctttaaaaatgaaagtctactaatttaggatgctggattccataaaggcccttatagcaggacttaattgattatcacactcatgcctgctataaagctttctatcataagaatgtttgagcttggtgcttaactgtactgaaatccattacagagaacctcattacaagtgacatctaactaagatgaacaaaaagattggcctcataaatagggtgcagtatactattagtgacagaacagagtaatcgttatgaattgtggtctttttacaagttgtctctgacaatgatggatttttgaggggttcgctggataaagcagcccttcttgggtacagtatttaggggctgtagaagttcttattgattgacactgtttatcaagagaatatatttttagtttgtgcggagagtgtgtgtgggtatgctttgaaacaggttgtgtgcactcttgggaagaggtgtaggaagattgagtaggtagaagtcagagttattgcctctgttttcagaaatttttggagatagcaagtagtgtggaaatccatctgacaagggctaaaagcatatggaaagtgtagagtaagtaaaggacatgttgaggactgaaggaatagcaagagttaacgggaatgctcctgtctatcatgttcattgagcttgcaggctgatcagaggaccctgagtggaattgtttctgtgttgatagtggattgtgcatacgatggaaaggtaaagcctgaggcagctacctcatcatgtgccctgttgttgaaacaaacacagacctaggaaagatttgcaagtgtaaaactgagaaagagttttaggagagaacagtattttccttctgcctggcattgttgtgtgtttagaagaggcatgcaaggcaggcaggcgtgtgtttctcctatgaggcagggatgttttacaaaggactaaagagggactgctgagaagaaaatagccagctttagataaagcactataacaaaggcttctagttttatatatcatggtgtccattaaagcttaatagggaagagtccattgaacctggctgggtatgtgttattcatgggaaggataaacatttaggggtgtgcaaagaaatcaggaatcaggaggacatgattgttcagcttttgaaaaggctttacaatgaagattttgtttttatctcccatggatctctatgcaaggtagaggaaagtaagctgaaaatgtttggagcatatcaacccggggatcccagggggttaaaagcactcgagtaaaataaaagtggtcggctcagcttctaaaaagtgttctattttacacatactactgagaagctgacaaaaggaatgattctgatactttgtgcaggatgataaactggcacaatatacaaagtcttataaaaatgtttgtaggctgtttgggatttccagttgaataaacaggctttgagttctgtacctttttttttttaatacagttcccaattatggctatgaaaatgagaagatgaagggaagccttttattgtgaggggtggtagggggccaggtctacatttctatcttttggcaaaataagggttaaccttgaacaggatgggggtggtggtgaataaattattcggcatttagcttatcattctgaatttcactttttgctttttggtgctctgaaacttgcagagagaggtggagtgctaaggggagggtaggggttgtgatactttgcacacacatccctgtcattgttctgcctaaagagacagggctgggttcaaggccacatgtgctcctgtcatcctccacatttctgctccaagtgcaatccggagtgtcagctctccatctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctggtgagttagccctgttctgtgttctctctgtttttccaatgaagaaagcttactttctattatgcatggaaaataccttctgccccacagcgtgttgtatctgatgtgggcaggaagaggctgggggtgacagaggtgtgattggaaggtagcataaagagaaccacaaagatcttgatacatggaggggtacagggtgtggagcccttgcttttaaaatttgggagatgtattttaaaggttgagggggtcgtacagccacggatgtttgtcggagtaatttacttgagggttttagctcaagtaagaagtattgtttctgttcagaattttgtgactatcatctgtacttggtgtcctggaaatttcatctgtggagagagttttcagattatggcagaatcctggaataagatctctttaaaaagctgtttatgtcagagaaagtgaaggaagctttggaactacaaggaatttcagtcttgtcctaaatcacagcccttagatgtcatcagacaaataattgaaatcagttaattaaaataaaaagcctgctgaattagtgaagctcttgtcctggaaatttagtgcatgtcagtttcctctgaaaaatattatttttggagcctggagtgtttctgtgatcgttgccagtgaaggctctgcttgtggagaaggctggccggggaaagggttgtttcggctgttctcaagaactgtctaaattgccctgtgcctaatttggagcttcctatcttcagataaaaaagacagggcagatagagatcctccagctggccgatttatgtggattatttgggtaggacaggcagaagaggctgtgcttggtcacagagtttgtacacctcacagatggtgttttgaaacattatctgccagttttctgcaaccacagttgtgtgtaggtattgccagttgtttgaagaatgtttttccctttaggatgtgtctcgtccatcctaatcattattgatatatatgcagaaaggatgcatttgtggcagaattgcactttttcattagtagactaggaatgtatgtagctgaattatggggaaaatcaatttacaaaaagacaatgactgaggtctttgaaaggtcattttaactctttaagctttcatcttgatttatatgcaccatgcaactaaagatgtaatgtgccctgggtatataatacagaatcagtgtgaaagtgcctgtgttttttatttcaccagaatattgagcacatttatctgatttttatgtcataattcagatcttttttatgctgttaataaacgtgttaaatgatctgatttatcagcattttgaagagtctatatgttaattttgtaaaacaaaaccccataataaaccaaagccatttgtgaattataataggtgaacgagattagttaggacccttgctacttctagctaattgcatcattttaaactaagcttcaaagcacccttatttaaaaagcattgaactatatttagggatttagagtcattgataagtttgttttagtgttgttgttaatacatctggttctacagcaatagcctgaagtgtgggcactgcttctctctctctctctctctctctctctcatcaactgtgttagaaaaccttgtacttggatacatagaatatattaacagctgtgactatgagcatgtgccagaatggcgatacttgagcagatttgacacttggctatttttgacacccatctgtagtttttaaattctactattggatggactacctctaaatatgtttttagcttattttagtccatatatataggttcattttaatggatgattttagccatcttgggcaggttttatatttttaagtaagacattatgtgtagaagattaaaaggttgtgttctatgcactctgatatcatctactgcttaaatgactatatatctacatacacacacacacacacacacacacacacacacatatatatatatatatatatatatatatatatttggtagttgaagtatcagaactaattcctggttgtctcagacatgatgtaacaattgccatatctagggcctttttttataaaattgaggatccctggaaacagatgtgcacaaactgatcttattcagacatcccaatctttgggggtgggtaagtaaaaaagtcttagtttaaggggttctagaactattttggttttaaaaaacatgtttttaaagatgttgctagcatattgtttcaaaatgaactatataagtcaaaagaggctaaggatgctttaaagaaatagattatttcaaaattgtttaactcattataaagaaatatcattttactacctgtcacttttgtaacaactagatccttgtgtttaagaaaaggaaaatgttttcttatgagaaggctgggagaccttgggcattatattgtttcaggaggcagtgactccaagctttctgaaacacttatatttttatgaatctttgtataatattatcaaagaacatatgttgacctacaaaatgctttcaggactatttccttaaaaggacaataagtgagcacagtccctgtagcccagaaatagtgctttttcttttagaagatggctagtattaggtcagaccaccctttctcaatggtcctgctctccagatgtgcctggaacttttttttaagttcaagtttccaaaagagagaaaaaaaaggtttgttttcaaaatctggttttacttaagacatctccatcctggagtgcatttcataaattgcccacatattttccttagcagagaacttaactggctgtaatttttaacacatggccacatcatgtgatattttcaaaacacttacacatagctttaagaaggtccctgcagaaatgatccatcctctcacagccggcccattttttaacagcatatctgcattttccatttagtagagctatatattattagcttacatttttgggtagtaaaacagtgcattgctgattgtaaaacatggactttattatttgctgaaaattgatttggcatttatagccactgtgtactagactatttttctgtttttaacatcaatgcttgcaagcgatgatttgtgtaaaaaaacagaaatgaaattgccatggacagacaactgttagtatccctagtaactgaacatttggataatgcacttggatttttttttaatagatgcatctaaatgctattatgcaagaataaaaacactcacagcagtccattcactgacactctattttactttgcaagttggtttgccattatattaggctctttgctgtatcaaacaacccttgtgccaactatagaagaaaactatgtaagttgtaaatacccaattataaatgtagattatgcagcattacttttttgtagcagaaatgtagacagtccagcttcccttcaaaccctgaaaccctctcccttctctttacattcttttctgttaatatttcagagtacttggccttttagttctgtgtatgtaaaatgatatttggaaactttcacaggccatcttcctgtgcagttaatggtctattgaaaatgataattgtttaatctttttcttgaagggggtgatggttatgacatcttaagctttcataagacaactacttgtttatttttatttcttaaagtaaacatttgcttagtagacattatatagcctagaaatgtttattaactatcttatcactacattgttaatggatgtttgcaaagaagatgctgtaattataattttctgaaaagccttctgagccatcaggggaacagatatatatattttagagcttgaaggtttatcttgcgagcaccttcagtttacagatgttgaaactgaggctcctagagattaagggacttgttcaggtagtttatgaaagtaagaagatcttttgaggacattttcttaactgtgctgtttgtaaatctcaaatgtacattaaatcatgttagcatattagtgtcagtcttactttgttgtcttttatcttcagtcctggatcgctctcatcgtatgctttctcccctcccactctaggattgcagagctacctgggagaaaattctgtgacaataatcacttggcctatggcaaaagtgtgcctattaaatttattttataattgtttgggaattagggaacctatatatagttaattaagagagtattaagcagaaccaaaaatgtaaggctacgacaacagaaagttactgtaatgaggaaagttgggtagtagacatttgtaggttgctcaaaatgtgccagataccagataaccatgattcagtccctccatgccctccaaaagtttggagttctagtgttcccagcagagaagtaaacagggcctgaacatagtagatcatgcaggagcccagaggggtagatacccacctggattaggagtcagggacataggggaaggatgcacaatgggctacacgaacgcctattggaatgccttgcctggctccttctacttgctgcagattggatctcagttcatgtaacttagcattttttggtttgttcttcttatactaaggatagggcattcattttggtttttattagattttaatttctgtgtgtggcagtgggtgtagtatttcttgaaagctatttctttgtgtacagttgcagttctttgatagctaaccatatctagaggaataaatcattaacttaaatgactcataacttgagaacaataggatttcacacctgaccaagaaacaggtttatcgtgctggctttctcaaacagctgtttgcattaattaatattaatgtaaatgtactttctgagaaggtctagcttaattatatttttcaacccatagagttccaatcaaaggaatcagaaaatcctcttaatctcaaagggaatatataactgctgtctctgaacggaataaatctctgatagtatactaagagcagccttttattgaaagcctatatatgccaggctgtgggctaggcactgtgtatactttctgattttcactacagctttgcaaattgtttctgttaccatgtgatctatttgaagcctgaagatcagataaattaagcagtttgcccaaggacataggtaaagttaaatggtagagatgggattccctggactttgaattctctttttgtttccttattttatttttgagaggggttgggtatgttgtggcttgatggcaggatcttttgtaatgaaggctagatggaacatttaaaggggaatgtttgaatctgaattatagtagcatagaaggtagagttctttttgctgaaaaataaaaacagaaaaagcattagccttcatcatcaagaatgatcttggataaaacaggttagcatgctggttatttctctgtgtattactattcctcttgaaagagaacaatggaattaataggcatcaggagacttaatgttattattttgaaaagcctaatagaaatcatagggcacattaagatacaggaacaaaaaagaaatcataaatttactccctgacagagctatacaggttaactgaaatatcacctttcttggcttttggaatgtggtcatcctggctatcttttgttaatcggaaggtcagatggatggttttctgtgttttggattagtagaaaattagaaagcaaataatatattcaacaccttggcagacaaaattgttaaaaattgtgtagctaaaaaaaagcacgttttttggtggtgagactggtgggtatccatggctctgcccccaggagctcctagacaagcaggcacagtgtttccagtagatgagtacattcttaagaaagcagatatctttttttgccatcccccacctcctgcaaagaaaaaaaaaaaagcagttgatttttaaaattgtgggatgctttctctagaaggcttgattttgttttccacatttcgcttttaaaggctaagtgataagtgtagtctggctcactttattagagggattcttttaattttatgtggtttattaacattatacagagtacttgacactcatggaagaaaataattttaaaagtacctatgagaacatgatactgggaagagtttcactttaagagctatataatcagctaggtgaaatgctttttaggaagaagggatgtaggagggtgtctttatcatgtgtttatgactttaacaagagtcttaaagagtttgacaaagtaaactgagcatttttcacaatctgggatgattttgatgggggtgctaactttaaaaaagacaattgctgtgcttttgagagtctcgttattttacgtttgaactttccctcatttaacttcaccaccttcctcaggacttgtttgctttaatgattctcaggttattaggaggaaaatacatagtaaaatttgagggtcctgaggtaacaatttatatactcctgcatttgaaatttaaatatgtcctaatgaggataagactggaaggaagaaaggctgtgatcctgacattttccctgtgaaatggacattgtttcttagttgttatggttgtatctgaacctatatacttagcagttacagtaacacttcatttgaaaggcctgttaacatttattttctttctttttgctttagcattatatttgtatagcctacagacaaaatacgtagaggaaatcaaaacaaatatttttgtctatagaaaacacttgttaaactttctattcaatatttattttcttctaacttcctagaatattccaaatacatagttgatttagaaaatatagaaaatgatagaagtcagaggcaaaacccaactttttagttatccaggcattctttatataccagtgtttgcttgctaaacataaagtggaagccaggcgtggtggcacgtgcttgtagtcctagccgctctggaggctgaggcaagaggatcgcttgcatccagaagttcaagtttgcagtgagctatgatcgccccatgacactccagcctgagcaacacagtgaaaccctgtctcaaaaaaaaattaataaattaatacaaacgcgaagtgcctcccaaagttggtaagcctaggcatgactaggttttcaaaatgttttctattttgtacaatttaggaatctttctaaagaacatctttaaaaggaagagttacctgttgttgacattgtttaactacttactacatagaggagtgtgtttccatttggttttttatctttatctatattttgatcatattttctgagtgtaaaacatttggtaccatgtcattgtgaagttaataaactttttcccaaaacatcttggagaattgaatcattttgtagtgtttctcaagagcaagattatctctttaagccatagttactttcattcactgtttaaaattgttgtacttactaatcacaagctgatcagtttgtgctgagtgtatttttttatttttttaatttatttatttattttgagacggagtctcactctgtcgcccaggctggagtgcagtggcgcaatcttggctcactgcaacctccatctcccgggttcaagcagttcccctgcttcagcctccctagtagctggggctaaaggtaagcgccaccacgcccggctaatttttgttgttgttgttgtattttagtagagagggggtttcaccatgttggccaggatggtctcagtctcctgatctcgtgatccgcccgcctcccaaagtgctgggattataggcatgagccgccgcgcctggccctgtgctgaatgtattttatctttagctttgtgacttgggtttatattatgagcaattaatatattatattttatgaggccatctatcaaaaacacagagcatcgagaatgtcaatgcctgattgtgaatcagtgctcttccatttacagtctgccagagtttcactctctttgtcttaaaagtagaaacagttattctgccttgctaactttcacaggatggcaatagtgattgtagatatgctgtgtacctgtataaagaggttattaaacctctttatagacagcgatgctgtctggagttaaaaaataggagacagtgtttaaccccccacaaaacagtgccaagtgttatgcttgatgcacattgtctaggttagatgaaattttctgagttttgcctatgcttgataggattttctgcctcatctttatgtcagcggtttaccccttctctatcagtgtgccacccttttacacatcccagttatttgcaaatgtggaaaccagataaccaaacttagaatggtgatcacataataaaacacatgcttaagtgagagcctgaaaagcctgtcttttttttttttttttccaggtactaataagtggcacttttaatttgtggcatcaatttacatcactgagtctgtcccccacttcttccccaccccacccctactgattttcatgtttctttgtaggtggttttgctggagagctgaattttgtataaccttttactccacttctgtgttatcccaagatacagcttctttttttcactgtttaaaatagacattttaaacatcatcaactccccttgataaagctgccatttatgttcagatcttgattttctagttttaataattccattccaggctacctgtgagcctggcatagagtatgcaatcagcaaatatttgcttaatgaataagtgagtggatgagaggtagactgggactcacagagatttcaaaagaaagaaataatacacaaagcatgttaattaacaaggggaaaaattaagaaatgaatcttataaaaattttcagtaagtggtctttacgaatgagaattttctttcagagttaaggaaaatacatatattttgtggcccacaactttattggtggctagctgcatgttaaaattcaatgtaatttatcctgattatacttactgaaagtataatgcaacatacaacacttaaaactttctggcataattactaaaattagaaacaaagggcttttgacagtgtgtgtgatattttggaaatggactctccctccacctgggcattttcatgtagtttggccatttttcattcttgtcacctagtggaggatgggtataatgtttcagtctcccatcaggcatactgggtaagattttagcaaagagaagtattaatgaaatatttttatcttttacatgataaatttagccaatagtttcttatatcaataatcctaggtaagtaacaatttgatagacaggtaaaatttatcttaaagactctagagcgattgctagaataattcattctatatataatatatattttctttaaaaatttgaatgattttaattgctgctctctttgaatgtttctgcccttttatcattttttcaacatttgcattggatcatttgaaaggaatagggtaagacttttgagtttcagtatctcttaaaagaataatctttgctaattcggcagatactttgtaagcatttctcttaattcatgcattataaaaattcttggaaggtcagtttagctcatctgttgagtttcctaatacaagaatgttgctgattttctaaacagattaaagactctcacagggtcagtcaagcactttggaagcatggtacaggatggtgtagccacgttctcaacatggggtcaaggggaccaacagtgtctgcctcaccagagaatttgttggaaatacaaattctctgccccctcccaagcctactgagtcagaaactctgtgggtagacccagtaacgtgtgtttgaacaagccctcagaggattcttaagcatattcaagtggagaaccacttttgtaaattatattttttgtgtccttttatattctatagataatgcccctttttggtcataaataagccaggttaggtcctaaaagtatggaaatcaatattgttcatttaatcttattttttctttttatttttgtggacttgtgtagagaaatatgatttattttaaatgatgtatttttaaaaatacttgagagattacaaattatgtatttgtttaattatgccttggtttctgacagtgtattcagatgcccacacagctaagttgactgagaatcaagggagggtgcttttcgacttgaattctggtttgttggtttgttctgatagttacttgtaaacaaatgagtagaatatttaggtagacttcaatttcacagtaatatcagttagtcttggaagtttggatatacaaagattttcttttatttttctctgttcaacataaataagcattcaatgtaattaaaaaatgtttcattggtaatgccttgagaagatttatttctgatgtctcccatatcttctgttgttctcttttgtgcttggtaggccttcagtaagtgtagtctgacacgctttgtggcctctgcctcctgtgataaaatagattgaaatgattcctggcaccatctggtgaagaggagcagccctggaggactgtgctttgagagaaagtgactgaatgctaagaaatgtggaagtctagggacacaggcaaaggatttttttttttttttaaagagcatgaacattaatacatcttcttgaggtttgatgggacatgtactgcctactgccccatctggtgcttatgatagcatggcatattagcatgctgcaagttcataatgtattcagggggaggaaacatcccttgcataccaattgaggcatcctctctttcagaactgcttttgaatttcaatgatgtttatatcttccaagccgcgtctgaactgagcatttccgctctgaggaataacttgagagagagagagagagagtgagagagagagagagagagagtgtgtgtgtgtgtgtgagagagagagtgtgtgtatgtgagagagagagagcatgtgcaagagagaatgtatgtgtatgtattctctccattaatttatcttcctctcttttttgtgatgaaattaagtagtttttaatattatgttggtatataatttttaaattttttttcttatttgaaaccatgtactactttgttatttcacgtacggcacttaaaacattttgccttgtggaatcatttgtatggttgtcctcctatagattgaacacttttcgagggttgggctggtacctaattatgtttgtgtctccatggcacctagagttcagtcatccatttaacaaatatttatttattgagctcacactatgggtctgacactgttatagatgctgaggaatcaatagtgagcaagactggtgagtccctcctctccaggcatttgtattggaactgggaggagacagacagtaaacaaagaaacagaaaaatgaaaaagatgatttcagatagggataagtacaataaaaaaaaaggctggagagtgacttactaggtggggagctcatttagattagattgtcaaggaagacacctttaaataggtgagatttttgctgagagctgagtgatgggaagatttagtgacagaggaatagcaaccgtaaagccttgagatgaaaacgattgccattttcaaaggtcagggtagcttgagccaagttcaggggccagtccattgctagaagttggggatttattctaagcatgtctggaagccatcagagggttaagctaggaagtgacatgatctaaattgccccctttaaaaggataacttgagctgttgtgtgtcttgcacttagtagtcactaactaaccctggaaagaatgagatgagcctttaaatccattgacgcaccatgtttaattggaattagcatgagttttaagatcagtaaaatgtctgttggattctggcctggccatttgctttatgtttgattttgagcagttatttaaccagttatttagcgtatgtttctcatccgttgaaagggaaaattaataccttaaggccatggcattattgtgaaaattaaatgagataatttgttaggagacccagcacagtgctcagtttttaataggtacctgatctatcactgacatagggatcataataaaacttttgggatagtttcaaggaacatttaaacagttggcagtgtccagttggaaatctgtttctggtactgttatcttcttaataaaacacttcaaatattaccatgatagtagcacttaacatctgtagtttgttgctcttgatctagaattatttaagaaaaaatactcaaggaattatatggcaaaatttatgcccagtgaaacaacctagattttcctccccctgatttcttcttcttaacaaaaatgtatttcagtgaatttgatttcttttacgaataacagtctatcatttactttaaatatattttctttttttttcctcaagacatgtttaacattgaagaagccaaactgccttattaattggaatgaaaattgtggttatatatatgaaggttacaatgcagaattttaattcataaaatagtaaccttattagttgcatagttattagacataagcctttcaaagataattttttaaatataccgtaatggacaaaataaggagtttcttagtttttgcctaaattatgcacttaatagcaagaacagtccttcaactattttcatagtctatgaggtaatgtttagcttctcaaactttctgtagaaggattgtgggattatgagtaggagcagatagtgttggggattgaatatctaaatagagttcgacttattgtgttaggcataattttttgaatatataggttggataagttatttggtatttgttttggggtagaggttcttcccctcctcagttggtagattgttttgtgttttgcctacagatattcaggaaaacaaataatgcttaaggaatgtggaggaggtagtgtgggtaattcaggcaagtttagtcagcacttatgagattcttgaaatgttttttgatgtcctgcagaactgtagagagctgttaacatctgcatgttctgtgagagaagtcacatttatggctgctgtattcttgctggaatgtcagaaaaagagggaaagccacagaaaaaggccacagaagattgggaggtgggcatcacagttcagaataaggcatctgactttacatcctaagatgtatcattttctttaggtaagccccaattgaattcttaacaccatcttagaagagtgataggcttgtgaggtttgagggtaattcgaaaaagatagttgccttgctgagaaacagcctttgtgaaactttgtaggccatcacagatattgtctgtccacaccttatatgtattttcattctcttctgcaggatgccgcaaatacagagacttaggtagtatttgtgttccactagaaagagagggaaagaaaaaccagctgatcaggtgagataggtacattttgctaatctgtgctaggtgtgctgggccacaggcctccagaagagacctgcatgatacagagtcgcatgtgacgtagccaccatacctcctcattttaatttgtttggcttaggcgctataatattgcaaactacactgctagatttctcctctcttgtctcttaaggacaatgaccattatcttgtataatacccaatttgtaattattttcaatttcagttacttggccaatgtggcctttattttgaccatttctctcacatgtttttcagattccaataatagaaagagctctttgtcaccctcacaaaacttgctttcttaggatattaaaggatatacgagatacaatgtacttaagtaaaatgaccatcatctcaccctccaaagaccaggttgagtgtcaaatatatggttctgtctgtctttctatcttcttacttttccccacccctccctttcttcctcccacaataaactttaaaacagatgttgtactatatatttaaaaattttttaaaaagagagatggggtctcactgtgttgtccaggctggtcttgaactcctgggctcaagcagtcctcctgccttgggttctcaaagtgttgagattacaggtatgagccaccataccccgccagttgtaatatttttaggaattaaaatccgtaacaagctttggtcattgtcaaatcacgttgcatacacagggtttaataatgatctgacacactttttccttgataaaattgaaaggaaatagggcctatatgttatttactgacacctcatttatattttgaggaaactagaagtccttaaacgtctaaaacaagtgtattgaatgttcatttaagcagtctatcagttgtaaatgtttacatttaaagttaattgtttattgaaaatggatcatttgaattagttcatttggtgagctaaacgtttgacaacattttgataacagcagatattgagcatacacaagttatactttttatgtggtccttcttgataagcagtgcaatggagttgtaaaaaaattatgtgagaacttttcttaaaggactactcagctgctcaaagctcagatccctgacatgcatcctttccattgtaaacttgtgcagtttacaaaggtctgtagcagatgttggaggaagtgggtagataagattaagtgggtgtggtgtcctaaaataacctaagaggcaattttggagcaaattgtttgaggttaaggactcttgtcttttcttcctttgtatcttttttttttttttaaatccatagtgcctagtacagtgttttacacataatatggatgatgcatgtttcataaaaataccctgtagctcagttatgataggtctgtaagtcatatattcatttaatcagtcatgcagcaagtatttattgaactcttaatacatgctatacttttttctagttactgggatgaatcagtgaataaaacaggcaacattttttgccctcatagaacttacattctagtgtatgtgaggtgggtggggtgtgggagtgaacaggagcagacaataaatgataaacataaaatataagtgagttctgtggtttgttggatggtgataattatggaaaatcaggataaggagggtctgtagggctgttggagcaggggtcaggttacagtttaaatttgggtaattgaaatgcacctctttgagaagggacttttgagcagagatttgagggagatgagggaagcggccatgtagagatatatgggagaagcaccttccaggcagagggtagagtgtggtgtggattgtttgaggaatgggaagaaagacaacgtggccaggttagactggtatgaggatgaaagaacacctggagatgagaccagagagtagcagggagcgtgaggggcagatagctcatggagggttcttgaaggccattgtcaggacttccctgtccaatccatttaacatccatcccacatacccgctgcccagcgcttggttgagtatattcttattcttccctgcataatgtcataaaatcagatgcttaaacatcatatcattctgaagacctcactgggcctcatggttactcccgtcatttattattccatgcctccagatatttactgtcatccaatccaatttgtgttttctgttttatttgttgttgtatggcagctgcattctttaacctaaacactgttctatgtagtgctagtcaaggctgcatgttaagtctttcttggttttgactgctatgttttagtgcttttaaactcattttagatataagatacccaaaacaggcatttgctgaaggtaaactaacagtcaggctgcagtaatattaaaaatcttggccaggcactgtggctcacacctgtagttccagcactttgggaggctgaggcaggcggattgcttgagcctagaagtttgagaccagcctggccaaaatggtgaaaccctgtctctactaaaaataaagaaattggtgggacatggtggtacaggcctgtagtgccagttacttgggaggctgaggtgggaggatcactggatcctgggagatggacgttgcagtaagctatgattgtgccactgcgctctatgtagcctgggtgacatagtgagattttgtcttaaattttttttaatctttgtattaatcatgtgttcatactaaggggcattatttgagagtcttattataaaccgtgatctagaatctgcttccacatttctcttagtaagcagcacacataccgaagacttgtcttgtcagctttcctcattcccctgcagtgagttaaggtggtacaagttacactagtatccatgaacatattaaaagtcaaatgtgtgatacaaatcattcttttctttcaaggtggtgacagtctgaaatgatacatgagtcggcaggtaggggtgaaatatctgtgttctttaggagagcacaggccatggggtaggcttcctatgtaatacaggcatgttcagtttaaattatttgagtaatttccttggacccacttaaattttctgacctccatgaagttgctgcaccgtctaaaagtacctgaaaaaaataaaatctactgaacttaagtggctatataggtatcctctcaaagtataacttttgagttttagtggctgcacaataaacaggattcaattcaatataaaaatatttgagtactgattctgggaacgactttctactaagcgtagcaggggttttaaagagaggaagacacagtcctggcacttaaggaacttaagtgtagtaggggatatagaaggagattgaaggattgagaggcagaaaagtggagactgattagggagaaattacaagaggtagcgcaggttccaaatcaacatgagaggattttgaaagcattgagttgaagtccatgattgaaattcattgaatgagtgtcattatttgggagaaaaggtgagagtggaatcaagggtactgtttgaattttgagcctgcgtaattggcagagtggtcttgcctcagtggaaataagaaagcaggaagaactcgttttgcagaaagaataatctcactgataggttgaattggagactcttacaatagtaggatccatcttgcctacagttgggaatgtatcatggtagtttgggtgaggaattgagtcctgagatataaactaaagtggaaaaaattgtacatttatgtgatggatagacaattttgagaaaatggaaaatactaaatgggtgttatccttagtctcattatcgaagctttgaaattccattgcaattatattatggtttattttggcggtgcataaattcccacttggtaattaacttttatatccttcctatttgtgttctatacttttattttccatatggaaaataaaatatatgtataatatatatatcgatatctttttttttttttttgtagagccagtgtctcactatattgcccaggctggtctcgaactcttggcttcaagcaatcctcccaccttggccacccaaagtgctaggattacaggcttaggcccctgcacctggtctattttattactttctgttacttgtgcatagcttcctcatagtggaattaattgactcctgagtatccttgcttgaatcaacatggtttccaggtggagggtaatatagtggttaagaagttggactttgcagtcaaacaaaactaggtatgattttctcatcttccctccttttacttgctttttgtgcctgaattttctcacctgattctcttgaggattaaatgaaataatggaaaaccatacatgttggtcctcaataagtggttggtgaaaggcagtagtggtgatgagaatgacagtaataatatttattccaaaactcattaggtttatccatgcttctgcatattgcaggcatggagatgtgaagtagaatagagtcccgcaatggaacatgagtttagtggttgctcagcccacctcttcatggtgctctgtgctctttttgccatctcttggatagactgattgagacacaacagacttataccctcttggtcttcttcactcattttttaccatagatgcacctccaagtctggaattgactttttcacacctacctttctgtgagaacttgcagaagtcacattggtttactcattcacaaaacatgaatacagccaactgtcagttacagcttgtttattcagagtgactaaattttggctttttctttcctgctgcctgtcttctgcccatatcgctactattgaatttttgtgtaagcgagtgcatattggttcattttagctacttatcaaggatttttaagagcaggtagcgaaggtgcattatttaccatgggcttttctgagttttgttttgtctgtctatccatacatctatgctgttcccctgactcctgttatcatggatagtaagataaaccaaataagcactatctgataaagaatttagaaactttggcataaattcagcttaaggtttttttttttttttttttgagacggagtttcactcttgttgcccaggctggagtgcaatggcttgatctcagctcactgcaacctctgcctcctgggttcaagcgattctcctgcctcagcctcccaggtagctgggattacaggtgcctgtcaacatgcccacctaattttttgtatttttagtagagatggggtttcaccatgttagccaggctggtctcgaacttctgacctcaggtgatccatccgcctcagcctaccagagtgctgggattacaggtgtgagccaccgcacccggctaaggtttttatgattataattattttttaaattgtgattttaatactgtcactccaaaattccaaggaaattacagctgaaaattttatgtataccatctttagtgtaacactctgtatgtttgttactataaaagatataaaataatcatactttttattatttcatttattttaaaattttatgtaaatttatattaaattttatgaaatgataatgtataatgacttttaataaagttttctctacttttgtgatagtttgctagaactagttagtttttttttccttccttagtatatatacttttttggttgttaagactgggactcagagaggaaaagaactctgtttcatttttggtaagggatttcacaaacttaatttggggacacttgaggatatctcatctaatcttggaaaatggatgtcagttttcttaaaataatttttaaattgaataaaattaactttttgtggaaactttatttttttggagggggcagaatgctatatagtcactagcaaagaggtctgagaaatatgtatagattgaaattcttccttagaacacctctttctccacattcacccattaactttataaccaataagacatatgccttcatgtgagagaaatgagaaataggagagactgaggtccaggtgaattgtctggatatgaacaaattagggacacaggagaaaggtgtgagaaagctcacatgcttgaataaaaatgtggttgttttttcaagtcttttttgggtaactgacatgcttgaatccaaacacagctcagggcactaaaataatgaaatggcacatagtcttcccaaggaaaagctgtgtttatttaaacagtggatgcttatcttttcctttgtgtgtgcgtgtatcatttctgttcagattctcagattacagtaatagctgccatttattagtgctttattatgttccagctgttgcataaatttttcacatccatattctctcatttaatctttagaaatcacttacagaggcagttgccaggaccacccttactttaaggtgagggaaagcagatcaagtgggtgggcatggtgccccatgcctgtaattccagcacttcgggaagccaaggacaaaggatcacttgaggcccttcgaaaccagcctggccaacataacaagacaccatctctacaaaagaaaaattaaaaaattagctgggcatggtggcatacgcctgtagtcctagccagtcggtcagaaggccgaggtgggaggatcacttgagtccaggcattagaggctacagtgagccatgatgacaccattgcaatccagcctgggcaacagtgagaacctgtctcaaacaaagaaaaaagaaatccagtaatttgcccagtttaagaagttggtctgggattccatttaaagtttagtgatctcaaactcatgctcttaacaacctatctggactgtttctgcgtatcatcatgatatcataggcagcaggcactttaccttcaaataataaaaccagagaatgtttacatatgaaagagataaagaaccaccccttcaggccaggcacagatcacacctgtaatcccagcacttcgggaggctgaggcaggtggacctcttgaggtcaggagctggagaccagcctggccaaggtggcgaagccctgtctttactaaaaatacaaaaaaaaattagctgtgtatggtggtggttgcctgtaatcccagctattcaggaggctgaggcatgggaattgcttgaatctgggaggcagaggttgcagtaagccgagatctcaccactgcattccagcctggacaacagagagagactatctcaattaaaaaaaaaaaaaaacccaccccttcattttttagcttaaaaaaataaaataaataagcccaaaggtttttgttttgttttgttttgttatttgggacaaagtattgctctgtcacccaggctggagtgcatttgcgtgatctcggcttactacaacctctgctgcctgggttcaagtgattcttctgcctcagtctcccgagtagctggggttacaggcgcatgccaccacgcccagctaattttttgcatttttagtagggatggggtttcaccactttggccaggctgatcttgaactcctggcctcaagtgatctgcccacctcagcctcccaaattgttgggattacaggcgtgagccacagtgcccagccatacccaaagttttaaacagtttttcattcagccagccaatcaaccatcaaatatttactgagtatctactatgtgccaagtagcaagtaagccaaacaaagcccaggcctttgtgaaatcctgctggcctttagtcatgtatttgatggtgggttattggtgggaggtgttagtcgaatagtatagtagttaaacccggagcatgggccgtgaaatcatgccccttggctttgcatgctgttcatttgctgtgggacaatggacaaattatttattctttttaaagctcagttttttcacctgaaaatggtaatatgaataagatctattgcattgtcttatagtgaaaattaaatgagttaactcatgtaaagcacttagcaagataactggcacttggtaaatgctcggtgagtattaactgctattaagataattagaaatagcctgggtgcagtggctaatgcttgtaatcccagcactttgggaggctgaagtgggaggattgtttgaacccaggaatttgagactagcctgggcaacagagtaagacctcgtatttgaaaaaaaaatttatattattttattttttttgatcatatctcactgcagcttttaacacctgggcacaagtgatcctcctgccccagcctcttaaatagctgtgactgtaggcacatgccattacacaggctaaaaaaaattacattataaatatttctagcagtaattgtatttcaccctgacgaggaaggcatgtacaaagatttttacaataagatgtgagttgtatgatggggaagaaatggagggctttgaaagcacagtagagccagacctaactcccagttggttcagggaaggttctggtgcagcaacactgttttccttttcaccttttttgtttttttaaaacttgataacttatttgatgccctaaatcctggtgttctttgacttaacagcagtttgccacagtgtatttattcagaattagctgtgtgctaagcattgtgcagaatgctggggatggaataatcaataggatgtagactcggccttttaaggaacatgtgtgtccgtgtgtatgtgtatatagtatacacacgggacacacacctgcaaatataatagttgtaataagtgatgctaagtttgctaataaatgtatgtaaaatagagcccaaagaaggtaatgatcaactctttgctctgaatatggggcaggggtaatttgggaagccttcatgggagaggtggcacttgttctgtgtcttgaaagatcataagcttgttgtagtcaaggtacatttcaaaatcagggaagaccatgacctggtatgaattgccagggctggagcatatgctgtgagaaagtaacagagggaaatgtcaagtcttataagtagaagtggtagaaagggaagccactggatgcttttaagcagaggagtcacattgctgggtttgaacgttaacatcactctaggagtgaagggaagggtagattgaagaagatgagatttgtagtacgctaggtgagagaacatgaggacctgatgggccacagtgtcaatgagcaagaagggaagggaggaaggtacaggctctagaagtaccaaataaacagaactgaggggctccaatgatcagttggtatggagccaggtatggtgagcagtggtgtctagagtgactctggattctgatatgagcaattggttgccatcaaccagaatggggaataatacatcgagagaagacagtgagttcactttgaaatgttaactttcagttttatttggtgtattagtgcagagatactcaatggcaaggtggatcacaggtttgtgaggtacagatgtatacagtgaaaaatcatcatttggagtcactggcgatagctaaaaccttttgagttgctcattcaggaagaaaacaagtggtataaagagaggaaaggcttgaaaagaatatgggaataccagggcaccagaaaagatgaagagaggagaaggaactgttatggaggttttgagagagtcaggtattgttaaaacaacaaagagtttcacaaagggagtggtgtacggggtgaagcactacaaagggaccaggaacagaagaggggtcaagatagccttttgggccaggcgtggtggctcatgcctatgatcccagcacttggggagaccaaggcggttggatcacttgagctcaggagttcgagaccagcctgggcaacatagtgaaacctcatcactgcccttcagcctaagtgagactctgtctcaaaaaaaaaaaaaaaacaacaacaaaaattgccttttggatttggccacctggaaggaaagtagcaggtaactttgtccttttgttggaacttttttgtggtggattgcaaagtggatggagcccctgaggtctgcccttaagaagccaggcagtgggagaatggaggatgtgccagtatagtctacaataaaggggaggggtgttaatttttctggatgagagagactccagcaagcctaggttttgagaaggagtggttagggccaaacaagttgaagataagagagagagtaatttctgggagagtgaagcccctagaggcagaagggtgcctcttctgagcctagaggcataggtgcagatacagaggagtttcgagggcagagtttgcagagatgtaggacccatgaccttactttgctatattaagtagactatgaggttatctgcagaggagagtagcagagtttggctggagaattgagatgagtcagtgtctttgagatgaatgcaacctggtttttttactggatgactttcttgcctcaccttgtccggggctgtaccatgttggatatgcttgggctcatttaatctcgaaagccttcgttcttcatttcctgtgtcctgtttggcttttcctctttgctttatcccacctcacatctaaccttgaccacagcatgaactcgtaactattcaccctccctttgtgtttctgttttttaatgacatctccttgtttcttttcttactgggtttataaccaattcactctccattgtccttttaaaagttagaatcctgccttcaggattttttatgcttttttatacagttttttttaatacttctatgccagacactgtactaggactgggatataacagtgctctgggagagagattaaactccaattaaaaggatataaaagaattttgattagctgggtgtggtggcacatgcctatagtcccatctacccgggaggctgaggtgggaggttgaggttgagggtgcagtgagccgaaattgtgccatggctctctagcctgtacaacagagtgagaccctgtctcacagaatacataaataaataaataaataaataaagaagaattttgagttgtgtaagtattgggaaggaaacaaaggggtgaaaattctccatgagataggatggtcaggagaggattgattccatgagaaggtgacattgatgttgaaagataaaggtgaaaatgagctaaccatttgcagaagggagaagggaaatagtaagtcttaaaaaatatttattgttttcataaatagacattccataagtattggattaactgcctggagctgtttgtggtactcttgggtcttccctactggtctttccttggttcctgaaagctccatagaagacctgtaacagattatactcctctgcttttaaagcagaggattttttttactttttaaatttattttttttgagatggattccctctgtcacccaggctggagtgcagtggtgtgattatggctcactgcagccttgacctcccggtctcaagcagtcctcccacattagccacctgagtagctgggactacagatgcatgccaccatgcctggctcatttttgcatttttctgtagagacagggtttcgccatgttggccaggctggtcttgaactcctggcctcaagtgatctgcctgcctcagcctcccaaagtgctgggattacaggcatgagtcaccgcacctgatgagaaggacttgtttatgtatttttaaaaaaatattgactggaaatgcagctgttactgaatacctactatgtatttatgggcagagggaagaacaaggcacctgaacatttctttcacttagttggatgatgtttctgccctccctccttctcaacatcagcatctgtggcttctcaaggcattggtcatccacaggacacggggttataaatttacacattgatgagaaagtttatttcagaatttctcaggtaattctgattcagtagcccattctcccaacccagttgaaaatcatcaatttttatttcatgaggcgatgagggtgtaggtatgtatatgaagttgccatcattagcccatcaccattatatgaattagttgaaatgactattggaacttcagtcccagaagtagacatttgggacaaatctgaagctcaggacattgagcctagatgggtgtcactatttagtatctttagctagggaacaatataagagttccagatttcttggagatcggagttagagggaggtactgaaaggaagctaagcaaaggagaacaaggaaacactgaaggttaactgtgctgacctcataattttgtctagagtcagctcaaataagttgacataaccacattttccagggcaaaatctagtgttttcttgaagcccaaacttgtacaagtaagttattgttctttagaaaaaaggagataaagagtagaatttgtgtaatggtttattaggcttcagaaaccttccggaggcatcctggcaagttctcctgaaaaggaaaggtattcaaaggtgctgtgttgatccctcaaaacagaagttcccaacagtttttcttgctgtcactcaaggaatgttgacattgacgatcacagtggtcttctgtgatagtgttgatcacattccaaaaattctatccctttgccttttagggaagtactagtgatattatcataggaatggttttggatatatcctaacttgagttattgttagtaacaagttaataacacaatgaacttagaaaattgagaacactttcctgtatatttagacatttattgctttcataattaatttatctgacaaataatatcaagaaggttgtgtttctgaaaacaaccttatagatctttagcaagcaacatttttcatttatatgtggaatgctctttgcagttgtccatcaatgtttggtttgattctcgccattataattcttcataagctcagagaagacatctctagtgctatatgaaatataaatgattcctagtaagtggatgggaatttagactgtcatcttaatttaataacatatatacccatatttacagtataaatagaaatgaggctacattaagaacttactaacattaaatttatgtatgtgttcacttgagacacttccctggaacttaaggtggtgtctgaattgtaaaaatgtgtcattcaaattgtaactagccagaattttatggttctaggttccccagtggttttcctggtattaaaaggtatgcttgcttttacattgtctggaaatatggaaggtgaaagtagacttacttagatgcttttgaatatatatatatatatgcagatatttcctgctaaggcaatcttgattttctgtccttagggaatatttattagcaattaattatttagggtaacttctctgaattactttattaagtaaggtcatgggtttccatgaaaagttgtattatgcaaagtattcactgatgtagaaactctattaagaaatgataaatatgaaattgaaacaaccgtataaaatatatggagttgatctccctttatattgaccatattaagccaagagaaaatcgcctttaaaatttttttttatgtatttagagtgtacaagtgcagatgcatttcttacatgcatatattgtgtggtggtaaagccgaggcttttagtgtaccaaatgtgatcattatacctaaaaggtaatttttcaactctcacctccctcccaccctcccactttttggagtctccagtgggatacctattatcccactcttatttttttttttttttgaaatggaatttcactcttatcgctcagacgggagggcaatggcgcgatattggctcactgcaacctctgcttcccgggttcaagcgattctcctgcctcagcctcccaagtagctgggattacaggtgcccgccatcacacccagctaatttttatacttttagtagagacggcgtttcaccacgttggccaggctggtctcgaactcctgacctcaggtgatccgccctccttggcctcccaaagtgctgggattacagggcatgagccactgtaccagcctatcccattcgttacatgtgtacccattatttagctcctacttataaatgagaacatgcagtatttgactttctgtttctaaggtatttcacttaggataatagcctccagttccatccgggttgctgcaaaatacatgatttgattgtttttaatggctgggtggtattccatggtgtgtgtgtgtgtgtgtgtgtgtgtgtgtgtgtgtgtgtatatatgtatatatatatgtgtatatatatgtatatgtgtgtatatatatgtgtatatatatgtatacgtgtgtatatatatgtgtatatatatgtatacatgtatacacacacacacacacacacatatatatatgccattttctttagtcgtctgttgatggatacttagtttgattccttgtgttgctgttgtgaatagtgctgcaataaactaggagtgcaggtatctttttgatataagaaggaaatctccgttaaatgcatatctttcgttctcaattaatgcatcaatataattatatgtaaagaatttgctaatataagtcacaggctgttcaaatttgtctttgggagcccttccagaggcctcaacttttagtgaaactgctttatggggtgggttccattttgtcacatggcacttactaaatgctttctgaagaatctgatcattttttgggggattgtattcttatggtgctctagtgtacttttggatttttccccaaggtgatctctagtcttttcctctcagtcagctagtgtttgtggacctttttcttactaaaataatattcattcttttattcagtgaacattgatgctaggcactgttatatgaatgggatacaaaggtgaataaggcactttttctactcgtgtgtgttcacgggctttcttgtgctccaaccgctatagataactccgcctctttaaccccttctcttcccttttggttgtcttgaatcctgctttttaccccttcactccaaagctgaatagccttggtagagttccaaatttaaaaaaaaaattttttttttttgagacagagtctcgctctattgcccaggctggagtgcggtggtgcagtctcagctcactgcaacctccacctcccaggttcaaacaattcttctgcctcagcctcctagtagctgggactacaggagcatgccaccacacccggctaatttttgtatttttagtggagacggggtttcaccatattggccaggctggtcttgaactcctaacctcatgatccgcccgcttcagcctcccaaagttctcggattataggcgtgagccaccgcacccagccaaaaaattttaatttttgtatttagctgggcatggtggttcacatctgtagtcccagctacttgggaggctgagacagggttttgccatgttggccaggctggtcttgaactcctgggctcaagtgatcagcccgcctcaccgtccgaaagtgccgagattacaggcatgagccactgtgcctggcctgacgatatatttgaaagttctgccccattctgaatcacgaacttaagaaatagctactcagtattctaatagagatcattattatacgtacccttctagtctttttacaaacacatacacatccatctaattgtcttaaaatagttttcttaaaaaacaggatcttgtaaaacatactgctttgtaacttccccccatgtggtagtagtatattttaaagatctttccaagtaaatatacacaacattgtattccactgtggatgtattagaatttgaattgccaaatgcctattgttgaatagttaggctgtttccagtttcctcattatgaatttctttgtatacttgatattatttatgtggaataatttccaaagagtggaatttgtgtattaaaggatatgtataatttagaggcaattgatgatatgtattgcctaattgtcctacaggaaaattattattttagaaaagtatattaattgaagtgccaatttatactctaataccatattataattaaaaaactatcattttgttggatgaaaaaaagatcttgttttaatttaaaaaaatactagagaggttaaactttcccttatagggttatgggtcattaatatttattttgtacattttctatttgtgttcttttacaatttttgttctgttgggctgttgaacttttaattattgacttgatggagctatttcattttttagagacagggcctcactctgtcacccaggctggaggcagtggcgtgatcatagctcactggagccttgaactcctgggcccaagtgatcttccttcctagctgtgcagagcactgggtttacagaattgagccactgcatctggcctgatggaactatttctatattaaggctatcaatccattgttgcccgtataccaatcatattttcttcatttgttacttgcctttttactttccttttactttatttatggtacattttgctgtactcatgtttattagtaagtgccattattggtcttggctcatcatggttattgtctcttttctcattctatgattaaataaatatgcacttacatatttaattttttactgcagtttttattcatacagaatgagtgaatttgaatatatggcatgagacgggtttatttttatgaattgttgtctgtctagtagttgcttgggaattactgaattattgaattactttgtctttttctcactactatgagaaattattgtatactaaattcttaaaggtatatccatttctgaacttagtattttttctattttttttttattctgctgtgttggccatctattcatgtactagcagcacactgttgaaatcattatagttttgtcatgctttttttttttttttttttttttttgagacaggagtctcgctctgccgcccaggctggagtgcagtggtgcaatcttggctcactgcaacttctgcctcccaggttcaaaaaattctcgtgcctcagcctcccaggtagctgggattacaggtgtgagtcccgtgcctggctaattattttgtatttttagtagagatggggtttcaccaggttggccaggctgttctcgaactcccgggctcaagtgacccgcccgcctcagcctcccaaagtgctgggattacaggagtgagccatgtcttgctttaaataaacgcccggccttgtcatgctttaaataaactttaggctgctgggcactggtttatgcctataatcccaacattttggaaggccgaggcaggaggattgctcgaggccaggagtttgagagcagcctgggcaacgtagtgaaactaaacctctacaaaaaaaaatttaaattagtctggtatggtgatatgcacctgtagtcccagctactccagaggctaaaggaggatcgctagagcccatgaggtcaaggctgcagtgagctatgttcacaccactgtattcccgcccaagcaatagagcaagaccctgtctcaaacaaacacacatgcttacatacatacatacattaggctaaatcttgtcacactttattttcaaagtgtttcctggttattttcatttttatttcagattaacttttaaaacatttgtaaaattctagaaaaaaatctactggtattttgtttgtaatgatttgagtacacacacaataggggttgaatggacacccgactatgttaacttttttagatggtttagtacaaaaaactaagggcctactatgtgcaagatgcttatgtttagacaccggagatacagcattgaaaagataaggcatcctggatcgcaaaggttatttagaagtggaattgacagaatattgggatggactgtagccagaggaagtcttaggatgattgtggtattttggcttggttagctcagtggaaaataatgctatgcccagagattgaaatataggaggaggcacacatttccaaaggactatgttaggtttggttccacatataactatcaatgggatatccagctagagttgttaagaaagcagtgagacctcttggtctggccctcaggaaagtatccttccttggagatatggacacctggcagaatttgttgcatgagatgtgaaggcctgtgtcagacgccagacaggttgaagccagttcagaagatgaggagatgaggaagggccagggtccaagagaattccattgcactcctagagatagctaggagaaggatgccactgcagaagaagaatgagaagtggctaaacagatcaaagggcacccagaggacaggtaagataaagactgaaaggtatgttttgggttaaccacaaaagagttggtcttttcaccggggtggtttaggtggaacagtagtgatagaagccccattgcagtgggaatgaggttgaaatatgagaaagtgatttcattattatcgtcagttgttattttattctttctattactgaagaaacttcggaaccccttctaaagagaataaggagtccaattgttttgctctacctgtaccttcaaatctatatttttaaataggaaatttcttatatatccactgtttactcatactaagtacttggcaatgtgatacgttctgggactgagttgatatgataagaattgatatgtccccatttccttatgggacactactctctggcaggaggtgttagacaaataattatacaattatatacaacagttgtggtaagctctacaaaaacagattaggtagtacgatattgcttataatacagtgggtaggataggggagaggtcaaggacgccttccttgagtaagtgaatttgagctgagatggattttctagggagagggaaaggccctgaggtgagatgaagtttgcagctgattaaaccaatgaggcatgagatgagataagagaggcccatattaaatctatctaggttgttggtcatttgaaggtttggattttatactaagagttatggtaaaccattgaaacactttaaataggggaatgacttgatcggatcattagaatgtaaagttcttgagtgtagtgatttttaagaatttttgttcactgacctgtccatagtgtttaacagtacctagcacattttatatagctcagtaaatatttttgaatgaatgctttttttaaaaaaaatgagtgaaacatttggttttacaagaagttttcatctgttgtttcatgtaaacagattgcagtgtggtgtgagaggttgtaaagtccaagtggaagatagtggtggcttgtatgctagtggtggcagtggaaatggagaggcacatggaggaggcagaataatttgatagtggcaagtgtgggagacgaagctacttgggatattttatacacgaacagcacagtaccattgatgaagttgaacttatcctgtcctttttccaaatacttcttccagctgggttttggcattggtttttaacatcaccatgcacctctcggttcctacttattcgagggcatcttactgagctgtgttaacttgagcaatacttctgaaatatctcctgaattttccccttttctccagtcttacagccatttccatactgaatgcctgtgttctatcttgcctagactattgctatccagtactcctgccctgttgccacttttatcctattcatactgtgctctcagatacactatagaaatgaacatctcatttggctgcctaaaatctcagtgccttttcattgcctataatgtaaagactaaactaacagtactttttttccccctagagtacattcaattaaaatcaagaaatgttcatttaaactcctgctgtttgcttgtctacgatttagccacaggtacataccctgggcaccttcctgattgtctctcttgatttgctaattactatctggatgatcataactgactctactgagtgtctgtgctaccgtttttctgcagcagctctctgaaccttctctataaccttctttatccttgtcaaataagacaaatgttattagagtaataattgtcagttctttagatgataaaaggtttggatcactaatgacttgtttttgttttttgtttgtttttttttactttccagaatgaactacagtttgacaacaaaatgttaacatacatgcttatgttcagttttggggcccttgtgataacatgcatctttctcttctctttggacaaggaggagtgacttctgttatttgggcaacttagttttccttcctaagtattgttaaccttaagtagacatttgctatttgcctgtgccaggggctttaaacttttctttgttaaacaaggacccttatttttaaatgagatcttaaatagaacaccagggtgtaagtcagattaacctggaactagcctatttgaagtgtattgacttcacctatttgaagctatttgaagtgaagtcgttagatcccaggctgccacttaatatccatttggtaccttaggtacctccaagaagtggtgattagaataagaagcaagagtcactggaataaaggtggtaacagctgtgggagggatgacatttctgaaggacttagacatacaagtaatgcctggcatccaccagtattccaatgacagcagatctttccttacttcatgaaatgagtattatttttctgtccagaaccaccatttgctctattgaactgtcttaaggatttgtttcaaacagctaagttatttgattaaaatagtgataaaattgaaaaaaaaaaaaaaagaattactaatatgtctctagctgttttggcagaaactaacctttcttccttcctttcatccatccctccctcccctcctccctcccttctttccctccttccttcccacccccccccccatttattccatccgtctgtccatctgtccgtccatccaatgcctactatttcaggcacttttctaaatgctacagagctaacaaaacagagaaaaatctctgttcacgaagctgacattatggatggggacacattcaaaaataagataaatgtgccatgcatagctagccggataagtgctatagaggaagggaaggggaattcctgttgtccctgtatggagatgagccaaacatttttttgaaattagttttccaaaaatagtaatcgattgccatagatttatctcattctcttacctggtttccctcttaatccaagttcactcccattaaagaccatagggatgtgctgcagtcatctctgattctgggccagctgctgactggctcatcccaggactgtgagcctgtggccttgtcctcactggcatggtcaccttgatgtttactgatcacctgaactgagaatgtcttgtgccggcacttcttcagagctcatagcttacatatctttgggcttcagacttgtttttcctatctcatcatcatcaaatgtagaaacccagcatataaagcaactgaaaggtctgaatggcagcggaagatgtttaggatgaggctccagacaatcctcctgctccccatccctttgggctgccttgtcacctccatggacttctgccacagagctgttatttctagggtaacatttcagagtcattgttctaggatgccattgtccttttctgatgacagaagtgttttataactgagctttctaacatagtaaccatcaggcacatgtaaatttgagtatgcagctagtgtgactgagaaacgaaattttaaattttatttaatcttaattaaaatttaaatagtcacatgtggctagtggctactgtattggaagatgctttttttgtttgtttgtttttctttttttttttttttttttgagacggagtttcgctctgtcgcccaggctggagcgcagtggcgcgatctcgactcactgcaagctccgcctcccgggttcacgccattctcctgcctcagcctcccgagtagctgggactacaggcgcgcgccaccatgcccggctaatttttgtatttttagtagagacagggtttcaccgtgtcagccaggatggtctcgatctcctgacctcgtgatccgcccgtctcggcctcccaaagtgctgggattacaggcgtgagccaccgcgcccggccgtttgtttgtttttgagactgggtctcgctctcttgcccaggctggagtgcagtggcacgatcttggctaactgcaagctccacctcacgggtttacgccattctcctgcctcaacctcctgagtagcttggactacaggcgcccgccaccaggccaggctaattttttcatatttttcgtagagacggggtttcactgtgttagccaggatggtctcaatctcctgacctcgtgatccgcctgcctcagcctcccaaagtactgggattacaggcatgagccactgtgcccagccggaagatgcagttttaatgtaatgctagctacagatttaacgtttactgagtgcagttcatatcccagttttccagatcatgaataaaatgacagtagttttagaggataatgaactttgagaaggcatggattaagacctgacttaaaaccttgggcaaatttttcaatccctctgagcctcagttccttttttataaagtgggcaaatttatagtaccttttcatagagaggtttaaagtgagataaaccatgcccaacatttggcacaatgcctaagcctgattgtagctgatttatcctaatagggttttgttgttgttgttgtttattggggcatttctttggcttgtaaaatgtaaaatatgcccattatagaacagagaaaaataagaaaataaacataacctgtaccaccatccacagacaaaacaacagaaaacttgtagaatgtagaaaaaagtatgtctttggttcacaatatgcttttctctttgttttgaatgtgtacatgtatgactacactgacactactattgtaaaacagtttttagaggccatagatcatatgtgtataaattgccttacaaactttttttctaatatcatatactaaaaagtctcaggaaatatgtggttactgagagttgttagaaaactggtgaattgaataatccagtagtatttttctagatttatctttagtgattaatttttccagaatataaaaattcttttggaattctttttggatgatgagaggaaaaaagagatacatagatgatttcatcttgagttaaagctgtgtgtcagatactgctaagtgctgggactataaaaacaaataaaatgtcatcattgctcttaagtaaattgtggtctaaatactgtgtgatcagtgctgcaggagggatctagacagtctaatatgagaacttgggacaaacccggccagctggggatagaaaggttgtcagcaaaaggtttctggctgaagtgacacctgaaggaagttttaaaggaatgatggacttaattaggcggtgatggggtgaagagtattcaaggaaagggatgcagtgagtatgaaagccagagtgaccatgggcatttggagaactgcagctgtctagtatggaggtcagaggtggggatggggtggatggcagaaatgaagatgtgtctggagcagctgcaggaaccagatgggtcacaaaggtctttctatgtcctgttaaggagcacagactttaaggttataagagatgtttaaagattacaagaggagagaggcaggatctctggtcacaccattggcatacatagaaaaataactggatgtggtttggagaatgtatcagagacgggtgggagtccattcaatgacttgttgaataggtcaggcaagagatggtagatgattcaggttgtagaaatgagtagccctctggaagtttgggtctagaatttgggagggatattgactagagttattctcatactggccacggagtgaataaagtcaccctttccggagtgcttaccatgtatcaggcatttgaccaagaatgcaatacacattatttgagtttattcccacaatacaggggttgcaaaacatggccagttttacatagaggatggcaaattccagtcctgtctctgaagcccaatgataacacaaatgaaatcactaaggaagagtataaagtgaaaatttgaaaagggtctaagaaggaacttaggggaaaatgtcagtagttatcacagagcaggaaaaagaggagcccttaagagactgaaaaggagaagcgaggaaagccagagaaagagagtattagactcatggaattctggggatgcaaatggttcaaggaggaagtggggaagtgtcagatgctacagagatgtcagataaagtagtgtacatgtttcttggattaagaataaagagacaattgagaagaatttcagtggagtttaggaggatatcttgatgctacatgccagggttgctttttttttttttttttttttttttttgagttggggtttcactctgttaccccagtggcaggatcttggctcactgcagcctctgcctcccaggctcaagagattttcctgcctcaacctcctgcgtagcaggaactacaggcatgtgccaccatgcctggctaatttttgtattttttgtagagacagggctttaccatgttggccagggtggtcttgaactccagtactcaagtggtccacccacctcaacctcacaaaatgctggaattacaggcgtgagctaccgcactccaccttgcatgccagggttattttatcagcatttcttggttttggtgaaaatcagctcaatctcggttttaggcaaagtagggattgtttgactaggaatctgtagaaggtttggaagacccaaattgtaggaattttacagatatgacaagtccctcgtattcactagaatgagggactttatttactactaccatgataatctctcattacttctctttgcttttttctgcctgttagttgctggcttttgtgctgtagacctgctttctagatgtggagggtagtagatggtgcagttttctaccctcaactctaaatataaagatcttggagaaggactgatactgcctatcttggactaggtgctatgtctgggcctgttggtgtcttgggtacaagttcatgaaagaacatggtagttcccaaggtagttatgagattagagggaatggcagtttccagcatgggaagagaaatgtttagacagacagtcttataggtttctgctcctagtgcatggaagatggagtgggaaatgaagaaccagagaaagtgactatagattctcttttaagagcctgggctatgaaagaaaatcctagtgattgttttggtgacaactaaagagggagaattggactttagaatgcttattttataactaaatcattgatgaggagtgaaaatgtatctgaaaagaggaggtagacattaattttaatgtttatgggagaaaaatggacatgcagacattcttgtggacatggaaatttatgtgaacagaagaaggctagttatgatcatcactttcaaagtgattgtatttgtggtcacttcattatcaaatatatgttttcagggtggtcatctttgtgtttgtaatgatcataagccatatctatagaaagaaaccagagaatattagtatttgcaaaagatctttagaaagaatacaacctaatatgcttaattcatagataagaaaagtagaattcaaaaaagtgaagggaagtaattacttacagataaaatagtgcctattagaagagaagggactatttgctccctgggtccctgtttagaaagtgaggatgtctttctcacaacctcttcagtagacctcctttcatggcccattgtccagaatcgaatcacatcacccacctctgaagcctgctattgagaaagaaactgtgataatctgactaatgtgcaacaaggagaatttgcccccaaagattgtgggaagaggaagagtacctgaacaaagtcagggctctccagcaaggaagaaagcaacaagcattgctaagaactcaacagtgtttgcaacatggactaagctaaagaggttatattttattccatggacaatgggactctcctgaaggttttagatcagagaataggtaagatcctatttgtgtttcagcaaaaatgctattcataaaacatctatggtcttagtccatttgtgctgctatatcagtaccttagactgggtagtttaaacaagataaatttatttctcatacttctggaggctgggaaatgcaaaatcaaggtactgacaggttgggtaagggcctggtctttgctctcaagatggcagcttgttgctagaatagtgcctttttacatggcagaagagatggaagggcaaaagtggcctccttagctctctccaacccatttgtaagagaccgatcccatccatgatggtagagcccttatgggctgagtgcctcccaaaggccccagttcttaatattatcacattggtgattaagtttcaacacatgaattttgggaaacattcagatcacggcacctgtgataagacatgaggtgagacgtcattctatataagttagttgcaaagttgaactaaatttcaggtctccagcatcttcccattgttatctacattctatcctctctctgtgtatactgttgatggtgtgtgtttgtcttttaccatgaaatttgatatctttgaacggataataatatagggaatggatttctaatagttagaaatgtaactatccacaattatattactacatatttattaagaatcctcctcaggaggaattttaaaaaatatcgccatcaagtgcttaccatttgcattggttggaatgtttgggtgtataatatatacatgtgtccatcatacagaagggctgtgataaatgttaaaagaaaggcagaggtaatgtgatatggctgttgctcggggcagttgagggaagctgaaagaggatgtgtgatctacagtgagcagtgaagaatgtgcaagtgggacgggtcattctagatgagggaaacagcaagtaaaagaaaggcagaaaagccagggagtaccaaggtggctggtatttgatagagcctaggattgagagaaaagtcaggaatggatcatggagttgaagacacaagagaatgaagctcacacctgctggtacctaatataagtaggcacagtgctagggtttaaaacgtgcaatctcattcaatttcaccacattcctatgagggacagaggatcatttttgcatttttttctgatgagggactgaggctcgggaaaactaacttgcttgagaactcactactaatggtggagagagtcaacatttgaagccagtctgccttaggaagttattctgttatgccaagtatcccactgtgtcatttcatgattcttagcatcttagtgtttgactttcattctcgggcattgcagaagggttctgagcaggaatgggcattaccacagtgctcatcagggaagggtggaggctggatggagggcagaagcgaccagcaccattgttctggtccatggatagtctcctgtaacatctgacacccagacattggagtcactacatagcatcattttcagaactgtatttgccatcttttccagtgaaataaaaattaaagttctatacccaccttgatgcctctctagcttccttcttctttcctgtttcctgttacaggacttgcatttcactttggcttatcctctctagtacataccttctagcttagccaacacttattcaaatatgactaactcagactaactactagttgtccaagaagttcctcctaatccataacatctctgagacttcgataattgacctgataaactgatagaaaaagatgtaccacctaccaatacttgaactccctttttgttgttgttgttgttgttttatactggtcctctctagaatgctatgtaaacaaggaaaatgcagaatacctactttttgtaccttagaaacacatctggtgctatttgaactaactaaaagtaaagtaagtgccatggcagattatgccataccttttctttttattgaaaaaaaaaaaaaaaaaggaaatgggaaacataccacttctagaaggccctgacactgaactggatattgaaatcatataggtaatgtattaatatatgccacatttgttttccatgcatcaaccatctttggtacatatgtgttggatatttgccatgtgagagaaacgttacacagagggaagatcgtcttgtttagaagtagtatgaatcgctaaggtagaagtaaagtcagcccttttttattttacttacctttgctacatgatctgatggaggttttttcttttgcttttttcttttgacttttaatcattttgtgtcagtctttgagtatatgtcagaactcccctattgcaactaaaaaatggaaattacataccaggacactataatttccatgaacttaaaaaattatataagaaatattataacttaatattggttttaccatgtcctctaatttgaaatggagtgaaatgcttctgtggttaaatcagcttgcttgtgctgtttgctataaaagtttcaagaatatatatttcaaaaaaagtttttaaataatccaaaacaaatgcaacagggctcagcatacttgaaacacattttccgcatttatcttaaatctctgtgctccagagagtgttcatgtgtatgtggattaggcctggctggttatttcaccatctatctccatcctggattgattgcactgaacagcacagaatgagttacatatggtcccactttgtctcagtttgtaggacctctgggctggaactccatttgatcagagtgaagctaaccattgcagaaatttggctaatgtaaaaaccctgaatatatgcacatatacatatattctggctagaatgttcatattcctattagaagtagtggtgtttcctatacattgtctctgtagttattgttgacatttcaagaattaaaaaaataatctatggatgatgatgttgctgttctggataggagtcgttacaagtgtggaccaagacaatattcagatgttttcaaatcaaaattatgaatataccaaaaactttctaaaattgggaagaagataggaatacaaagattatcttaaatacaaacttaaaattgaggaggaaacttattgtcaaatttatagtttattttttttagggtggtctattttaggaaagaaaaatagccttcaaatatgtttaagtttagatattgctccttaactctataaacttgagtcaggtagggggctgtgcacattaaggtccagcttgtagacactgagggtaaaggaagctgttgagggtaacttactcccccatcaggctcttgtctctctattttgttctttttcctcctcttctttttcctcctattgctttatttatttttttgttactcccacttcccctccccctcctgctcttcctttctctgtctgtgcaaccacgtgcttcaaatctgtgtatctggactgccttctctaacagttccgtgtgagtgttagcagaatgaaaaccagatggaccagcagttcccactgttatctcccagccgactctggcaagcctccctttttccctccctccttggcatgacagaaatatttgcctttatttagggagacttgtatttgctgctgtacctcttccctcagctgcaacataagtgggaagctatttattcccttgttgctgaggttggttgaggtgagtagaatgtgcaaatgaatttaactgttgaagaagcggttttaagcctgcctaacttctgtatttttctagaataagtgacttactggttgtagcaatctgaagacaagtttttaacaatagataaaggtgaaaatgctcttcatgtgtgtctctaccatcctttcactcagaacacttttattcactatagggacatccgttgttattcagccagaagtatagattcagaaatggagaccctgatattgctgttaactcatcaataataataataacagcttattgtgcaaatactcttattagaatgatgattattttcattctcttattgcatcttccctaaagtgatatcaacattatttcaacttttaaatgttgtgttttattgcaacccaagtgttaagcaattgctttgaacaaaagtgaggtagatttggaattgttatagtagtaatttgggtttttctttttctttcaataattgacctttaagtgattttgagattttctcactgtggttattataacatttttaaaggcttgttctttcttaatagttacttcacttttctaaaagcccaagtgtgagatatttgtgtctataactgcaagaggtgcctcaaaatacgttgggtgtgtgtgtgttcatgtgcgtgcctacacatttgtgaaagaattagatctaaagaaccaaaaatagagactctgatactgctgttgactagctcatcgtgcaaatgctcttatttgaatgatgattatttttattcttttattgcagcttccttaaaatgataccaaaattatttcaacttttaaatgtttattataaccaaagtgttaagaaattgctttgaacagatcaaaaggtctgttgctttgataagtagattagattgagaaaaacagttcagaatgtcaagggaaaagtatacttacagcagttctgaagtatgaatgtccattattgggtaatcaggaaatttcttcatatctgccacatactcatgaaaaaaatattagcagtgtctagttctttttagttctctgtttgggacttttacattcttaactctgtttgagattattaattggagtattggtttcatgcttttaaaatggcaggtcataaatttacaccttttaagtaaataatagtttcacttcattgtataacacatttcacctatgtagcagtgatttttaaaacagggcaggaaaaattgaaatgcgaaatatgcctggaagacgataacctatttcatctaataggccagaaaactaaggacagcacagggatggcaggtgtaagagaaaatcattacaaagagctggctcctaccagtatctcacctgcataacagacttcaggtttttgttatttctgagctgtcatgaggggttcattatcatcccacttcctcatctattttctacctcttgctaacattggcttcagcttccagtgcagttgtgctgctgcatataacactaccaaggtagcatctgcctaagccagaaataacaataggatataatataacctagttacaaatgaggtcctgccatctgtgctataccttcttaagtggggtttggatgataaaatcctgatttaaacgtcagtagataagtgtattttattgatagaagatgttgaatttcttctgttcacttgcttttaaaaaagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgtgtaagtagtcatttcaggcttttgagtttcagttttaaagtttaaattaaatttttttctgcaaatgaaaaatcaagggaaaataaaattcagcatcaatgtattatgcagaaatgaaccaaaaaaaatcatttgtttgccagtaagtaggtactgagcacagaagtatcatagcttaggtctaatttgtgtgactgccaatatttgccttccttttcattattgcttcgaagttgcagtctgctatgattttagcaaatgaagcagcatttggtctgtaattccagttgttaccactgtaacttctaattcatcttaatgtggagctctttattttagtttgttcagcatgacttggaacatggaaatgtgctattattatttctaggttacttcttctaacaccattttcatctatttcaagtggttacaaataatgttaaaatataatatccttgtgttaaaaagggtattgatatgcaacaatatcatacagaaaactttctgaagtgagaagtgcctttcttgcccttttttttgggtggagggggaggacagaatctcgctctgtcacccaggctggagtgcagtggcacgatctcagctcactgcaacctctgcctcccaagttcaagcgattctcctgcctcagcctcctgagtagctgggattacagtcatgcgccactgagcccagctaattttcatatttttagtagatacggggtttcaccatgttggtcaggctggtcttgaacttccgacctcgtgatgctcccacctcggcctcccaaagtgctgggattacaggcgtgagccaccgcacccggtcgtgtctttcttgtcttgaacctgtcagactcttattaaaactttactccattcctgcttggctcaagttctgagttctctcaatagagtgtattgctttcagtacagtccaaaggaaaggatagagaattctgacagaattgcaacttcccattctttcctgtgtatttcattagggatagtgagtaactgttttaataaatctcaaagtcctggttgaaattgtcatcaaggaattgtgaaactaataaatgttatcggttgcagctattttgcacaccatgtgccatgaaatccatatgaatgaaaaataactaaaaggcaaaagtagatctttgggactataagggattagcaaagtacgcatctcaggctgtttatgcagtgttgcactgccatttaaaagacctttccaaatgtgtaaggagcaggtgactgtgcaatgccaagttgtaaccgtgtcatcttatatttggtttgttgttacccaaagccacaggggtaagcatatgtctcctgtgagatgtcctggtgagctggcatttcttgacaggttattatgatactcagttgtgacaagagaaccattttattatgtcaaaattgaacttttaagcataacatggtctttaaaacattttcaaactatatcaaaattatattaaaaagatgggtttgataaaggtctgcttatcaaattaattgacttaacatgataaaatcaacattttctttaatgcaaacgatgcagatttttaattctagttcttatggattatcaactttttgctttctttttatgtacttattaatgtacatattaatgggttacagagtgacagggattatcgtcttgatgttcaaacaaattttatcagaaatgaatttactgaattatcaccactccatgctcttggctggatttaggtgtccctttttgatttcttgaagtaactccttgttaaacaccatatccattttggctttgtacataaaatatgcatttttcctaaagaagtggttaagaagtatgagggggagaaaatagccttctaattgggtggtggaaggttaaaacttgaaagtcctattcctataaacacagctgtcagttgtgtgtacaaaacatgattaaaaatgttcaatgataaatttagtctccaccaaatgtacactttctctaggggagcagtttggaaaggaatagtcctgttatattgatgtaagcctgcgacaaaaagctgacatccgaagctgtctgttctatttttgaaacatttcaggtggttggcatatgtgcacatgggaggcagggctggccctgggttgcagcagactccatttattgtcagcctctgtgcaggataccatcactcagtatgaggagtagacccatttagttatagagtacctgagaatgtagtaaccctgtgaagtccaagcatttttaaaaagtcccaacatttaaaaacttataaaactagtagatgtaaaaggtaggaaacttggtggcaatttcctcatgcatgttctctgtaagtttatgacttccttctgattttgtgctcttgacagtaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtggtaagcaaatggaaaccaacccagttttcttggtgtaagggatagtgtgggtgggagactcagacatgtagacaccgttctcgcaagtattttgttataatagtttctacatctgaagattgtgtgcaagtctgattcatgctatagtgacagtcttttaaattctgcattatatattgaccccaccagagttttttttctcactgtttgactaataaagatatggttatacaaatttattgttatattggccataaacatgttatatatataaatgtgtgtgtgtgtgtgtgtgtatgtgcacgtgtatttcagtatttcagtaagtacactttcctggcatgcctagtggttttcaatgatgacaaaatggttttgttatgttgagtcactcaatctaattggatgctcattttaatttcattgctttagcggatttttatcattggcccagatgaacaagaatttgtaacaacacattcttcttttatctagtgtcatttttaagatgaataacattgaaattttttattgtggtaaaatatacatacagttcatcattttaaccatttttaagtgtacagtttggtggcattatgtatattcacattgctgtatagccaccaccactgtccatctccagaactttttcatcacctcaatccgaaaccttctgtattcataaaacagtaactcctcatctcttttatccccagctcctggtaaacactaattcttttttgttaaaaaaaataaatctttgttataggtagaattaccgaaaccactagtttgagaagagaactgttggtttttgcatattacactacgttctgcacattgtcacactagaaaatagaacatatatctttttttgcgttctaagtcacttttccatgtgttgtgattttctgtagaagtggaggattttcgagtatttaggaaggctagtctcccatatcaaactgagtcacggagaagctatgaatcgtatatgcagttctttcattgtccagggttatggtcgtctccactttcttgaaatagattatttatttttattatatggacctatcaggggcaaagccataccagttgtgttttgcaaaagaagtttcagaattagaagtctgggtaagagactagctcagaagacatgcttcaaatcactatatcccacatttgacagagattttgcaatttaatttttaaccattaactgcctctcctccctactccaagaacaaaagacttccatgtttctcacagtccatcagctccacctcataaacttccaagacaggaaggtgattttcacaaaaggtgtgttggcatacttcagatacttttgtcagtcacttatcttttcctttttattcattcttgaatttgcataataagcttttttaacatgtaaataagttagaccaaggaaccacaaagtaaatccaaagtaataattgtatcaagtaaatggtgaatgtgttgttcttagcaaaattttttttttttgaaaattgccttataaatttgacatgttctttattaacagtggttccataattgaaaatgcagaaaaacttggtagctttaagtagatttttcccaagtggcatacttttgtgtgaaatacttttaaaaaatatattttttaaaatctaaaagcctagagaggaaaataggggaggacattaattcattataacttgcatataataggcagtaaatattcattgagtagcagacttctgttaaacatttggcttacaagccattttacataattctcaggactaccatttgagagagtgatttttttttttttttgagggagtgatttttatacacatttgacacatgggcaaactgaggttatagaggttaagtaaaatatgcaaggccacccaactggtagtgacagatttgaacctaggtactaaatcatgctgatgcttaggtggagttaagaaaatgttaggaagtactgtcttttttgttttttcttttaaacatttttttttagtaatttttttgagacagggtctttctctgtcacccatacccgttctctgtcacccaatgcattcgcatcggtgccagcaaggctcaccgcagccttgaccttccaagcataagcaatcctcccttcccagcctcccctgaaactagaggcacacaccaccacacctggctaatttttttgtgacatcatctcactttgatgctctggctggtctcaaactcctgggctcaagtgacactcccaccttggcctcccaaagctactgggattacaggcgtgagccactgcactggaccggaagtactgtccttttgaaaaggagtcatagaaacaaaatgatagattttaaaaaattggctccttgacatttattgttacacataggaagttattgtttattcatagtttcatatgaagatgttttgagtgtgggggtatgaagaacttagaacttggtgctcgtgtactttgttataaaaggaaacatgcacaaaaaagtgggtggagcaatattgtaatgacgttaggtcacaaattcccaaattttgtcagtcatcagaattattgaagggactgaagaagttgagaatgagttgtgatcctgcctgagaaactaaagaaaacgaatgaaatgagggttaatttactcaatgcctttataattgctttgttgttcattaagtagatgcttttaccaacacacattatctattgtaggatacaaatcctgagtatttggggcttgtttttttatataaggtaggttagaagtgaatctgagttaattttgcttagtcttgtttgggtcaagcagttgcctctaggataagtggaatgtcttcgataattgggatttttctttcaccttctacaaaactcattgactcacagaagggtcaaaccttttctttggctttattggcatagcacactacccaactttgatgttcaccctgagcaaagatgctttggcagacaaagaaagaatacaagatggaaatacaggaggaggagaagaatatttccaccagcagtagtgctgatgtgacacgtgggataaatcttgactgagaattctgacacttgccctcggtcctttaagtgatctgttatgcttttaaatacatccaagtgtgtttgttttccataaaggcaatattagaagattcttcataattgcaaagacttctctgataattaaaccatgctagtgatcatgcacattatcctcaaagtactatacataatgtgtttcattttcagatgtaggttttagaagtgagtgatgcaataaactgtgtgatcatttttacaaagtcaataggttttattgaaaatactggtttctgtcagtatgtttgcttgttattacactgtgttgtaccagtcttaataattaatttgtttgtgtttttactatttaccaacaggctaatgtatttatactacatattttcttccatagaactccactttgacaattgaagaatttcattccaaactgcaagaagctactaacttcccactgagaccttttgtcatcccatttttgaaggtattgcacagttcactggtctgtaaagtattttaaaccatattgttgctaggtcataactgtgtgcttttttagtacatttaggggctctttgatttaatttaatggatgaaaactatctgaatcgattgtatttatgaccatttcctaagtagtctgaaaattacaaggagtgttttaaataattacctgaaaagaagtaaagtttgaagaagagtttagaagtctctttgaataaaggttttgttcatttttttggtcatatgagatatgttattttacattttgcttgtctttagagtgaacagaagattggttgagctttgtagttgttcaggatttttttatcctcctaattttatctttgtaacaacttaacgggaagatcagaccgtcatccttttgtgccagtgaagaagttgggagtaagtgacatgtccaaggtgtgcctggctgaggactgattgaggtgtgggattcgaaatggtttttaagtctctgctgtgagctttctgtctcctccaactgctgccacttcagtaaagcaactggaaaacaaacaaacacaaagttcacaagagaaagaaggaacatttttattcagcatagcgggtagttaattcactgatggatactaaaataactggtagttttggtagaaaagcagattactaagatcccttttacttgggtaagcatattgcttgggcatagtggattctcaataagtttatactaacagtgggcttagcagattgataaatgtgaaagtttcatttgcactcccctttgaaggtcactttcaaaatgagcactcaaggaagcctctgatttaattatttgccaaggaggatttacctttctgtctggttcctagaactttgtttgggagacaccagaaatataactgatcagatcctgtgtgaaatttcatctatttttaaaactgtatcagacacataaggttcaagtaagtatccagaagcctagaaaggtttgtctgaaatgagccccaattctgaactttctggatattagtctttcctgttgttattattaaggtgaaatgaaatattctgctttgtgagtacctacaaaccagaaattagatctgtttgtgtggaaacccagattacaattatattcttttcgttcttttctaagttgtacatttaaggttaaaggtataatgtgttagtgttttctcccaaaatggcttatactataatactatattcttatttaaaagcaaattgtttgttgaacaatttgaacaagtttgttgagactagaatctttgcctttctcagaaagcgttgttttctgtaaagatttcatcatatgaatgccatttcctgtgcaaataccactggtttctgtgctaaaaaagaaaaaaaaaaaaaagaagaagaagaaagaaaaaataggctcctttcagggtcaagttggcagccaaaaaaaatttaaaaagcttacaaggacacttccagattcttctatcactgctgcacaccatatggttaccatatcatttagttgggatcattggaatcaaagatataacttttttttctaattttagtgcttttcctcaaaggagacattaatgacaaaaaccatatggttgtgggaactcgggccttaataagtgcattcaaacactgctgtaacaatatgcattaaagtcttgttttcattaagctaatgtaacccgcagaccctctattccattttgcatttatggagaaacatttactggaaggatattagacaccattctaattacctaatctggcaccagaattagagcaaacaaaattgctttgtattaccatattttttaaattggaagaagatgtttatggaatcgctaaattaaactgagtaccacgtgtggaagcctcttgtcttgtaccatccatacgtttaaatttgaaactggaggcatgcatgtttcccattagtcactcagctgtgtggcaatgaatgtattaaacatgaggttaggagcctaccaaaacacagataagatgaattctaaagaaaacttcttcagtgaaagcagtcatagatacagcatcttttcttattagtatcttaatttttagacatcaatgaaaaagtttatgctttaaccacacccaatttctatagtctcttttgtgaaaatatatttgcttcatcctgaaactaagaaattgctatctatctataacacatagccaaataaatgtgcattttataacttctctccagaagtactatttaatgtatcttaaaaatcaactcttgtactgaatatattaaggctgtttctggatgggagccagcgaatgctttgccaaaagacatctgcacacaagatgtccagcctgtgagtcaattctcctgattatcattcaggaatttgtctctctgagctggcataactatgtttgcctgcttggttcaatattgctggcattcttaacagaaggaatatgattgttttagaaaggtctctatatgttcagatagagcctttacctgaggtcccagctgactctatttaatacagaatggcacatagtctcgtgtgtgtgtgtgtgtgtgtgtgtgtgtgtgtgtgtgtgtgagagagagagagagagagagatatgtggcacccaaataattctttttgataagaagaatgtgggagacagtattagtaaagtcaagcaacagtcttcacttcccccccgcttcctcatcgttctgaatatcatgctctgctaatagagtcctgaagatactgttttttgtctcctcatttgttactccatttcttgttctaggatttcttatctttgggatccctaaagaaccaagagcagagagctttgcagtgtattgttttggacaatttaaatcttatgcatatacagtcatgtgctacatataatgtttcagacaatgatggactgcatgtacaatggtagtcccataagattataaatcatatttttattgtgtccttttctttttctttctttcttttttttttttttttttttgaaacaaagtctcgctctgttacccaggctggagtgcagtggcacggtcatggctcattggagcctcgacctcttgggttcaaacagtcctctcactttagcctcccaatagcagggactataggcatgggccactgcatccaaccgattttgtattttttgtagagatgaggtttcaccatgttgcccaggctggtctcaaactcctgggcttaagtgacctgcctgccttgacctcctgaagtgtttttctatggtcagagatgtaaatacttgtcattgtgctatagttgcctacagtattcagtacagtacatgctgtacatgtttatagcctaggagccgtagactataccatatattctaggtgtgtagtactaggtttaagtacccgcttttgatgtttgcgtgacgaaatcatgtaacaatgcatctctcagaatgcatccccattgttaatcagtgcatgactgtacttcagaatgattttttttttttttaattagactgagtctcgctctgttgcccaggcaagtgtggtggtataatctcggctcactgcaacctccatctcctggtttcaagctattctcttgcctcagactcccacgtagctgggattacaggtgcgtgccaccacacccagctaattgtttgtgtttttagtaggaatggggtttcaccatgttggccaggctggtcttgaactcctgacctcaagtgatacacccacctcagcctctggaagtgctgggattacaggcgtgagcaagccactacacccagcccaggatgaattttaaaaactttaaaaatgttcacatagaaatgttatttttgctttattattttatgacacaaggtatctaagctctctctttactgaggacaaaaaatagtttaaaaaatatatacaatatattacccacatgttcatctttactaattacaaagagtttaattttagcattgttatcctgtaggaagtcatttccattgttacagtgtatggcatgcatttatctttagcaaatatcctagtattttatatcttgtgtagaaatatgctttggtgtgattatgagatggtttcttgattaatactcttagaaaactgacttgagggcggttggtgggtgaggggagagaaagcattaggacaaatagctaacatatatggggcttaaaacctagataatgggttgataggtgcaacaaacgaccatggcacacatctacttatgtaacaaacctccacactctgcacctgtatcctggaactcacaaaaaaaaaaaaaagttaaaaggagttcttcagagtaaaggaaaatgatataggccagaaacttggctctacataaagaaataaagagcactgaaggaaaaaaaaaatgaatttgaggtacaagtagccagccgtagttcctgtccatgattctctagaaggctattttttaaggctgttgggcccaaaaattgaggcagctgggacctctcctgtattcagaaatgcttttctacctgatgggttaatcggtgtacatggcacctggttcctacaaatgaaatcttcaagttgcaaagagatttatgtgattgatctttcctggaattaagtgtgattggggatgagtgctgttcactcttcccagtatcttctcctttcctctcccttactgcccctccccaaacaataataaaaataagagaaagagaaggcaatgacaatctggatttataatgtcaaagtaagttcagagtaaaatgccttcttaggttttcattttaatgcctttactatgtgtgaaattgcctctttctctcttattacatttgaaattgccagaattaccgatcagcctatcaaccagcccgttctttattcaaggtgctgacctagctgaggaggaagagtgaccagtatacaggatttcttctaacattagaagaaatatgtgtgtgtgtgtgtgtgtgtgtgtgtgtgtgtgtgtgtgtattcattccttagaataagactgatacaaagaaggcagtttacttttgtagactactagaatatactgctttatgcattaattccatctgggatatgtgactgtacccaggccattacttaactattgtctgaacttgatgactatggaaaataatctctatgttcatgtctatatttttaagtgtattttcattaagttagtacttgacaaaagatattttctgggattagcctgcttgacctttgtgagtcaccagatacaaaattgagtgtgtcagggaaactattctgaaattaattggactgtgtatatattttttataccctctatcttccctgtggagaacaaaagttcttatgattggagctaggttctcacataccgtagaacatacattcaagtataaagggaccctaaaaataatgtgccacttgcaatgttatcagtgaagaaataaaagagaggtaaagtgatgtacaagggtcagtcacctcacacttagggcaatctgcgcacatggtagcccagtgctgagaattgtgcctgtggttccagcccatggcatgcatttgacctttgatgtagctgcattgcatactcttctccagtgttcgaaaagcagagtaagtcaacaggacagaagaaaactttcagtccgtcctctcattcctgtcattcccttgcaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacaggtgagagggaggaggagcctggatgaaccatgacctttttcccatacctgtggcatgaggaaacatttcatgtcacaattaaaccgctggcctatgtcattcttgcacaatagcaataagccattgtggccatcttgagaatctggctctggcctgggattttacagagttttgaatctctggcctgggacagtttggcttttgtgtaggttaatcttttctgcttgtagtattaaagcgaaatggtgaagacgaatgatttttctgatttgccaagtaccactgatggctcttagatgcacatcaatattaaaattctcattcattatgtaatttaacccaaccacatattttacttcaatattctgaaattggctgttcctagtttccttaaaatgtgatggtttggaagcttgtctgtatgtatttcttaacacagtacagtagttatttgttttggtttgtatatgaactaagagaaaacttctgggacactagatgaactgagtgaagataagagttatacagtagagacaatagatggtatttttgctgaaaattttacttgttagatactgttctatcagatactgtgctctcataactaagaattctaagaaatgtaaaataaaaccacttctccattaaaccctacagagtaattgttgaataaagcatacacatgaaatttcccatttaccgtagtaaaataatttttatgaatacctcatcctcatctataattatcttctgatataggaatgcaaagtcttattagcatcattttgcatagtgtttttgaaatatggagaattttacaatgaaactatattcaaaaacttatttagcatatactttgctttctttctctgcttatctgttctcttttgctgcatttcatcaggcatgggtataacagcctttgagaggttaacaccctgacacagttatgttccacattcataggagcttaagatctttggagctgctcagagacatctatttgtgactgacttagctatccttaaatgtattagctgctttgcaaatcagaatgttatttaaaagccagccagtttacatactgttattacataatcctctgttaagcagtttttatgctacaatctctgtaattttgttccccttgacatagaacctcttaatagtttaaaattcctaaagcaaacagttaaatattagtccccttttgacgtattgtaggcctaccttcatatatgacctacaaacagagctactttcttattcttgcaaatcatattttgttggtcacatttaagagtaaaatagagcacttagtgctttagcttttaaagggaactgcttaatcctgatgcctgagtggcatgtccacatgatgctgaaaaccaagaggtggctcaacaataggtgatttacatgtgcattcctgtttgacctgaactgatttaccctgcagaaaatgagtatgacatacagatactgagatgttttagctccatggtaaaagaatgaaggagagactcgatggaaaattggaagaaggaaatttatttagggttgttggggtggaggagagtgtaacagggaaagatttagatagctaagataaatgtagagatgatcctgcaggcaaaattgaaaatggacacaacttactctggcattctgaactgctaaataaccataacagggaatatgaaaatctgtttcattcatttctctgtatttccagctattttcccaccagctctttcccagtatttcatatttgaatgtattgtgacttttgactatccttgcacagtcttaaggtaagtgctgggcagtatgttaacactgatatgaaaacttcatcttaaattccacagaggctcagcattcttgttttgatgctctgtcgctgtgcatgcatcagtgtatgcattcagtcaggtagaactctcctaaaaagagtctttggtctgattttccctttggtttttcatggatggttgccagagtcagagttcacatggttaatctttggatggaacattctttatcaaatggggcactgaaatatacattatatctcaaagatggcaaatgggtttccttagagttaggaggaagggtaatgagaatatgttgtgtaaatacatttgtatcttgtgggaatttgatcagagccaagaaaatatgggcctctacagtattttttctttttgcatatattttctgcatcttgtttgcatatgcattttcctcttctctggttatttatctgtatatccagatctactatatgaaattttatagagtatggagctgtctgacagcagagctttttttgttttactgaatgttttgttggtgcatatggtctgacatggatgagcagccacggtgagattttggagtctattaaactggctcattaaaaagatcaatctgtttctgtaataacactgggagccatcagtcactaaaagagggaaaaactgacacctgaggagaaaacacattttggtaatttgttcatgacatgtcatgaacaaaagagcgctctatattttgtttacaactttgggagcttaaattctgtgacgattgctgagttaatgtactaaacagtcatcatgtgtttcagggatgggttttggcaaatttaactttcttcttgtccttaaatatgattgtcactggttatgttttttttctttaaacattattgttatttacagagaaatgagtactctagggaagtctatgaaattgttttttgttttttgttttttgttcctgtatggaacagtgaaatgttttctactttcttttaaatgtagctctggggagtgtctctgaacaagtgttactgattttgtaggtctgtgagagaatattgtagaacccaaagtagaaaaagataatttttattataaaattatgttatttctttcctaaaatattagggaaagtaagtagaaaattctgatttctattctttgttaatatgtaaacgtcatttatagtaaacatttattcttttaccattctgtggtgggagatgctgaagaaaggaatgtgatcgtttgttttggagccatgtaaacgaaatgaacactcttacagatagagagtagaagctaagagccctctttaaaactgctcaccgtggtgactcgtaaagacacaagcacttttgtgtaggaggagggaaaagaactgttagataatgctttctttctttgagactgcagaatggattaaaattattaagatttaaagaaaataattgtgttaggatgattatcattgctgtctttcttttctcagagctttgatatcacagcttttcgatctaatttgccttcagtattgtgttctcacctgttatgctacttttctggtttaggatttttcttgcttaagaaatcaaaccaaataatctttgcttttgtgtgggtaacatggttgttttgtttcccattttgtaccccctactatctcaaatgatggatgttaagtatgaatccccttcttatatgccattattttaatgtaattatgctttacattactctcagtttaacgcttctaaactttcaatgcaaaggccatgtagttggattaatatgtatttcctcctcccccaagggttaaacattattctctaaaaataattggttgaactttagagttatgtaatttgtcagctgggagggatcttatagatacaccaggccccattctttttatgttttttttccttaggcatggtctgcaatgttgcccaagctggtctcaaactcctgggctcatgtgatcctcccaccttggcctcccaaagtgttgagattataggcatgagccaccacaccctgcctttttacatttcataccaaaacaaaaaaatcacacatattttaaatttatggatttgctcatgggatgttatctgtatttttttttttaagacagtgtctcgctatgttgcccaggctggtcttaaactcctgggcccatgtgaacctgctgcctcaggctcctgagtagctaggactacaggtatgcaccaccacacccagctggcccccatctttttattcttgcacaaactaaggcccaaataaattgcctaatgttgcaaagcttcttagtggagaaacaagcatatttgcatacttgaaatcttccagttgcataaaatatgttttaatgtgcagaatttaaataaggaaactcaactaagacttaagcttctcttttttcaccttactttccctcatttattttctatagttgctcaagtgggtagatgccatagtataacattctgaggttttatatatatttttaacgacagaagagccacagctagcctgtgttcctggcttaatgagtcagttagaaaatgctgaaggttggaggatcaaaggcaatcattttaaaatcatgttggttgtatttgtgagatttgttatgacagtacacaccaactaaactgaataggtccatttttttgtttctgtaaaatgaaagagatttcactatttttatctttctaaaagaaaaaatagatacactttacaaggaattgtagggtcagttgtgcaaataagaattaaatttgtataacctgcattcggttttctatgaaaaaaatgtagggattttatgacacatttatttattctagtttgtgttgcatctattatgtattccacagttgcaaggagtgatttttaaaaatattaatcacatcaattgggaggcctttcagtgaaatagcacaaaattacatttatttatttttatttatttattttttttgagatgaagtttcacccttgttgcccaggctggagtgactgatctgggctcactgcaacctccacctcctgggttcaagcaattctcctgtctcagcctcccaagtagagaggtatcagatgcctgccaccatgcccggctaattttttgtatttttaccagagacggggtttcaccatattggccaggccggtctcaaactcctgacctcaggtgatccacccatctcggcctcccaaagtgctgggattacaggcatgagccactgtaccgagccacaaaattacatttatatgttaaagataacacagttgtacggggcattttgttctctccacattccagcttcaactttaacttgttagcctgatttcttgctgctttgttagggtctaactttactgcatactcctcacgccttagtctctattccagctgatggtttctgctgtctttcctaattcttatatgccataattctattaatacctcatggcctaactcagtatctactatttgaatgaaagcttcccaattataaataatataataatggttactatttactgaacacttcagatatgctgggccctgtgctaaataattgacagactaacatatagcacttctttcctcactatcctatgacatagattccagaaggccaaataatgtgtgtgaagtcacatggcttgtcagaagccctaatgggattctaaccctgggttctcagactcaaatgcccatgctctcatagccgtgattctgtatcatcagcctctgaatgcccctgcttgaaaacaaaatgctttgattaacttattgaatgccaaattcatgttaggttcttttcttagattctttcctatagttctctccatagctttgagataatcatttcccattttgcaggcagaaacactgaggctcttagaggattaagcctcttgagtttatatggccagcaaatagcagagccacaatttgaagccatctctatgtgactccaaaacctctgtccttatgagtacacattctggagtaatctctcattctgctctcacataccacatttgttctgtttttaatggtaccttctgtatacatgtcctgtatgaaagtatagaagtcttgtagctccaattaaatcattttaatggtaaagaattaaagtctgccctaaataataatcttatggaaggttgagggaccatgtttctctcatctttgtactgccactgaagtgcaggatagtgcattacacatactggggacctaaaacaaagcaaaacactacaaacagaacaaaaaccactattgaacaaataattcaaattaaacttaatgcagtcatttttagtagtgtattaaatggtctctcttccaggcatctttatttttttgtttagttaaaaaatgcatctctgaaatacaataaaaacagccacagacagcccaggaaccaaatgctgtgattggttcactgaccagaaaaaactggagggctccaatagaaacatacaggtgacagattcgaataagaaagcagagttccaaacagcaggagcagcaaaaattgaatgcttcagcagtggcagagattagaaaaggcaagggaaacagccagtaacagcctaactgttgagcagatggtcagcttcagacacgtgacggaagcattccaccttctcgctgctggagggaaggctcagatggctcccccaacctgcatattgcaatccttgaaggtctgggcatcacgtttgtgtgtctggagtggcacgtatccatctgcctcttacttacttctaaaggtattagcacactgctcagaaagttctcactgctaggtggttgtttagcaatggagagattaaaggtgcttctctccacctggcccaataatgatggtcctgtggcattcagctctctgttcttcatcatctaaatgtccccctccctctagagtgatagcaaaacagagaaaccactgcaggttgtcatgaagaattaggtttgattttctttttaaggacgctggggaatttgtaatgtattttgtttcaataccttattcaataccaataaaagtgtgttacgtgaaattcatatctaaagtcacctctttcctaacaattcctgaagagatcttttgctgaattatgttttaaaaataatgatgatgagagtgattttcccccccttgattcaatgtctagtcattctatggcaatcttaacaaactgcacgtgttagaaaaggaaaggaagatgtgtttgatgttattaatgtctttggtctgcgtttaatagaactaccttcctaagatttagatacagacttctaaaatataagaataaaataaagtaagtctccagacttctaaaatataagaataaaataaagtaagtcttcaatgcctggtcttaaaagaattttagacccagtgtctcactcttactcatttttcaaggagctacagtctagggatgggacttggctgggctgtggagacaaacagcaaacaaatctgggggcctgtggctctgggggatactggcaaagtgggaccatggtgtgacaagggccaagataaaggtatcctggggcaagaaggagggacccgtatagagatgcttgagatcagcaataggacttggatttggaaaagaaagttgtagagtgacttcaagtttctactcgggtgactaggtagaagatggtacagaaagcaaaagagaaatgaggccagtttggacttgtgaaatgtctgtcgaaactcagataagtgagtgtgtaaggcacataatttatttaaataaataaatgacaggatgaatattagaaattaagtttcttctttcttaggtttattgtgctctaccaatttgccttcccctaaaacaatatttatagtggtagttcctcacattaaaaaaaatgttaatgtagagaaaaaaacttacacccgcttctgccatgtagatttgtcctcttgttctacttatgtcatgattttatgatggattttttcatacttccccgtttccttgaatgttatacactgttttatataaatgttactaaagggattaccagcacacactagctaatcatcatcttaaaaatatttcatgtagagtttttgtttttatttatttttattttttccttgagatggagtctcgctctgtcacctaggctggagtgcagtggcgcgatcttggttcgttgcaacctctgtgcctcaggttcaagtgattcttctgcttcagccttcagagtagctgggactacaggcatgctccaccatgcctggctaattttttttttttttttcttagtagagacggggtttcaccatgtcggccaggctggtctcaagctcctgacctcaagtgatccacctacctcaccctcccaaagtgctgagattacaggcatgagccactgcgtccagcctcatgtagtttttaaaggacatttattttcttttcctaatagtttacagtttctgttattgaggagctggaaaaaaaaaaagagcctgagatagggtaaagtataaattaggttgtctcttaatttgttagtcccatttcactgagcagaatactgaagccagaaagttaagtaactggagatcacacggctgagtcctaaggatcccctgagcttagaacattaaacctcgagagagaagtgattgggatctaaatgttgaagtggttagattgtgttgaggaaaatgtctcctggtaaggagatataacatcctcaggtagacttaaaaaacaaataagccgggcgctgtggctcacgcctgtaatcccagcactttgggaggccgaggcgggcggatcgcgaggtcaggatatcgagaccatcctggctaacagggtgaaaccccgtctctactaaaaatacaaaaaattagccaggcgtggtggcgggcgcctgtagtcccagctactcaggaggctgaggcaggagaatggtgtgaacccaggaggtggagcttgcagtgagccaagattgcaccactgcactccaggctgggcgacagagcgagactctgtctcaaaaaaagtaaaaataaaaataaaaaaaataaaaaacaaataaaataaaactttcagaaatccttaagacataatacagttacctctcacttcagatttctactagaatttgagttatttcaagggtatactggtatgggacaatgaaaagtctttgctaattttgcctgatacactgaaaagggcaatgaagaatgcaaatatggagttcaaccgagcaaatgagatataggtagttgtaggcatttctaagaagcagacagacaaatggcaattaattgtttgagttacccttctgaacatacatgctttgaatagaactggccttgtaagtagacattagtaatttgaggaagcaccagagagatccttcatagctttatttttgtggacagtgaaagtttttgtgttttctttttttccccttttttttgagacagggtctcactctgttgctcaggctggagtgcagtggtgtgatcatggctcactgcagcctcaatctcttgggctcaagtgatcctcctgccccagcttctggagtagttagaactatgggtgtatgtcaccatgtccagccaactttttgatttttgtagagacagggtctcactgtgttgcccaggctggtcttaaactcctgggctcaaacagtccttcctcctgagccttccaaagtgccaggactacaggtattagtcactacacccctgcaagtgttaatgtttcacaactgttagaatgtaaactatccttatgaggtgatgagcttttattatttcagtagctagcagggtgatgggccccaggataggacagtaagacctgattgaagtgagagaacagactcaggccctagcctgccttttaggacattactgcccttgctttagaaaaaaaatgctttttacctcccatttaattgggtcattgaagtaatagcactgaacaaagggtttatctaaggatgaagataaattgtgtatctaaccatttaagaattattaaaattactccagtgttgttgtttttgccttcattgatcaaggagagagaaaactagtaagttggggtggtttgacccaaatcagtcaaagatgtttcattatttagaaattctgcaggggctgccctaagataagaggatattttctaatttttgcacaaaaaataaggtataaataataaattgttcaaaccaaggaatggagaacttggctaaggtggttgccttagatacttatggtttggccagaggactatcagcactgtgtgttttgatctgcataactatggcatttagttgtaaatatagaatacttgaattgcagagtttgcaaactagaagggactgcagaaatcatctagtccagtggttttcaaacttgattttagccgcagactttttcctttaaaaatgaaatcttaggtggaaccccagtgattgaaacaaataataagaagtgggttcctctggcactttaaatcttgagaatcttgattgttttggggaaaagttcttcattgcctaccttcagcacctcaggtggcacagtttgaaaaccactgatctagtccaaccctttcattttacagatgaataaactgaggtccagagaggttaagtgacttgaccaaggtcacacagctagtcatggaagagccaggactagatctcaggtctcttgattcccagtccagtgctctttccactacaccacaatgccagtaaggtaggtgctgtgttagcattacgttcatagccactaatagtcttcagtattttccagctgatttatgctgataatatgcattgaatattgaagtgtattttttagaaatttgtgggatatgcaaatacagattagaatcacatgggtatattcttagatgataaatcagtatctagaatgtttcagtttacttttaaaaattattttaaagcaatgcaattaggtaatgtctgagctacattggatattttagtctgatatcagtgatcaatatgtaaggagtcagtatgttttagtgtagacacatactttgaagggagcagcattaggactcctggccaccactcccttgggggccatgctttgccatcatttccaatattggccagtctattcagaatagtgcatccctcttagtatgtagtgggcatgttcttcaacattaagctctgcagatttaccctcagtttttttgttgttgttgttgttgttttaagaaagagttttgagtttgttgcccaggctgtagtgcagtggcacaatctcggctcactgcatcttccgcctctggggttcaagtgattctcctgcctcagcctcccgagcaactgagactacaggcatgcaccactacacccggctactttttgtatatttagtagaggcgaggtttcacagtgttggccaggctagtctcgaattcctgacctcaggtgatcctcccgcctcggcctcgcaaagtgctgggattacaggtgtgagtcactgcacctggcctcatgtagagtttttaaaggacatttattttctttctgtaatagtttacagcttctgttattgaggagctggggggaaaaaagcctgagatagggtaaagtataaattagattgcctcttaatttgtttttacaaatgttgtttcctatcagtcccattttactgagcagaatattgaagccagaaagttaagtaactggaggtcacacggctgagtcctaagggtcccctgcccgctccataatagtgcatccttcttagtatgtagtgggcatgttctttaacataaaactctgaagatttaccctcagttctttctatgcctataccttctgtctctaagtcctttattcttctcaacctggtgtgtatgaattgtcactggggcgcccaccctaaagggccataaaggatggttcattgtagaatcctgttgcccctgattatctctgttgttgattcagtttccacctgaattgctctagtgttatcagacaaagactggatgccatcactagatgccgggaaagtagaagaagtgcctctatgctgttgttttactatctaaaataaagaaggcatgtagatgtctgcagccactgtgaactggtagaattcttatgagaaaacgtccctgggaaaatagatgttaccacctgtctaaagataagagtgctggtcttgtaagtaaaaagtaagtttgggagcagtgattagtcaaatttgaatatggtttgtttctatcttattgaatatattaggggctagtctctatgcagtagaaatatatacagccagaaattactgctttactcctacttttatttgagaatcaaggaatcgtgactagttatcaggtcttatttatagaatgcattccttctgaaagccaagtttagagttctgtgcatcacctgatggtgtgtcgtcagggtgttcccgtcctgccatgtgacctgataaccccagacaggatacattagctctctgggtatgtgtttcctcaactttaaaataagggggttgacctagatcttccttctaggccaggctagctctgtatgactgctgattgattaccttggtgactcaagataatgtcagggtcccagacattgcattgcatacggtatttgctcagtttgatccttactttcctatagaactttctgtgatgatggaaatgttatgtatctgtgcagtccactactgaagccactggccaagcgtacctgttgagcacatgaaatgtggctagtgatactgaagaactgaattttaagctttatttaattttaagtaacttacattttaagttaaacaaccacatgtagctactgtattggacaacacagttcttagatattctctgacacagaagtcagataccaagtggaataggtgtaccttaagtgttcatcaagagagtagtgatgttttaccttgatgaatcttcatcaaatacagtcggtcttagggtaacttgttagaaatcaagcactgttttttgaatgaaaatgttatctacaggagtcttgagtttcctcttgtttgtgacttaaccacatgagcttcaactgaaaagatatttgctaatttgatgagaagtgaaggattttttcctgtctgcaggcttgtgatcatttaggtctcgacacaggtctcagtgaattcccgtatgttttctgggaagctgagtttagaaggtttctggccaataaaaaatattctgtttttattccaagctcaaatatgagtgactgaactgtgctggtttctgaatagatgatgaaacaaactcttgttttttccccctttagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatgggtaagactgaaggacctgttcacttcttacgggattgggtgcttgaagacttgcaccattatttctgaacttaacttgaggcttgaaatctgtgatagggatgaagattctcatatcttgctttatattgtctcctttatgaaaaaaacttgattggtattaatagacttttaacagctgtactttctctctcctaatcacttgtattctttaagacagtacactaaatttctttggaggagggcatctagattaatacaagaccctcaattgttgtgttggtaacaaatgcaaaataaatttttagcttgaattctctttcaacatgagacttcatatgcagtctgcctgccacaaatatttttaaaaatcacttgattttcttgtgttgtatcttttgtttcagatagtctctacgtttattttgatttttttgagcctccatgatattccatatttccaaagtgtgatatggcatgctatctgtggcttaacagatgtttcccaaggaatgatttggtacttttttttacttgaaaatgccagtgattaaagttaatattgacagttttgggtcaaggatcagaatactgaagaagaagtgaatttgggcaaatatgtgttctatttccctgtgttcattccttctttgcataaaactattagaagtaaagcattttgtctgggtgcagtggctcacacctataatcccagcactttgggaggctgacacagatagatgagtttgagctcagaagtttgagaccagcctgggcattatggcaaaatcccgtctctactaaaagtacaaaaattagccgggcatggtggtgcatgcctctagccccagctacctgtggggctgaggcaggaggatcgcttgagcccaggaagcagaggttacagttagatgagatcatgccactgcaccccacacactgcacctcagcctgggtggcagagcaagaccctgtctcagaaaaaaaaaaaaaaagtagtaaagcattttgaagacattgccttctatagaacaaatgtctaccatgaaaaatgagagagaagatgaacaaggtaagtttttaaacatatgatcagtggttcagtggtggagatgatagtgtatcagagggttatcagtaagtacactgttactgggatgtcttcaattcctaattagtgatgagtctcactgagagcaatagtcagtctcctcttctttttccatctcctgtgtccacatcacccactaacaggacttaatctctaccttgtaactaattgctggcaaactttcctgatgagggcgacttagtgacctggacactggaaagagcaagggatgaaatgcaagtagaaaaccagaaagtggagctgaggatacagaattctggggaatgcagccagccagatattcactacttgattacagtgatggtggttgtttttttgtttgtttttttgtttttttgccacaggcagagagagcctaatatatagaagtttacattcaatttccaactacattgctagcaaacaggggctccacgtgtagggccttttttacctttctacacccaactccccaaatgtttagaaagcagaaagagagtcagggtgagaggaggggtgattgaggctttggttgtaagacagtaaattagtagttctggttctccacaacagtaatttctacgtttatatagtgtgtcagacaaatggctatgcatataatttgtgctttcttaatagccagtctgtctaatgttctcgcaggtaccatttctgaagagctttcaaaggtggttatgctatttcttgatctggattgatattttaaccccaaaatcaaatgtgataacaactcccttctacacaaagccttaccacttatttatgacttaaggactgaaaaccatgattgcatgtttttaaatagcagtggagtcttcaggtcacggtgagaccagttcaagggatcccattttgtagatgtgttagcaaatggcctgtttcttaggcagcaggtgctattttgtgaaatattagttccagtgcactatacagtaatcagcaaggaagtaattacacttatgtgcaatgattatgttttcatcaagtaatataaaatatccctttatgaattatatctgtatccattggttttatgtgattttcttcagaccatgttccttaccttttaattatattagcttataaaaccaatagtgctaatctctataaatatgtgcagctactaaaccatccctaaagtctggcagagtttagtgtgtgttaatgtaaaataaaatcttgatgtatgagcaacaaattatggtgttacatcaggctgccattttgagaatataaaaattgtcataaagatatacttagtctggtacgatttataaatgcctattatgtgtagggacatatactcacgagaatccttcagtaaagtaacttcttagcagcattagtttataagtaagcttagagttttatcctagttagttaaaatattctaaaacaaaataatcagttgagactcaacattagtgtcaaatttcccacaaatgaaaatgtgattatgagctatttaatgattatgagatatttcccccggtacatccctctggtattatgactataaataaaaattgtgtgctgctgaatatttaagtatcttaaatagagaaattaataaacataaaatcttgatttattttttatttttaaagatttgattatatctaacaaatgactttcaaagttcaaaagcggcaaatgaatcttacattttttcaccaagtacttgagctcaaacatgtttctaatgcacttaatatttttttaaaaatgagatgaagcttagtactgtttcacaaatgctgaaatcccaccaccacagatatcctgttgctcattaatattactccaggcattacagcttgtgtcattattgatttcttctgctgaatttttcaagcttttgagacctctggaattcttgtccttaaaggcaaatattcagatgcctctaacatgaaagtcactgtcacatttatatccttatcactttctggttgttttgtatggtgactaattttaacagtagtggtttttctctaaaacccaggcaacaaataagttaacaaaaattacatatttgcaaacatttcaacttgaaataatcacaacagagcagtagctaaatactattctttcccaatgtctttatattatgcaaattaataaaacatatttgcacttttacttttttaccaataggtggcattgacaattttaacttttaaaatatatctcagaatatgttctaattggacaggaatggtacaaagcatcttatatttagctttttatttagtctgagaaggggctatcataaatttgttcacttccatcagttgtaaatgaaatcgttttatgtggttggctgaacagtcatgtgactcatctttatttgtgtaaatcagctaaaaaaagggatttataaccacttaaatctcacaaaaagtaaaattcagtgtcttataactcctatggtcatttaattcttacataagttccacagagagatagctcagttatctagaaacccaaactataagaaactttatacataagttccacgagaggaagcccagttatctagaaaccaaactataagaaactctatttgctgttcagagtaacattttgaaaattggtaaccaaaaataatagttttgatcatttaaaatgcaaaataatgccacagcccaggggcttttcctatacagtagaatataaagtgaatatgtaagaggaataacacgtttccagatttctctgttcggagcctttcagcctctctttttagtgagacacatttacttcctattttaatgagcatcctagctaaccgcttaattaatattggtgctcacttggtaaacacttatgtattactttttcatggacttcaaattaggattttcagttggttcacttggatttatgatatttgtcaaattatatctggtatattaatttttttttgaagaatatccaatttacttttattttttaatttttggtaaactgaatgagtatatgtagctccatattatacaagccttttcttcatggtctaattttatcacggaggtatatgtattaggattgtattcatttacacaaggctgacatgtagaaaaatttaccatgcttgttttgggaaagcataacccttcctatgtaaaatgacttatgctgtctttatttttaatgcaggacagcaatgctttaaaaaccacttaatgtctacttgtggtttcttgtatttattaagagttagaatatatttttacttacagagtgttgcatggataactagttgtggagttggtgtcacttaactgtctccttatgtgtaaaataaaggcttctgaccaggtgacctctaaaattccttctagttctagtattttatcattctatgaggaatctgttaggtaattctgaatctaaatatgactcatgtctccatccaaaatcaaacgtatttttacatcgagtttgcccacatagtccttgctatgagtctgtgtgtttatgggttgtgtactgaatgctttagggttattcagccttctctatttttgtagggttgcatggcacacgtcaagaagaaatgattgatcacagactaacagacagagaatgggcagaagagtggaaacatcttgaccatgtaagacatcagtaatcatttgggattaaaaaatgtttggaaaacaactggagtgaggttatgtgataaaataaaagcttggtgatcctttgaaggcattgtttttcctgctatccttgaaaaaaaaatgagcgagaatatctgaagtagaatataggatttgatttctaaattgatatgaaagtcacttgagagaaatgtttagatcttggaaaggaattctcaaagccagatcggtgggctactgttctattgtgaaaaggtcatttaatttataaagtaatgggattagtatttggagaggtggatttactggctataatgccttcaggtgaaatttcccttctgactcgtgttcataacacttatcttctcattcccattgaattttccatctattggctctgaatttcaaatctagtcatagaaaatactagactgaaaccttcagggataaaattgcttccttcattgtcctgaaatggtttgtttcactactcagcaaaatctttaattgtgatgatttatatgctcttccctattctcccctttcccaaatagctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactaggtaacttttcttcagatgagtatctcgaaaacacatatttcttatgctgttaatgctgacttcatttttatttttaaaattaaaggatatgcaaggaattttaagacaataaacaatttacatatcctccaatatgtcttgtctatctgttaggaatttgggcagattggcatagacagagatagccacaaaacttaaattccttttccaggtgagtgtattgagctgatggcagcgtttcagcactgaaccagattttcatgtgcataactaaaacttgtgctccttcgtaatgcctcaaaacagcaaaaacaatctcagggagtgggcctggggcttaggcacttccgtcaaggtctctagtgaattctgccactgcataccaatgttatcactgcacatggggatgtatgtttcaaattattaattcagaaaacagcctgtaagacaatcttgttagttgaatcatatatatatatatttatattttaaacttttttctcaaccccccgcctccaggaagagagacctagaagctatatattttgcctacagctattttaaaattaatgataaagatgtagcacccttcctgtgatttgatcttaacttagattacttaatcatgattatattaattctagttttatctagttttataataggactcataatatagttgtgccttagaaatggaatgttagtatgtaactatttcttattgatatttgggaattgttggggttacagatagaatataatcccatatatgttgaaagaaatcttcaacctgaaagaatttttgtgtggcctgtgaacttttacctaaattaataatacggttttgtcattgacattgccacccattacgtgtgaatactttttgagtaaacttacgaaggtggatttctgtggattcttgttctctcatattatcttatgcgttggccccatacccatctgctaactcaagttactgtccatgctgcaaaacgtgcagattaagttcataattttggcctcattagtaccatggctgattatccaaagtttaaaacttgaagtatattatctgttgatcacattactgttttcaatttgttcccagccagtgtagtttcctatgcacttaggtttgtagatttctgctgatctctgaatgccgaatgcctattatcataagtattaaataatgaaagagtctaaggcagttaatttacctaacaagcattattctgaagcatattttaaaaacaaaattgtatttgtcaggtcacattaaggcaagcaacgaaaacagaattacgtttggtttgagccaatattggtcgaagccaaactatttagagcagagtggaaaaaaaaatcttgtgtttatttccttattatgaacaaaaattgattaatcatcagagatttgcttaggacagaggggatatttataaccgtccagtctaggcaaaaattgagagctttaaagtaaataaaacttagggagttaaaacatctagtttggcttattctattgaacacattcattgagtcagtacttatttattgagcacttactatgtgccaggcaatgtgctaggcattctaatgaaggaaaaagtcttcatttctttctttgagggcctttgggtctagtggaagaaggcaagggaatagctagtgttcaagccataggatagctacctcaattcagtcggccaaactgaccagattgctattatctgccatccactataaaagaaacatctccgaaattgatcagacttcatacctaagcgagttatcagcacatagaacaagggccattttgtgtatagtcactactactacacacagattctggtgatataggtatatatcatgttctccaggaagagaggttcattgtccctgctacataaccaaaagaataaacttggtttaaaaaaactcctttttaaaagtatacaaactatactattttttagtgatgttcaatggatttatatttttgttaaacctgagatatttgtttggccttaagcttttgtaggttgtattagtcaaagggtacaagcatttaatttctttgtttatagacaacattaagacattatgttctttattgtcacagaatcctaagttgccattaagacactatcataactttagagaaaatctgtgtagaactctgcagtgtgcaagttttagcatccagtagtgcttttacagttttttttcactgtgcatccttactagctgattcttgcagccttgtgtactattttctgggactgagctatggctgtaaataagaggacaggtggtttgtaattatgggccacaatcatttacattaagtgctttctaagtccctcttccaggctttggagttgaatggattgatgtgtgtaatgaaaggattggagattattggctgataaatctattttctgtgactgggaagtgtttaatggagtgcatgtgcgcagataaagatatggatatgtctatatctttatatacatttagatctccgtatcccacagttgtatgtatttcttttagcctaattattttgcttcttaaactactgtctggtctcaaatgagatcttcagaatatattatagaagatatctttggttcaaaatattgccctacttatatccctaacttggaaacactgggaacgtttagtcatacacacattcttagcattttaaaattatatttggggactgcacaggggagaatgtaactttcatgattgatgtgttgtacctgttaaactcaatcccattctcacttttgaaatatatctgtagtattgagtgagtatagggggttagtaaaataactcgattaatctattactaattgaattttaagagttttcctggctgggcacagtggctcacacctgtaatccaagcactttgggaggccgaggcagacggatcacgaggtcgggggttggagaccagcctggccaacatggtgaaaccccttctctactaaagatacaaaaaaaaaaaattagccaggcatggtggcgcatgcctgtaatcccagctactcgggaggctgaggcaggagagtcacctgaacctgggaggcagaggttgcagtgagccgagatcacgccattgcactcgagcctagacgacagggcaagactctgtctccaaaaaaaaaaaaaaaaaaaaaaaaagtattttcctaagatattaaaatctcttttttgaataacctctgactgaaacaatttttaacactgagtatacactgaattcataatggtatttctattctttaaataaaatgcaagttgacatcttgaaggacttttcataaaatagattttcttgaaataatagatatttatcgtttttactgttgttactcatttactttccagggaaaactccaagtatccaactcttaacaaaattagaaagcaaattttaacactgctgtctctattttcaaagtatgacttatttatacatttaagttttattacatggtatgctccacagaagagcaagataatgtgatcagaattgacagatttgaccattgaagtagaattacttttatatgtatagaaaggcagttgctggttagcactttgtatgttttccgaagtgcttgtcagaatctccttagtagctctttttcctttctttgtctttggttcctttttctctcagaatgttgtcacatcactttcttggctcctgacattttatttcttttaaactactttcctttttactggcttttgactattctagaatctttctgtagtttgtcttgtatctgtgtgcgctctttttgttttctagaagtcttccacatcgttagggttaattttttttttttttttttttgagacagggtctcactttgttgctcagggtggagtgtggtggcataatctcggctcactgcagccttgaccttctgggctcccacctcagccccctaagtaattgggactacaggtagaccaccaccacacccagctaatttttttgtattttttgtaggagtggggttttgccgtattgcccagtctggttttgaactcctgagctcaagggatctgcctacctcggcctcccaaagtgctaggattacaggcgtgatccactgtacctggccaaaatttttttctaatgataggtttagggctaatgtcaggggctggacataaactctgaaatataaatgcactttccctgtgcttttaaaacatgtatgaacattgtgatgacatggtagtaaatttagaaaaataccttcactctgttttgttaagagtttagtatttgccagagaaagaaatatcaaaaagttttgtttgtttaagtgtaatgaaaaatcaagcttagcatttataagaaacttagagccaggagtgttggctgacgcctgtaatcccagcacttggggaggccgaggcgggcagatcatgaggtcaggatatcgagatcatcctggctaacacggtgaaaccccgtctatgctaaaaataaaaaaaattagccagataatggtggtgcacccctgtagtcccagctactcgggaggctgaggccggagtattgcttgaaccctggaggaggaggttgcagtgagccaagattgtgccactgtactccagcctggaggacagagcgagactgcctcaaaaaaaaaaaaaaaaaaaaaaaaaaaaaggcttagtaacttaggagtttgttgaattaataccatcccctgtcccaagtgggttggtagaggaattagtattttaaaatactgctagctggcaagttttatgattgtcatatgattgaattatggaatttctcattgctctctaaatccccgggaaatctagcatgaagactgaaagcacaaactcagtcagtagaatttctagattcgaattactcattcctcttcatattagttttgtggcctttggcaggtcataatctctttgtgcttcagtttcctcgtgtaaaatggggatggtaatatatatttcataagcatttctgtataatgagttaataggtaaaaacatatgagacagtgcctgacacatagtagaagtgttatgtcttagctgttatttagatgtgcattctcaaaaagaactttctgctgggagtagaagtgtctcatgcctataatcccagcactttgggaggctgaggtgagaggatcccttgagtccaggagtttgagaccagcctggaaaacatagtgagaccccatctctaccaaaaatcaaaaaattagctgggcatgatggtgcatgcctgtggtcccagttgctcaggaggctaagatgggaggattccttgagcccaggaggtcaaagtgacagtgagccacgtttatgccactgccccgcagcctgggcaacagagcaagaccttgtctcaaaatataaaattaaaaaatttaaaacataaaatcaaaaagaactttaaagaatagtggtaaatgaaactagtaaagtttttccttggcattcaagattgtgaagttacagtggattcataagtattttttcatctacaaagtacttctaagcaggtggcttctttaataggcacagagattagaaaagattcctgtcttaaatgtagtaaatctgttgtacctttgggaccctaattcataatacaaggctatggaaaaatagatttctcccagccaatgaaatatttcaacttctatactctcaaaatatgaaaaccacaaacaagttattctgtgtatatttgcatgtaaatgtttggagttttgtacccttgtattgatttctttaaatcacatcatgaaattaatctcacagtcattcagctgacttcataatgcaaatgcctactgtacttaactatattgggtttaaaaatatgggactattagttaaatatgtccatcttttaaaattaagaggagatggttacttcctggagcattaagtatgtttgttgtaaaagatggaaatcctaaagcagttgctagcttctaggttggatttgggcttctgaaacctagtgtgaagatttctgaatgtattatccttaaaaacaagtggcatttgtaaagataaaattacttaactctttctttcttttgatggtttttgtaatagatattatcatgatcacagcctcattctgcccactacaggatgaaggccatacctaggtgctgcccagctttgagcattgctgtcctgggtcatatgaggtcacattgcttctccaaaggctatcagctcatcccttcatgtatattgatggcggcccttgcagtatctagtatccaatggtctccatcctgtcgtaagtgtagtgcatcttccatctctttcatacatcatagattgctctttctgttctttcacatttcttacaccattttctgtcactctgacctggtctcctctcttcatagatgtgaattattttcaagaggctcccttcatcctcatccactctcaccaccaccccccgccccaagcaatttgcatcccaaagcaagctagacttaatttagaaggacttttctataatgttttcatctttcagtagttgcatatatatatacgtttaacattttagaccatatcatagacgttcttctgtctttgcatctaccactacattttagaatgatgattcctttttctagcaattgatattttataggtacttaagagttaacgggtaagaattagcttcttttgaatctaagccttagaatcttaggatgttttaggtagatgtgtttagattagccagtattctaaaatagtaaagtcctaggagagaattgtcccttgttttgtttttcaaactcagttttccctatatagattttgatattgctgctgcttaatcagaagaggagatattaaatgtattagtcatttggtttctgaatctattaaagtagtgtttatcaaggtatcaaatagatttctgaggagtatacctactaccaatcactctgttctttctgttggtagacctgatgtttatcaagtacactaacttagaactggagaggatattgtaaaacacgtttatataattatttccctttagattctgctattttgaaaaactgtcttttagaaggtaggttagcattaagaaaacttttgcataattggctttagcatttctattgggtttctatgtcagttaaagtttgggcctatgtggacatggcagtatgtcagtgagaaatttaggaaggtatagccaaagtgaaacattgcacaactttccagtgtggtatatgtacccccaagacacctgtgcagcccatagaaggtggaaggtcaattgagcctggcacgttaatatttgagtcaatttgggtgttataaacattcatgggtgaggctcaagtaaaatttttgaaagtgtcatctaagaaatttgaagattttgcttccaaggacaaaggcagtgaattgtgaactatagaaatattttctatttccaagtgacatagattctgggagtttaaaaaattacttggtgtatattgcttaatccaaacttcttcaatggctttgttctcttcaaaatttgtggtatttggatttttaacattgagagaaaagataaactttaaaaggaaataattatatagccattcttactagaccacatagtaagtaataataatgataataatgaggataatagcaagtaccagataatgggagtttaggatgtgtatgtaataggaggtacttccttcaatcttcacagcagtgctctcaaataatagtagtattgtcctcactttattatagatgaggcatctgagacatggacaaactaacatacccagtgttccatggtcaatagctagcttcactgggtgctagaactaactttcttcagcctatgttgcctggggctggtaattagcatctttcatgcatggactttggatacctaaacattacctttcctgttctttatcataatgattgactatttaataaaaaaaaaatgtttataggctgggcatggtggctcacacctgtaattccagcactttgggaggtcaggtgacctgacgtcagaagtttgagaccagcctggccaacatggtgaaaccccatctctactaaaaatatacaggttagctgggcttggtggcatgcacctgtaatccgagctactcgggaggctgaggcaggagattctcttgacctgggaggcacaggttgcagtgagctgtgatcgtgccactgcactccagcctgggcaatgagcatgactccgtctcaaaaaaagaaaaaagaaaaaaataagtttttattaactacaggtctcttcttaacacaataaatgaaaaaaaaattgctactttgaagtcacgtttttttctttcttcaaactttacagatctgttcttattcttatccaataaattatgcttaaatccaagtcttttctccttaaaagttgtcttttaatgtcataagtaaatctctgtgttgtactgtgtcacatggctaaatatgaacttgattgcactttatttcttctggaaatagttatagtggtaaggaagataatcttgataaatctaattagctgtatcacatttccttttaggttgtttatgcagcagttttatctcgccttaagaatgaaagttacttcagtaaaaacgtttttatttttgtcatttactttatagaaatgaatatacacaggagaatgcatagatatttccagtccatcctattattaagtagtcatgacatcacagtgtaaacttttgaaaataaacttttaaatatttggaataattttagattaaaaaattgcaaagatgatatagtttccatatattcctcaccaagctgtagtaaatttttgctaattcagaatagttgagaaaatctaatgttcttgccagttgataatctgtgtgccctgcaagaattcaaagcattcaaatgtatttaaagcattcaaatgtaacaacatatacttagctaaactcatcgtgcttttctttatttttgacattgtgtagcaccataaaatataggagactggactaaatgtcttcatcttcaacataaccattagataaagcatttaaaaatatatgctactcaacatttactgtacacatagagaaaatttcagttttcctcagaatttatcatgggcttattaattaagttttataaaagttaaaatgatttttttcttaccgaactcttctatataaggaggcttttattgaaaatccaatatggaagacatgaaatgcatattttagctatggaagacggtatacactttgtttacttttgagcatatgtaagaactataaaatgttttgtgttaattccatgaacatattttagaagttagcattcctatatcaaagttattagttgttttcttaaacttttaaaatttgagacgcctagtaagcacagcatttaatttaaagtggaacttcatttccttttctggaaagcatgggctaattctctctgctcaacagaatgtctgtgaatccattctgatgagtctttctggctttcacgtatgtcaaatccatatgatctaatttgtgtgaaaaattttaatggtcactgagatttttaagaattaagtatgagaactggttagccatagagtggagcttgctattcattgaaaggtggcagaatcagagctctgtggaaattacattacctgaacatttgattgtttaaccaccagtttgactcatgaaaggaaaactaccaaatacaatttatattccttaacaaaatatatctatagaagtctccatagtcagaaagtgctgagaacagtgttcccaaacatcatattgtataatgaaatcaagttgctttggctttgagcatgcatggcatttagaccaatgaccctctgttttccttgggctctgatgacaggccttgctatttttatgtgttttcaagaagtgaaatgtttagccttttaaaattgcgtttttgtagagaagccaggagaatgggcattgcttactttcactctgtgcgatgacacaagtgtgcttacagtactctcctcctctctccacccccttcccatccttttcatagacgcgcatcgggaattccttcacaggcctgcgtctggatacgtgccagaggagatctggaagaaagctggtaagaattgtttaaaaacatgagtttcgtgttctggcagctgtgtgcagttgttaatgtagtgatgtgaggaatgacaagaaaggactttactgctaacaacaacaacagcaaaaacaaaacaaaacaaaaaaaaccactaaacaaaacacctgattaatattcttaaaccaggcctgattacaagatgaaatcatttttattttagtaacatctgccagtttcactataattgagaagctggcaatatttccattataaaactccatttttttcagggccataatgatttcaggctgaaacttggcataggaggtcttagcttgcatgcatttttttctttgatgaaaaaattccagtgtcttagaaattaaattgcgtacttcagccttttctcctgcatccaaaaaaaaaaaaaacgaaaccaacatcaaatctagttgacttgttaaagtactcagataattttttggttacaatcgacttttaaagttgttcttctgtactaattagtattcaacgatcagagctaaattactctttaagtgaaatgacaaagttactaaacatttatttttgcttttcatatacactatctgctttccattacaagatgctgctctatattttgtaatagtagatttaaagctcctcatgacccactgacttgttattgggcttaaagaagtccagatctgtgagaattttggtggaaccacctagcaagcaaaaacctttatgaaaaccaactcaggagatgaaacataaacctgtttcaagagttaaagaggccatgaaaaacatactgtggctttcagctgctgtaactccagctcttaaaacagtttgtctttttgagttgggaaactgggaaatgctacttctacaaacagtgcaaattgaagagtcaggggacagattttttgtttttttctacagaagatttctctttgggatttcactcagctgtgtttgtagttctgtgtaacttgctgactctctagtcacatgtatcttatccaagtatttttatacattttccaagaaatacctgtttttgtaagagtgataatgagctttaaaatctgatagcattctaggtttagtagcccagattaagaattagaaagctgtcttgcacgtccaatacgcaaattagataggtccatttagcttaaaggttaaaatacatatgttgctgaactgtgtagttttaccagatttactgtaatagtcatgtagtattcccaagctgttaaaaatatgccaagtaccacctacctgaaaagacgggcaacatcttccttctgaccatttttctcttccatttctaagctgtcagtgcaacttattccaataagaggtacaaataattgtgattttggacagaagaagggtgactttatgttcagaggagtgagtcttttctctgcacttccctttttaagtatatttaagttaaattcttgatagttcatagagaaaaattaccagtaaggtcttgtgtaatccgaattctttttgtgctattatctgctcaagtctttgtttgactgctattaagtgagaatagatttttctgaatatagcacctttgttggaaagtcaacttgaatagctatgtacaaaggaagtcctaccataagtggtaagcaattggacgcagattcaaaactgcactatgtattttccacttaatcagttgtttattttttcctacatggcatattgttatctattgactccactattatttttctttactgtctgttttgggggtttttaaacctaattctgggtgtaatttaggttttggggacttaagagagtagagaaagagcactacttgtttttgttgtgtgcttgccctctccaagaagggttaaaccttatctaggaagtgtttagattatttattacagtgtctatcatctacagtaggttttcaatctaaaatatgacattaaatttgtattcttctcacagtggtatccctaaactgctgcttaaaaacagtttgggaatagttttctatggatatatgctaaattttaaggagtatattaaatccacaaagtatggatgatagtttcatctagaaatctccagtaactacttataatatttatctttataggtttcttaaatggcatttctagtgttcagtgtcaaggcatccaacatgatgaaaacaccaagggcagaatgtgacatctgcactcagcttgttacaatttgaaagcttttatcctagctttctaaaattggctatgggcaaaaaaattttttgaagaaaatctataaagtgtgtctttgcaatgaaattattatacattatctttgttgcaaaacataggtgaataaagtatttgaaaaatacaaaaggggcagaacacccaaaacttgatgtagcataacaaatgcatccactttcacagaaaattgtaattacaagtataccctgtgcttgaaagtacatcatatagctttttgcatcattttattttgaaatgatttcaaacatgcaggaaagttgcaaaaaaaaagtacaaaaaattcctctataactttcacctagattcccttattttatcatatttgctttagtattttctcttttcctccctttcatcctcttctttctcttaaatatatatatatttctaatcatttgagagtaagttgcagacataatttctctttaccttaaatgatttgaatgtcagtttaccaagaacaagaatattctacataacttcagtacagttaccaaatcaagactttatcactgatagaagactattatttaatctacagaccctatgcaaatctttcacattgcccccaataacacaatataataacataacaacacacatttttaaagattagaaatccaaaaaattgttcaaggccatattctcctctaaaagtagtattttttaaagcgaaagtaacaaatgcactcaaaagttacaaaggtctttatgaaactggaaaaaatctaacataaagatggttttaaaattgtaacaatgttttcttcagtatatttctttttacatgatcagagaatgtttgcagttggtaataaatattcaagcaccttgcaaatgtcctaccaattctctttgctgatctgtatatgcctgtgggattagaataggaatgcataatttaaatgtaaattgcctgatttgcatatacaattagtcaagctacagctttgatcgtaagcaaaaattattgttctgtactaccacttagatagaattttaattcaccttgaatattcaaactaaattagaccctggctgtatagttagaagggcagtacttcccttgtgccccaagtcatttatgataggataataaaggcatcttttcacctcctggtgaagaaggtgctataagctgtttgcaatactctgattctgtacagattttaaatgcatatcttaaagcagctaacaacggcttaatataatttagttaatatttccactatggatcttttacttatattttagtttataaaacctagcagacagtaattgcaaagaaatgtacttcagatataatgctgctaaaatgacagaggctacaaaagtcatgacagttaattactagtggagagcttctgatgactctcaagtcatggacaatagatgtgtgaaataaaccagaggaattgaagaaacaataggagtacttgcatctcttacatttttaatctacagtaaaacatttttattaggaatctatgtttttaattaaacagaacatttaattaaggtgctttttaagtgggtgaaacaattaagtgcaaacacttgaatgaaacatgtcataattagttttaatagagtgttaattggtactaggtttgccaagttaataattactgcttattaaattttcaattaatcattgtcattttgctttgaataaagatgaaaattagataaactaattcagggggaggatattttcccctgttaattagaacagttaattttttaaaatggaaattacttgttttagttgtcagtcttatgttgtacattagttgaatctttgcaccctttcctcagccaaaaataaagagcttatttgacaccttgcagactcatagtcaggcctgattgttttggcctgtggtatgattcagttatatttgtctagtgcaacagttggttatgcaaaaccactgtatatatttggtaaagtaaatggacaacagcttaaaatgtaaaaatgagattattttttaaaacctctatcatttaacctataaaggcacatatttatattactcaggaaatgacttttcaaaagtaaaactggatcatccattatagcattgatttttcattaaaaggtctatagtaacttaattgctatctgagttaccttttcactattgtgttgtagattatgccagcaactaatagtttgcacttatttgtttatgtgtaaaatccattctcggcctctcttttttttctgaactcttgacctgtggaccctcctatattcatgttaacttatagcattgtggaaaactgactttatgtgtctgaattattcagacaggtttcttgcgaatgaccttgtcctttaacttcttatctggtctcagaatcatttctggaggcattagtttggttaaaaaaattataataatgatataggagtttcaaaaaatatttccataaattcaagttaaagaaacattttcaccctttgttttcctaaatgtatgtcaaaagatctgctagtttttagactgctggaactgcccaataatttggatgagagtcatgcttcttctatagaattctacaaaaaagtaatcagatagtgggcatggtggctggaaggctcctgtaattccagctgctaggggaaattgatgcagaggataacttgagcccaggggttcgagaccagcctcggaaagaaaaaaaaaattaaaagaaaagtaatccgtatccaatgacttcggctaactgagaggtgttttcttgtctggtttggcctgactggcacacagaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgaggtgaggcatcttgggaagctccaaataaacaagatagttttcattcattagagtgctcattcttcattcaaggtgatcactttagataaatatttggaaaaaaatttagaacagtgtggggaaagtcaaggtattcatgaaatttgccaagagctgatcacatttgtctttttattgaacacctaatctttgccaaaaaaggttttgaatgtttggtaggttaccgatcaaagtgaaattcttataacttcgcagcattatttagagactcatagctcggctgtgtgtgtctgttgtgtatgtgtgcatgtgcatatgtgtatgcttgctttccaattgaagggatttaatagatactgtgtaagctgtggtctccaaagccatctggcaggcttgggattgaaatcactgccttagctattggtcctaaagtccaatgctaaaacaatgtttgcatcaactgaatatttctaagagatcttagagacagtctgtacttccacattatttgtggtaacccatatgatggtcatttcatagcataacattgctgctagaggtaatgttacatatattattgttccagtataataattctcacacacacacacacacacacacacacacacacacacacacacacacacacacagctagcctaaatggctcaaagatctgcaaagtaactaaaacacaatatctaacaacatgatttttaaaatattgcctgcaaaatcagcagaatagtaatgctccacgttaattaatatagcatcacgatccttaaccccagagtaactttagataaaggactacaatgggctgctctcaccaagccgaactcacaatggcatggactgataaatcaatggtctactacaatacatatctataatttgtgagggagagtaagtatttaatttgtaccaggcttttctgtagatgaaagactctgcaggaatctctcaatgcccagagtttctatttaatgtgtagcagatgaataacaaggggacaaaaggaattgattttcaacatttgaaagtttctcaggaaaagagggacaaagggaagtttatctgccctttaactgctgacttttccattgttcaattaaactagacataaattcagttttattggtatcttgtggctaagatataaggactttatgttttttattttaaaaacattattagcatcttttgaggagaatttgtccttctctgttcaaatgagcaatatcgtgaggcacagttgatgtcatatcattaaaactgtcactttcacatgaacattttagggctgttaggtatgttaagagtactttttaggtcaccaaattctaaagacagatgtctaggaagaaattgtcaattaagtctttgtactcaggcagtaacatgctgtattccttcagtatttataagctttgtgtctttattcctaaaacctatttagaaaatatgtgatcttgacaccaatatttagcattataaataaaccctgttaaacagtatctgtgataggttattcagtcatatctactactaatgtaagaatgatcttctgtaataattgtttttctttttttttttgacctcttgggggaactgatctttaatatagcattaccagtgtcttcagtgacacttccccaagaattttaaagcagaccatggtagaggaaagggtttggaattcagagggtcaaacttaattcctggctccaattcttacaattctttgatttttgagaaaaccactgaacctgtaaaagcttcaattttatcatgatctgaagaagagtggaagtgtctagtatatggcttgaaccttgagtcatgctatggatgaggaaacttacctggctaaagttacacagctaggaaatggcagagcctcaacaggatctcacagcatgctttcagtccctatgttgttttgtaacaatgaaataaggatcttttcatagggatcattaagataatttttgtatgcagataaagacaggcagcttaggtctgttttcttattctttaaagtgcaaggaccacttttaagacttggggaggaatcatctctagaaggattaagcctcttttctccaaaaatgctgtaaataatttcccaagaatagaagaaagaaagatggaaaaaaagatctctttacgcccaataaggcccatattgccttgtgctttaagtattttatggattgttctgttttctaagaaaaatgaatgttctcatttcttagaagtttaatgtgcaaaacttaccggagagtgcactgtaacctagggtgcagggcaaccacacctcccactttgggtggagctgtccattgacacctagtgtcccaatataattattacgagcgcccccttccactgtcaggtgtcctgtcttcattgataagttgaatggtcccacctcttaaaggccatgttcatctgatcagatgatcgtcttctgctagcacagctcggaggcagatacgtgtggcagaaagtatctgagaggaggacccagaagtcctgaattatggccccagctcagttactgtctcagaggtccttcggcaattcattttattcctgtcagcctccatttcttcttaaggaatgggacgatattcatttaccttacaaggttgtttaaaagatttttaaaatagtgtttttgaaagctataacacaatatattattatctgctcatatttcccacagtttttaaaaaatcacagtatttactaaagtattcctactgaaacaatattctttcctccctttccctttctttatttgaagccaccacctattgtaaacatctgcccatctcttacctaggtcaggtatgaactatataatccaaatctaaaacaacgtatatgtggtaagatacacacattattattctctttccttcatagggattgtaagaaggaatctaagattcgcgatcagaagaccagagttctaggcctagcttggccatttatgtttcttctgcgctatttgtgttaactctagatacctctgaattcttctctctgtaatttctgaatttgccctttctcttcctatctcagttttctttcacatgtataaaacggagctaatgatgctcattctgcttagaaaaaacagtggttctgaaagattggcagtggaaatgtttcagaaggaggagaggagttgagaacatttgactggggagaccagcagaaagaaggcttggaggcaggaatgaataactcatggatattatttgtaggtgggcgggggaggggggcgtgtaaaatttatcatccaaactgggatgccttttggagtaagaaagactgctcttgcttagacagaccagtccggtaaaccaggccatcccaggctcatgggaacccacagtcagccaagttatcggaggttgcatgaagtttgttttgcctgagatgaaataagacgacctacgatgagtgtttaactctgaaccaggcatggtatgaagtgctttctatactttagctcgtttacttctcacatcggctctgacaaagtaggtagtgttactttcctcattttactgataaaaagctgtgccttgaagggattaggccacttgctcagtgtctcatggtcagtaagtgtgagctggtccttagttcaggtagcccgactttcaggccaccttcttagtagctacatggcaggagtgggaggtttttgtttgtttgtttgtttgttttttcctaattgtgtactgtatctatttttcactggacttcatgattatttctacctagttctcaaactttacttggatttataggctgatagttggtattactatcagttagaatgacactggacttgcggcagatatctaagcaatgtgatgcttactgtactttctcttttcccagtggattatatatttaacccagaatataatgccaacattagcataaatcagaaatttactgaatctgatcatcttaaattcttttattttctccatatttatttctatttttcatttcctatctgtgtacagataaagctttttccaatgaatgctctcagattgcagctatttccaaggaaacttctacagctttctttgagatccataccttatactagcttaggtgattgaagcaagaaactgcaagtgagcacagaaacagataaatacttttattgttctaatagtttagagttttaaactaccaaagtgatgtttttcccccagattaaaacagcctttatttatcattcttatataggtgcagagctgcacagttataccaacctcagtggaatctgtgaagtttggcccaaactggaaatgccacctgtgtagactctgaataaaacatagggacctcacagcatgggtcctgtcaaagccttcacaatctcatcagaccagttgattcccagaaaaatttggagctctcagagcatgagctatgatgctatgttacatatatatatatatatagttatacaatatacaatatgtacaattatatatatatattttataaatatatatatatatgccagctgtttgattccgtagatgttcatggtatagtagacagggcactgggctaggattgacctttggttgctcacctcttgaagctttggttttctcatctgcaaaatttgggataacgtttctgtgatctgcctgctttgcaaggtggtggagaggtgccaatgagatgaggagaagtattttattaaaagaaaagtcaccttacaaatgagcagtgtgtctatgtaagaacgaaagaggaaaacggagaagaaaaacagttaagaaatgatcctaacaggaagggtggcgagagaattagagtagtgactatgcgattgaaaaggagagagaccacagaagtagtctgtggggtttggcactgaatggttccaggggctaaagaaagaggggtttgcaataaagtgacaaagtcttgggcatgagtgttgccaaagactgaaatggacccaccagagttgggtttagggaatactgacttagaggagcatcctggtggaggtacctacagaacaggcagttgaaataggagcacaaagctcaggaagaagataacaaggagaaacaggtttgagagtaatttgcttacagctgatcattgaaaccacaagatctcacaaggggcagcatgagaaggaaaagatattccttttctttatgccagcatccctccctccctcactgtcaactacagggaaaagaacaaacagcagaagaagttattgtataagaaagagaattttagtaggggaaatttcaacaagaggcatttaataaggaagaacggggaagtaatcagcaatggtaaatcttcagaaattttgaggacagcaaatgaagttgcggaagaaattattagtcactaatgaagtatgaggagaagtaagttaatgttcttctcctgtagctgtcagtgcccatgggtgatagcacttaatttgaatgggaccatcagccttctaattctaaaggttgtaaggtgctggatctggagcaaggactgtatctactctctctttcttccagtcagtaccaaaaggagggagtggtggtagtacctgccatttattcaggacctatgaacatcatgcactgtgcttagcactgacataaccctgaataatcctgcagttattattcctgctttacatgttctgttgctccaagggttaagtaagtggcttgtggttctaaagccacaaagtgatgaagttggaaatgaaatgaagttggcctggcttttgaagcctgtgccattttcattacacactctgacaccttgtctttgctgcctctgactttatggttcaatttctgtccatttttgggagttaagtgcctgctaacctgttcttgccacaatgagagctaataaaagatctgaaattgacaaagtgtggcattttagaaagaatatttttaatttgtaatccaaacatctgggtgaatcaaactttggctatgtaattttatatttttgtgacttggggcaagccttttactgtgaaaattatttattttgagggtcccagtttctgaaactgcaatcatgtgaaaatgattttaaattgtcaagtgcaatgcaagtagatgatgatgcaatcttaatgtgaatttaagtcaatgtgttgccttctgtaggattcttaacatttgaggagtttcaattacaatcattctattatatttaaatttattacacatcgattttgtgcaagtttttctgaagaattatagatatgtaagacctggagagacttaaagcagttcagagacaaaataaaagatattttgtccttcagaaaaagatttttctgcagtaagaaccagaagggatatatgcctgtacgacagaaagatcattctctaaatgtttttcttagggacaaagagaaatgctgatttgaaacaaagtgtcgaataccttcagtatgcagtgttggcattcaaaagcttcagtccattgattctgtatatagccttgtatttagtatatttagcaaaggggaggttcgtgttcagccacaaattcttcatctgagtcacaacctaactttggtcaattgacttattcttacttttcagatagggaggaaaatattctttatgccaaaaagggaataacattatcacaaataaaggaatactataaagtgccatgagctttgggaatgaaatttgctgtgatatggatatccgtgagctttctacactattatggtaatttcagtgacatcactccttagaggcctgaaagggaagctcagtcatttaaaaataaataaataaaacaattatcaggaaatagtatcttgaatataaaatgcacaaactgcaaaatgtaaaattagattaagccattgactgcctttatcccagcccttgtggatagacacgtggctgttagacacagtttgcaatttccacctttgtgaacagtagaaagcttagaatgatccaaattggagtactcaaaagattctgcaccttccgctgtttccagaattgtgactattcaggggctgagtgccactgatcaggcatcagtcttgcaggtatggattagccaacagtaaattcactagagcatccaagagaaatatattaatagaaattgctctttcagttttctaatgagcttttaagaatgaatatgcgcattggagcgtttgttagttgaacactcactaaagttccctacacattcactgcaatgcaatgtcaagagaaataaaaatttgcagatttttttttaaccagatcattaaaattgctctttttgtaacttcctacagctgaaggttgttttttcttttgtcccagtggtgggtggtaaatgaatagtatcaaacaacttgagaatgaaactagaggtaaaactagccagaccccttaactcctggatcagaaccagacaatactatgcaagaaggctcaattcccagcagcttcacgatccaaaacatctgtttctgtatttggcacaattccacttttttatttgtaaaattgttcccatctttgaaaacactttaaaaaataaagaagcccccattctgtctccctttccacttcccagcacatgcatctgtaattacctggtttagtctgtgtgtttaatcagtttaaattgagaatgttgcatacatctgatttcaatctgaaggagccattgagtattggacagttaccaccctgtgtctgccaaaacgtgcctctgccaaaaaacggataggactcacaccagggtatttcctaaagaagccacttgactcagattagatgtttaatttccttaaaatattgttttggatgtgagtctctgttctctaattggaatattctgatgtaatttaggaatatagcttatttgctgagtttgttccaggatccagctggcattattctaaaagcctaaacctcaaggaagttaacttcactctgagcactgagtattatacctcacagctttgaagggtgggccaggcccacgtttgctcacgtctttgtggaaccattgtacatgcaatgcagttgaattaattttgagagagaaaggcttcttgttatggtaatgagacttgcgatcagagcttcacatcttttgagatagtttcttaaattaattgaagtaggaaaaaattgttttgttctactactattcattcaaattttaacttatgacattttttgacatatcaaccaagtttctagatttcctcagcaatagtcacttaaaacacctgtcattggccagagtttgagattttaagtttttgttttgtttttgttttgtttttccgtgttggattgtaatttcttttttatttctgttttttgtttgagcttttctgctcaacatagcaatgtctgatggttaaagaaataagaacgtggagctgggctctttctaaaagttttaaattggagttcttgagttcaaaggctttcagcacatgccagcctctgggagcccatttatttgttaacaatgttaggatggctgctaaaaattcccttgcacgttttgcacagtggtaaagccatacacagggtgatgggctgacgtttcctaggagtatagtattgtcagcagctcatgagcttaccttaagccacacaaccagcatgctggaagcaaagcaaatgtagagaacacagtagggagacctgtgaatacctatgtcagggctttaaaaatctttcttatcacacaagcacatagcgtcagctgtttggggttaccagattgtagtcagaagtttgtttttcaaggacataatcaaaaccaatgaagttaaagaataaaaagttgaatgacataaagctaagattacttactacagttttgcataatgggatcggtcttgccaaagaaactaggaacatttaaacatttaaagtcagctttgtgaggtccccctccccaccacactcataggaggatccctgaaggttagtttcttcctcattcctccttgcctgcttagggcctgtccccaaaaggtgctcttctgtctctggtatgtttgtgctctaattcgtgatgcatttatcttaaagtttaaatcctggtggcagcctcagtcccacttttctcatgtcttgcaaaacactgcccacaactggcagtgaacttactagggtttgagttttgttctcatcactcccaaatgagccccagttccctctgcttttctgacttcccagagttgctgaggcacacaggagcagcagagcagctccgttggctggaaagaactgtgtgcaaatagaattgttatttggctggttttagcatttctcatttctcaaagccaaataaggcgtagtctaattcattcatttcacaaatatttattgaacacttctatctatcaggcacccattctgggtgcttcagatacagggagaaaaaacaaactgaggatcctgtcctccagggagctgaggtaaagggggttgttttaacacagtcctagcatttggttgtaaggttcactgaatggatgcactgaaagaactaaagacatagagaggttaaaggactttgcctcaccttgtctagtctgaaggagcagggaatagaatcccttatctactctattatatttatttgaatccaatatagatatggttctggtagtttctttgtgattccttttggtatctaaaaggaagaagcttctgctcagatatatctctgtgtctgactattgtggtataggtattgggaaaagatttggaaatagtaattgctagtcagtatgagtgaagggagaatttacatacaaagataaccaaacctaaaaagaaaggatgttatagtaagaacttaaaaagtcttcaactgctttgtcagatgccatagtagttgttggcagagcagtttggacaaccatcccatcaaaacctgcatcttctgtgtttagtgtttgtatccatacgtgaacacctggatttttcatcctgactgtatagttcttgaaaataaggctacagtgatgcctaacatatttgtcagactattgtcttaacagtgtattaatttgggatcttgctttcttctgccttctcctttagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggttta

SEQ ID NO: 14142 - DNA, 121234 bp, Human
gggtgactttagatttacattgtatattgtttgaaactgtatttgtacactatgttaacatttaagaatttataaatatgcacatttaaaatactttgttatcaccatgttcctgccaattttcttcattcacttcaaaaaactctgattaaaatagatacaagtgaagttaaaaagtaaagcagtatattccaaattgagagatcatttttaattgagaaatttgtcttaaagtttatcacatggtaattttatgtgcctcaaaaccaagattaagtaccccatttttgttaaacccagacattggtctgatatttagcagtcatgagaaggaagatatagacttagactctagaggatttgtatatgctttgcctggttcgtttgctcagtagagattattaactatggctcatataggggcatgatccacttttgtcaggctctctgatggcctttgttgatggttgctgaagcacaaaatatatattatgattgaatctaagaagagtatacattttcttttttcccaatatttgtttagcctatataaaatgttttttacctttgtacagaaacattggaaataacagaattgtgcagaaaagttactcacattgccatcttccagaaataatcatatttaacatctagatgtatttactttcagtcttccccgctgtgtgcaccctcccccactccactatttgagtacttacacaacctatacgtgtacatatatttatgtatcttggttatagcattgaaattttttgctttatcatttgttaataaaattgttagtatttatagtaagctaaatgtttccaagatccagctgattgtctttaatgatctttgcttactgcaaggcaattcccaactaagaaatatctagtaatgtattttaattaatcagtacttatttaatttttaaaccttaaagagcaagaaacaactgattgcatcacaaaagaatcataatgtggcacataaactacattgattttttaaaaaatagaacctgcttgttttatttacatcagaatatgttcaccgattttaatttctaggaagtaatttggtctcaaaaaataatagctacagccttagtaattccttttgagactgcttttagaaatctttcttcccttgcatttgttgagttcctaccttatatgtgtatgattgtgctggacccttatatttcctagtttgtaagaattacatagcaatactttttctattcatagtagtgatagtagtggtctcatttttaatcatagtaggtgaggaatagacaataaatattgtgaatgaacaaattctaagtttgtcaaatatagcaggaaaaatgagaaaatttatattattaaaaggaagaaaaggtgtagaagtttgttgatttggtaaaataattcaacaatatttgtttcattaatattttttaactattctattacataaggattattcttcactgttgttttaaactatgtgtgctaataatggcaatactgaaatttcagaacagcgcaacaaaatttgaataatgaaacaaaccactttgttttgaaacaggattaacttgtgtgtaaaattccataaataataatgtctaaattgttttctaaagaaaacataatatctgacagattatttatttttttgaaacaggtaaaatgtaacattctcttagggtattgatgtgcatatctttaaaaccaatttaagaaaagaagagctttcagggtgagaatgtatccagctttgagtcagatgattggaaaattaagagtcctttagaaaacatcatgataggaactgagacaatggggattgttttggattcttctaaaatttagaagagcttgtatctgttttttttttaaacaaaacataacaaaactggcctagtgttatcatgtaaacagatgggtatgatacttcagactggttgtgatatatgcattttttttccctttgttgttgtcaatagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaaggtaaggaacagacaaatattttgattttgcaatttacttacataccagaaaaatcaatctattttttccaataaattataattgtaaagattttcttttttcttccttcttctagtgcctgttctattgtatgttttaaacatttgtctttgaaatctttgggtgtggggattgggtggggatcaatctggtggtgggaaccctgtttgatagttttgggtctgaatatatcaaatgatcaagtaccaaattttttcaccctcttcttgttgcagtgcttcttgccatgtttcataatacatctgttataagctgagcaatacttggagttaaagagtaaaaactatgccatgatttctgtgtttattgtaacgaggagatggtgttttctgaaacagtttgttgactaaataggcaaaaaactgcctttcagtttattatttcttctgatgtatttggatttttaaaaaacttttaggcaaatgtcacttcctaagcagagttcattccatagacacattaagaaaaaaggtgatatcttaatttaggaaaacagcaaatataaactaaatgtattgccatttggcaagagacttcttaaagtctgcaatatttgaaaattcaaggaagccctgaattatgggagagagttcatgtctcctgtagccagctctgttccaggtttagtggatagtggacttgtgcagaagcaccagggcataaggatccactgctaagaaaaagttgagagtcaacacaaatgttgtgtgatactggttggcactctagtggttgggaagagattttaagttctgtgactgactgactgactacgtagaaagagggggagcgaaatactcacccttggtgaccactgttctggaaacatcactgctagcatccaccccacaatgtctactcttgccatttttacaaatgcttataggcttgttcttaaagttctcaggaaggtgttggaaaataaagttgttgtttttttttcttgaaagaccagagaaaatgaaataattccctgtaggatgatacactcctttggggaagccttaatcatgatttggtttctgtgtctgtatttcccttcttttcattcctccttcttcatactgtgatgatgttcttttaatacaattaatgagagacatcaattcaaaagagaaggcaaggagttcaattgtttaagcagttgagacatctcccatgactacttctcttttcttacccttatgcactgttgttactaaacattggttttttgagaactcagatcttggttgattagcctgctaaagtcttgcatagagaaaaagaaaaggtatcaatatcttaaaggaaaaatctaataataataaccatcccgctttagaattgttttcttgtcatcttccaccagtttgggcttccacattaagcttgggcttaatgtgtctgtggaactccttgctttctgccttatgtatctgcgtggagtttgtattaatatgataaagatatctaagatgcagattaaaaatcaaaaaggatattggactttaaaagcttgaacatattgcagatacatagagttactatctttacccactcgcattccatcacaatctattcctttctggtcatgtggaatatatctgtggcctgctggcaatgaaccattgcagcatggaagatctatattgaaagcaaaaatgcatgacaagaacacatatcttaatataatttggaatgcatttatttgttattcatgtacggaacccccagcatcatgtatcagaaacacaatgtgcaatttcttctttttttcttctctgtctctcctactctcctgtatgtgtggtgtgtgtacatactttaaacatgatgtctgtatacacatatacatatttgtattgacctattttgtaactgttgggttttctttgttttccatgtggcattaaaaatttacttctaggccaggcatggtggctcatacctataatcccagcactttgaggggctgaggcaggaggattgcttgaactcaggagttctagaccagtctgggcaacaaagtgagaccccatctctacaaaaaaattaaaaattcaggcgagtgtgatggcacatgcctgtagtcccagctacttgggaggctaaagtgggaggattgctcgagcccaggaattcgtggctgcagtgagcgatgattgcaccgttttactcctgcctgggcaacagcaaggccctgtttttaaataaatgaaaaaatatactaacaataataattactcctaatttttttttcctctttgtaataatattaggtgtatagaaatatggggttcaaactcaagaagttgggaaaacagaaatcacatactttacattttagaacacctggaatccattgggctcttagagttttggagttgtaatttagaagcagataaagcaaaggactatccatggctgaacagtcggcattgtgagtgagaatggcctgaggtggcgccagagagtctggtctgcgtagcaagtttgaagcaggctggggtctcctggagatgggcctctgttagggcagaggctggggggcaggagggtgggaaatgatactaaaggggtatgccaccagcttgggtggaagctggtaaaatgagaacgctgttgtgtttcccacctggtgttttaaagcatacccaaggtacacacagtgcttggtcctctagaatgccatttggagccgttctcctgtaatgcctgccattgtagggaccagacagatttgggacacctaggagtggtagtctggcctgaggagcttgctatcataagccattgaggacaattctaagaagggtgtagtatttgacatattaaaaagatccatatgttttctaaaagatgtaagaggaagcagcttgggaggaaagaatgacaggaaactttttttgcaaagagtgcctgtttatgttcatgcatatcatggaatgggatatataggtagtatcaatttttacatattgtgtgggtttcaaaagccacatttgtattttgaaaaagaggtatttttaaaatgctgatatagatgatgctgtgcacctttatatattggtatctttgttaggaagaggaaagttattttattaagtaaaattgctgcttttagagagtatctgctcttatttttagtttttcttggtcatgtttgaggggtctgatagcattaatgggctttaccccacatggagctttgagcttattgtagcactgcacactgatcccaggtcagtgtgatgcgtgaaatcaatttatttgaatctctttgcctctataggaatttggcagcatgccagttgttttcatttaatgttctttgtgttgaacacagacaagcaggcatgcttttgtattcttctctcttttggtctctgtctctttcagccaatattttactgtatggattttgagatgaaagaagagtatatcatttatatgattctaatcattgtttaattatatatatgtatataaatataccactttcttatcttttaaaggatatgtttgatattcctgagtttggtgactttgcacacacaaaatattttagagttttgtttaaataaaatttttggtgaaacataataaaccagatcatagatggtatttgcttacattaattaccactatcaaaatttaaaataacaatgttaattatgtaacacaacaaatgtttaatttgtaaactggactatcaaaatcatttatttcttggtgagccttctttgaatttgaagatttacactttaatcaagcatgttaaaaattataattatttgagtacaattttctttgatccatcttgattaagataccagcgttttacacagatttgctgtatatgaatttttatgaagtttctgccattaaggtacttttttgttttttaaaatttggagggtaatgactgggaatagcatagagatttttatgacaaataaaatcagacctttctctggatgtttttataggcaggacttgtttctgggtcagctttaggaagaggtggagaaggaaatgagagagagtgagaggagaatgttctgttgatgctccgggcagttcttgcggaagttgatatgcagaaccatggagccgcagcttcggggtcaggctcatacccagcagccctgcttccttgtttaattacctgaaaagcaaaacagtcaggctgggagtgtgtgaaaacccagtatctctcacagccgcctggcgctctgacatcctgcaaggccagccctgtctgtccgccagcgtcaggctggctcaaaccctgggttcctttctttcgggaggcattgtgtggaagagggtttggtcaggaatttgaggttcctgccaatgctgtgtcccctgctctccccttgtggaccacactgacagacatgcttgattaaaaaaaaaaaagatctaagaatttggctctattttacacttctggccttgctatgaaacaatctgtttcagcagcaacagacgttaaccagtagagggctggccttagtttgttgggttcttattttctgagttcccattatatagtgtcctatgtgtgttgctcttttccagtcagactcattagtagtctggtgtggagctagtagctcagagattgcttttatgaggcggttttggaatcttcatctgcccatgaaaatagaatagtccacttttaaaaaaaggtgatagaacttttgcacttgaatgttttttccttttcttggaattggaatatggtctttgacatttgctgtgggaagggccatactctttgacgaagctggaggtggtgagaaataatatttgcacagtaatgtgtggccaatttgagggtaacatgggataaatattctgagaagtgcttggagatggagccatttgggagatcccatgaatataagaggattttatcttaccaagaggaaatctgtccacacagtgggctgatgaaatgtctttgctgtgggttgggaaacaaaggtggtggtggtggtgtttcctgcaaaggcaggggaaagtgtgactacatgtgcagtgatttggtttttccaactacttcattaggattctgtcatgcagactgaagggcatttaccctttagatgcacatatgtgcctcccattaatgttaataggagttatgggcatgtaaagagagcagtatatacctttgcctagtgcataagcacagctccaaggaattgattctgtcctttgcaaagaatagagattgggctttgcagggaagattttggtgggaattattttaaaaacttgttttgcatatcacatggaagtaatgtcaatattttatatatttgtttaccactccagtaaaacatatataataatttaaataattgcattagcctggtgcgccttgtgatggagctggcatcatcgtgatctattatgcacagcgtaagtagctctgccataagtgttatgtgtatcctcaggcatgtgcgtgtttatttatgtatcagcctgctgcatttcttttagagtatttctcttttcaacatcagtataaatatgaaaaaagaaaacatataaatatattttaagccacagccaatattcctaactagtgttctcctccaccaacaaactcttggcaggtttctttcaagctccaacttttttgtagttctgtccacgtggagtcttcttaaatgcaggtaacaatagtaacattaggaccatgtgtagctttaagctttggcagcagagagtgtataatgtgagaaaaatgtggaagactgaaaactgaatggggagaattgtggtttgcaggtggtgtcagaaatgaaagaatttgggtttggagacttgcactgagggtgctcagtaagtgtggactgaaatgcaagaaaaacaatctgtgagagaagagaatcggaggcagtgaattactctggaaagtgaagggaaaacatataactaattgtggacttgtgtcaatttatcaataggaatgaaaaaaggacatttaggtataatgggtaaaaaaggtacaataatccataattttaataagattatggtatatgcagttaaggagaattttaataaatgaaagtaagagtaaaaatttccatatagagtaagggaattgcattgagatttataggctttaaccattcttgagtgtatttcaacatatacagcattaaattctcttttgcctggtaaaaccctgtagggtcactgtaaaacattaatttaaaaatttacattgatataaaagcaaatatactatgctgggtattatttgaacaaatagagcagttttggagtgaacatttgtaatagaattcattgtaactaaaattcatttttgagtaactttgaattgtttataaacgtggcagattagtatgtgtgcatagattttgataatttgcaatgtggagagatataagtggagaatttattagagatgaaagtcctgtgaaagaaaatatgatgaaaaaaattctgggatttttttttttattgctgtgtatttgctccacctggtggattttgttgaaagtgttttaatccttgttaatgaaaagaacactctttagacaatttctctgaactatagggaaatcttttgttttatttttgttgctgtgtaaaatagtttaattcctatctaggtcaaaacatttatgtgtcatttgttcagttctttcaatgcattgaaagtaacttttttttttttcaaaatataatacatgctcattttagaagatttgggaaatacagaaaaataaaaaaatagggaataaatattgtatataatttcaccacccacaattgcattatttttaagaatagacattatcagaagagaaccagtttgcatttgaatttatttaaagatatctggaatgttaaatattatgccaaagtatgatgatgatgattattactataattatttttggacaaatactatccttagaattcccaggctccaaaataatgaatataatcaagttcatcaagaattgcttttattaagctgcatgtctacagaaggcaaaggtagtgagattaaaggtatctcatgtattcatagggttgttcatagcggtggtaagatctgttgtttgctgggctcacacagattgctttctctgaaaatcttaaggattcagttgtgctttgatcatcttattgttttccttaggttattctttttttctcctgcagtctctcacagctctgtaacagaaggtgaagttttgaaaacagtgtctccatatgcaagggatttggagacctttttattgtctttaaaattgtcattcatagtcctcattagcatttattgttgcaagcgtacaagcagaaaatgtgaaattggtatgtcatgaatagccccacagagctctcgagccctccgattttgcctgcagtgtggtgtgggctgggctttgagggaaagctgtccagatggctgcctgcacagagcagagctgcaggtttttgtctctgttgctgagaggagggaaagttcattggagcatatgccatcacccttgcgttttaacaaaactaactcgccattagtcaagatgaggaggtggtgacattgaaacaaaggttttctatatagtgttacagtccttgtcaaatgaataagagatgggtagttaggatgtcttccatgttacctgagtgatttttgtagctgtacaaaatatgagaaaactgtaaatggtaacttatttgcagatttacattgcaaatgtatagtttttaggaattgttttatgggaaatgcttttacttgaaaaaaaacagcagttaacatagctagtgttcagcttgtggattaataaggaagtgttttacttaaaaaattttaatataatttaaccccttgctagtgcctatgtaggaatctacctttaactgtattattatagtatgtttaaaatttgtgtttaaatagcataaaatttaatcagtgcaagtgttaaaagctgttatagcatttcaaaaaattttaaaatattagacgttgaaaataagttggtggaaatgaactacaatatattgtcatattttaaaggcattggcactatcagaaacaatttgtaataattacagatatagattttgtttactttcagtgtgatattttgtcttaaacagacttcatttttgtacacatacacataaatgcacacacaacttaaatatactaatacacatctttttattcatgtataagaggacattgtacttcaaccagagttaaaagtcaaatatattgcttgaaaaactgtcagaatgatatcactaatattttattctgtagacattgaagatggaaaaaagaatatcatagagactatttggtttatcagtttaggaagtcattatttaaaatattttaacattggaatcttcaaagtacagtcgtagagtccattattaacttactttaactgatggagatgcaaaaatcaaagtgacctgagaccatgagttttacataagtcataggtgaaggctaggggttgtgacttctagctctcagcctgccacttgccctggtagatgaggatttctaaacagacctacagcatgtcctccatgggccactgtgttctatagtgctttgtctgactagttgcatgtgattgaggcagtaaagcttttccgcgtctgtaatgtctgtataatcacctattaagataggtttcctctatccagcatgttttcttttacttgactccatctcattgctagcacttaggctctcttggacagccctaaataaccctttaacctcatgatgtttatacacccttcaaattcttaagatggcaataatgtctcctgttcttttgtcatctaagcaaagttcttgtgagttctgcgggctggctgaaagttgaggaggtgcaaatgcttgccaatcatttcccccaaaggaaatatttgagggaatagcgtaaatgtgtttagttgtttacaacagacatttatgtaagggagctaaaatgacagataacctcttaaccttgatggaatacttcaatgaactttttcacttagttttttctttccccctctatcccacttatttcttgtggttagctgtatcttacattgtagcctaactaaaacataaaccatttgtgtttttttgcagacaaagtataattggatttatctttgtcaggggacaatctattatggcttttatttaatacagtttcagatggctttcagtggcagaaacaaattaatgtacatttttattaggtgttgtatctatttaattgactgtcaaagtgatgagaagttaggaaatcatccaaaagagaggtccatctcccttagcccaacaactcacacattaggtaggtttgccttatcagtgggatgcctttagaaaacactaatagcttccagctgggtggaaaatcaaaacctttggggtctgacaaaactagcagatttgaatttgaaagcagagctaatgcctccattttattttttaccactcgcccataaaacattattttccaatatgtcagcctcatttggtggccagtggtctgaaattgaaagtgggacaagcaagcggagaaatctggacatgagtgagtctgccctttcaagctggtgtgccactttgtggaagggtctcctctaagagcaggggggtcttaatgaccattcatcaatgctcgttgggtgatcattgagtgccttctcattcagtttatcaagtcttgcacataaaaagtcagaataagccttattcagctttgttaaagccaactaggagtaaaatgctccatttgaacccattttgcccttgttttttcactttgttaatgcagccctgcttaaatgagtgcctttattgggtcggttagaatatctgaaactattaattctcttgtattgaatagttggtggcaggccagagcagatggggtaggaaagtatttggttgggtgtattgctttcaattaggatcaatgaggtttcagctcctttgaattaactcacttaatacccactgtgtgaagtcacagtgtatcacaacagcctgctagaagccgagaggaaagttgagaagacctgtggaaaggctttaactcaaattctcccttcaccaatgtagagagctttcctgaactgcagcccatgtcagtagactgctggtccctgttgctaagtcaggtttgaacagaggaaaaatttgtatttcatgaaaggtttgtggtggacataagtgaaaaataccttggaatcatacaataccataatgcctttctaatgaatgatctaaagttgtcagaaaacaacttatgtatttgcttttgtgggagcccagcattttgttgttgactaaacttactggtttggaaagtgttgatttagatgactctctctaaaaaattgccttaaaaatggactgtgttcttaattcagtgacatacattaaccgatgaggttctcctgaggaagtacttaattggtgagtaatgtattctttgttattgggatatattttagttttataaaatatgtttccttatgacagtgttttgtactggagaaaacttttgcaatatgtattgtttttctccattcacttgcataaatgcattcatcatgttattgattgtctatttttattatacaatttggatgttagagatcttggctccatatcctccttttatttatttatttatttatttttatgaacgaaaagttattctgtctgagtaactgtgtagaactacatatccaggtttccctattcagggagaactgccaaatggggttctgcttttcttgcctccatggattaaagaataagaggaggaaactggtttcttgagaaaatgctgaactagtctcagatgcacacacattcagctaggccccgctgcagtcagacttctaggtgagaatctccagggatccaggttttgttgatgtggatcaatttaaagtggcaattactgtagtcagataacagcttaaaaagcctttttacacatagaaaagatacataatcacacagcatatggaagttcaattgtctgagctgcggtttagggacttgcagtgtaccgatattaagaccccattttaaagccggatatcatccagttttctcaaaagtgtattgcattttgtcatatgattttctattttagaagtgattcaccatgcatattgatgaaaggttgggtttcccactgtgaaaatgttttctttctaacataagtatagtactaaaaaaaaaatcagtggcatgtagcattaagtggcttttcaaaaatactctctttaaaaatgaaagtctactaatttaggatgctggattccataaaggcccttatagcaggacttaattgattatcacactcatgcctgctataaagctttctatcataagaatgtttgagcttggtgcttaactgtactgaaatccattacagagaacctcattacaagtgacatctaactaagatgaacaaaaagattggcctcataaatagggtgcagtatactattagtgacagaacagagtaatcgttatgaattgtggtctttttacaagttgtctctgacaatgatggatttttgaggggttcgctggataaagcagcccttcttgggtacagtatttaggggctgtagaagttcttattgattgacactgtttatcaagagaatatatttttagtttgtgcggagagtgtgtgtgggtatgctttgaaacaggttgtgtgcactcttgggaagaggtgtaggaagattgagtaggtagaagtcagagttattgcctctgttttcagaaatttttggagatagcaagtagtgtggaaatccatctgacaagggctaaaagcatatggaaagtgtagagtaagtaaaggacatgttgaggactgaaggaatagcaagagttaacgggaatgctcctgtctatcatgttcattgagcttgcaggctgatcagaggaccctgagtggaattgtttctgtgttgatagtggattgtgcatacgatggaaaggtaaagcctgaggcagctacctcatcatgtgccctgttgttgaaacaaacacagacctaggaaagatttgcaagtgtaaaactgagaaagagttttaggagagaacagtattttccttctgcctggcattgttgtgtgtttagaagaggcatgcaaggcaggcaggcgtgtgtttctcctatgaggcagggatgttttacaaaggactaaagagggactgctgagaagaaaatagccagctttagataaagcactataacaaaggcttctagttttatatatcatggtgtccattaaagcttaatagggaagagtccattgaacctggctgggtatgtgttattcatgggaaggataaacatttaggggtgtgcaaagaaatcaggaatcaggaggacatgattgttcagcttttgaaaaggctttacaatgaagattttgtttttatctcccatggatctctatgcaaggtagaggaaagtaagctgaaaatgtttggagcatatcaacccggggatcccagggggttaaaagcactcgagtaaaataaaagtggtcggctcagcttctaaaaagtgttctattttacacatactactgagaagctgacaaaaggaatgattctgatactttgtgcaggatgataaactggcacaatatacaaagtcttataaaaatgtttgtaggctgtttgggatttccagttgaataaacaggctttgagttctgtacctttttttttttaatacagttcccaattatggctatgaaaatgagaagatgaagggaagccttttattgtgaggggtggtagggggccaggtctacatttctatcttttggcaaaataagggttaaccttgaacaggatgggggtggtggtgaataaattattcggcatttagcttatcattctgaatttcactttttgctttttggtgctctgaaacttgcagagagaggtggagtgctaaggggagggtaggggttgtgatactttgcacacacatccctgtcattgttctgcctaaagagacagggctgggttcaaggccacatgtgctcctgtcatcctccacatttctgctccaagtgcaatccggagtgtcagctctccatctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctggtgagttagccctgttctgtgttctctctgtttttccaatgaagaaagcttactttctattatgcatggaaaataccttctgccccacagcgtgttgtatctgatgtgggcaggaagaggctgggggtgacagaggtgtgattggaaggtagcataaagagaaccacaaagatcttgatacatggaggggtacagggtgtggagcccttgcttttaaaatttgggagatgtattttaaaggttgagggggtcgtacagccacggatgtttgtcggagtaatttacttgagggttttagctcaagtaagaagtattgtttctgttcagaattttgtgactatcatctgtacttggtgtcctggaaatttcatctgtggagagagttttcagattatggcagaatcctggaataagatctctttaaaaagctgtttatgtcagagaaagtgaaggaagctttggaactacaaggaatttcagtcttgtcctaaatcacagcccttagatgtcatcagacaaataattgaaatcagttaattaaaataaaaagcctgctgaattagtgaagctcttgtcctggaaatttagtgcatgtcagtttcctctgaaaaatattatttttggagcctggagtgtttctgtgatcgttgccagtgaaggctctgcttgtggagaaggctggccggggaaagggttgtttcggctgttctcaagaactgtctaaattgccctgtgcctaatttggagcttcctatcttcagataaaaaagacagggcagatagagatcctccagctggccgatttatgtggattatttgggtaggacaggcagaagaggctgtgcttggtcacagagtttgtacacctcacagatggtgttttgaaacattatctgccagttttctgcaaccacagttgtgtgtaggtattgccagttgtttgaagaatgtttttccctttaggatgtgtctcgtccatcctaatcattattgatatatatgcagaaaggatgcatttgtggcagaattgcactttttcattagtagactaggaatgtatgtagctgaattatggggaaaatcaatttacaaaaagacaatgactgaggtctttgaaaggtcattttaactctttaagctttcatcttgatttatatgcaccatgcaactaaagatgtaatgtgccctgggtatataatacagaatcagtgtgaaagtgcctgtgttttttatttcaccagaatattgagcacatttatctgatttttatgtcataattcagatcttttttatgctgttaataaacgtgttaaatgatctgatttatcagcattttgaagagtctatatgttaattttgtaaaacaaaaccccataataaaccaaagccatttgtgaattataataggtgaacgagattagttaggacccttgctacttctagctaattgcatcattttaaactaagcttcaaagcacccttatttaaaaagcattgaactatatttagggatttagagtcattgataagtttgttttagtgttgttgttaatacatctggttctacagcaatagcctgaagtgtgggcactgcttctctctctctctctctctctctctctcatcaactgtgttagaaaaccttgtacttggatacatagaatatattaacagctgtgactatgagcatgtgccagaatggcgatacttgagcagatttgacacttggctatttttgacacccatctgtagtttttaaattctactattggatggactacctctaaatatgtttttagcttattttagtccatatatataggttcattttaatggatgattttagccatcttgggcaggttttatatttttaagtaagacattatgtgtagaagattaaaaggttgtgttctatgcactctgatatcatctactgcttaaatgactatatatctacatacacacacacacacacacacacacacacacacatatatatatatatatatatatatatatatatttggtagttgaagtatcagaactaattcctggttgtctcagacatgatgtaacaattgccatatctagggcctttttttataaaattgaggatccctggaaacagatgtgcacaaactgatcttattcagacatcccaatctttgggggtgggtaagtaaaaaagtcttagtttaaggggttctagaactattttggttttaaaaaacatgtttttaaagatgttgctagcatattgtttcaaaatgaactatataagtcaaaagaggctaaggatgctttaaagaaatagattatttcaaaattgtttaactcattataaagaaatatcattttactacctgtcacttttgtaacaactagatccttgtgtttaagaaaaggaaaatgttttcttatgagaaggctgggagaccttgggcattatattgtttcaggaggcagtgactccaagctttctgaaacacttatatttttatgaatctttgtataatattatcaaagaacatatgttgacctacaaaatgctttcaggactatttccttaaaaggacaataagtgagcacagtccctgtagcccagaaatagtgctttttcttttagaagatggctagtattaggtcagaccaccctttctcaatggtcctgctctccagatgtgcctggaacttttttttaagttcaagtttccaaaagagagaaaaaaaaggtttgttttcaaaatctggttttacttaagacatctccatcctggagtgcatttcataaattgcccacatattttccttagcagagaacttaactggctgtaatttttaacacatggccacatcatgtgatattttcaaaacacttacacatagctttaagaaggtccctgcagaaatgatccatcctctcacagccggcccattttttaacagcatatctgcattttccatttagtagagctatatattattagcttacatttttgggtagtaaaacagtgcattgctgattgtaaaacatggactttattatttgctgaaaattgatttggcatttatagccactgtgtactagactatttttctgtttttaacatcaatgcttgcaagcgatgatttgtgtaaaaaaacagaaatgaaattgccatggacagacaactgttagtatccctagtaactgaacatttggataatgcacttggatttttttttaatagatgcatctaaatgctattatgcaagaataaaaacactcacagcagtccattcactgacactctattttactttgcaagttggtttgccattatattaggctctttgctgtatcaaacaacccttgtgccaactatagaagaaaactatgtaagttgtaaatacccaattataaatgtagattatgcagcattacttttttgtagcagaaatgtagacagtccagcttcccttcaaaccctgaaaccctctcccttctctttacattcttttctgttaatatttcagagtacttggccttttagttctgtgtatgtaaaatgatatttggaaactttcacaggccatcttcctgtgcagttaatggtctattgaaaatgataattgtttaatctttttcttgaagggggtgatggttatgacatcttaagctttcataagacaactacttgtttatttttatttcttaaagtaaacatttgcttagtagacattatatagcctagaaatgtttattaactatcttatcactacattgttaatggatgtttgcaaagaagatgctgtaattataattttctgaaaagccttctgagccatcaggggaacagatatatatattttagagcttgaaggtttatcttgcgagcaccttcagtttacagatgttgaaactgaggctcctagagattaagggacttgttcaggtagtttatgaaagtaagaagatcttttgaggacattttcttaactgtgctgtttgtaaatctcaaatgtacattaaatcatgttagcatattagtgtcagtcttactttgttgtcttttatcttcagtcctggatcgctctcatcgtatgctttctcccctcccactctaggattgcagagctacctgggagaaaattctgtgacaataatcacttggcctatggcaaaagtgtgcctattaaatttattttataattgtttgggaattagggaacctatatatagttaattaagagagtattaagcagaaccaaaaatgtaaggctacgacaacagaaagttactgtaatgaggaaagttgggtagtagacatttgtaggttgctcaaaatgtgccagataccagataaccatgattcagtccctccatgccctccaaaagtttggagttctagtgttcccagcagagaagtaaacagggcctgaacatagtagatcatgcaggagcccagaggggtagatacccacctggattaggagtcagggacataggggaaggatgcacaatgggctacacgaacgcctattggaatgccttgcctggctccttctacttgctgcagattggatctcagttcatgtaacttagcattttttggtttgttcttcttatactaaggatagggcattcattttggtttttattagattttaatttctgtgtgtggcagtgggtgtagtatttcttgaaagctatttctttgtgtacagttgcagttctttgatagctaaccatatctagaggaataaatcattaacttaaatgactcataacttgagaacaataggatttcacacctgaccaagaaacaggtttatcgtgctggctttctcaaacagctgtttgcattaattaatattaatgtaaatgtactttctgagaaggtctagcttaattatatttttcaacccatagagttccaatcaaaggaatcagaaaatcctcttaatctcaaagggaatatataactgctgtctctgaacggaataaatctctgatagtatactaagagcagccttttattgaaagcctatatatgccaggctgtgggctaggcactgtgtatactttctgattttcactacagctttgcaaattgtttctgttaccatgtgatctatttgaagcctgaagatcagataaattaagcagtttgcccaaggacataggtaaagttaaatggtagagatgggattccctggactttgaattctctttttgtttccttattttatttttgagaggggttgggtatgttgtggcttgatggcaggatcttttgtaatgaaggctagatggaacatttaaaggggaatgtttgaatctgaattatagtagcatagaaggtagagttctttttgctgaaaaataaaaacagaaaaagcattagccttcatcatcaagaatgatcttggataaaacaggttagcatgctggttatttctctgtgtattactattcctcttgaaagagaacaatggaattaataggcatcaggagacttaatgttattattttgaaaagcctaatagaaatcatagggcacattaagatacaggaacaaaaaagaaatcataaatttactccctgacagagctatacaggttaactgaaatatcacctttcttggcttttggaatgtggtcatcctggctatcttttgttaatcggaaggtcagatggatggttttctgtgttttggattagtagaaaattagaaagcaaataatatattcaacaccttggcagacaaaattgttaaaaattgtgtagctaaaaaaaagcacgttttttggtggtgagactggtgggtatccatggctctgcccccaggagctcctagacaagcaggcacagtgtttccagtagatgagtacattcttaagaaagcagatatctttttttgccatcccccacctcctgcaaagaaaaaaaaaaaagcagttgatttttaaaattgtgggatgctttctctagaaggcttgattttgttttccacatttcgcttttaaaggctaagtgataagtgtagtctggctcactttattagagggattcttttaattttatgtggtttattaacattatacagagtacttgacactcatggaagaaaataattttaaaagtacctatgagaacatgatactgggaagagtttcactttaagagctatataatcagctaggtgaaatgctttttaggaagaagggatgtaggagggtgtctttatcatgtgtttatgactttaacaagagtcttaaagagtttgacaaagtaaactgagcatttttcacaatctgggatgattttgatgggggtgctaactttaaaaaagacaattgctgtgcttttgagagtctcgttattttacgtttgaactttccctcatttaacttcaccaccttcctcaggacttgtttgctttaatgattctcaggttattaggaggaaaatacatagtaaaatttgagggtcctgaggtaacaatttatatactcctgcatttgaaatttaaatatgtcctaatgaggataagactggaaggaagaaaggctgtgatcctgacattttccctgtgaaatggacattgtttcttagttgttatggttgtatctgaacctatatacttagcagttacagtaacacttcatttgaaaggcctgttaacatttattttctttctttttgctttagcattatatttgtatagcctacagacaaaatacgtagaggaaatcaaaacaaatatttttgtctatagaaaacacttgttaaactttctattcaatatttattttcttctaacttcctagaatattccaaatacatagttgatttagaaaatatagaaaatgatagaagtcagaggcaaaacccaactttttagttatccaggcattctttatataccagtgtttgcttgctaaacataaagtggaagccaggcgtggtggcacgtgcttgtagtcctagccgctctggaggctgaggcaagaggatcgcttgcatccagaagttcaagtttgcagtgagctatgatcgccccatgacactccagcctgagcaacacagtgaaaccctgtctcaaaaaaaaattaataaattaatacaaacgcgaagtgcctcccaaagttggtaagcctaggcatgactaggttttcaaaatgttttctattttgtacaatttaggaatctttctaaagaacatctttaaaaggaagagttacctgttgttgacattgtttaactacttactacatagaggagtgtgtttccatttggttttttatctttatctatattttgatcatattttctgagtgtaaaacatttggtaccatgtcattgtgaagttaataaactttttcccaaaacatcttggagaattgaatcattttgtagtgtttctcaagagcaagattatctctttaagccatagttactttcattcactgtttaaaattgttgtacttactaatcacaagctgatcagtttgtgctgagtgtatttttttatttttttaatttatttatttattttgagacggagtctcactctgtcgcccaggctggagtgcagtggcgcaatcttggctcactgcaacctccatctcccgggttcaagcagttcccctgcttcagcctccctagtagctggggctaaaggtaagcgccaccacgcccggctaatttttgttgttgttgttgtattttagtagagagggggtttcaccatgttggccaggatggtctcagtctcctgatctcgtgatccgcccgcctcccaaagtgctgggattataggcatgagccgccgcgcctggccctgtgctgaatgtattttatctttagctttgtgacttgggtttatattatgagcaattaatatattatattttatgaggccatctatcaaaaacacagagcatcgagaatgtcaatgcctgattgtgaatcagtgctcttccatttacagtctgccagagtttcactctctttgtcttaaaagtagaaacagttattctgccttgctaactttcacaggatggcaatagtgattgtagatatgctgtgtacctgtataaagaggttattaaacctctttatagacagcgatgctgtctggagttaaaaaataggagacagtgtttaaccccccacaaaacagtgccaagtgttatgcttgatgcacattgtctaggttagatgaaattttctgagttttgcctatgcttgataggattttctgcctcatctttatgtcagcggtttaccccttctctatcagtgtgccacccttttacacatcccagttatttgcaaatgtggaaaccagataaccaaacttagaatggtgatcacataataaaacacatgcttaagtgagagcctgaaaagcctgtcttttttttttttttttccaggtactaataagtggcacttttaatttgtggcatcaatttacatcactgagtctgtcccccacttcttccccaccccacccctactgattttcatgtttctttgtaggtggttttgctggagagctgaattttgtataaccttttactccacttctgtgttatcccaagatacagcttctttttttcactgtttaaaatagacattttaaacatcatcaactccccttgataaagctgccatttatgttcagatcttgattttctagttttaataattccattccaggctacctgtgagcctggcatagagtatgcaatcagcaaatatttgcttaatgaataagtgagtggatgagaggtagactgggactcacagagatttcaaaagaaagaaataatacacaaagcatgttaattaacaaggggaaaaattaagaaatgaatcttataaaaattttcagtaagtggtctttacgaatgagaattttctttcagagttaaggaaaatacatatattttgtggcccacaactttattggtggctagctgcatgttaaaattcaatgtaatttatcctgattatacttactgaaagtataatgcaacatacaacacttaaaactttctggcataattactaaaattagaaacaaagggcttttgacagtgtgtgtgatattttggaaatggactctccctccacctgggcattttcatgtagtttggccatttttcattcttgtcacctagtggaggatgggtataatgtttcagtctcccatcaggcatactgggtaagattttagcaaagagaagtattaatgaaatatttttatcttttacatgataaatttagccaatagtttcttatatcaataatcctaggtaagtaacaatttgatagacaggtaaaatttatcttaaagactctagagcgattgctagaataattcattctatatataatatatattttctttaaaaatttgaatgattttaattgctgctctctttgaatgtttctgcccttttatcattttttcaacatttgcattggatcatttgaaaggaatagggtaagacttttgagtttcagtatctcttaaaagaataatctttgctaattcggcagatactttgtaagcatttctcttaattcatgcattataaaaattcttggaaggtcagtttagctcatctgttgagtttcctaatacaagaatgttgctgattttctaaacagattaaagactctcacagggtcagtcaagcactttggaagcatggtacaggatggtgtagccacgttctcaacatggggtcaaggggaccaacagtgtctgcctcaccagagaatttgttggaaatacaaattctctgccccctcccaagcctactgagtcagaaactctgtgggtagacccagtaacgtgtgtttgaacaagccctcagaggattcttaagcatattcaagtggagaaccacttttgtaaattatattttttgtgtccttttatattctatagataatgcccctttttggtcataaataagccaggttaggtcctaaaagtatggaaatcaatattgttcatttaatcttattttttctttttatttttgtggacttgtgtagagaaatatgatttattttaaatgatgtatttttaaaaatacttgagagattacaaattatgtatttgtttaattatgccttggtttctgacagtgtattcagatgcccacacagctaagttgactgagaatcaagggagggtgcttttcgacttgaattctggtttgttggtttgttctgatagttacttgtaaacaaatgagtagaatatttaggtagacttcaatttcacagtaatatcagttagtcttggaagtttggatatacaaagattttcttttatttttctctgttcaacataaataagcattcaatgtaattaaaaaatgtttcattggtaatgccttgagaagatttatttctgatgtctcccatatcttctgttgttctcttttgtgcttggtaggccttcagtaagtgtagtctgacacgctttgtggcctctgcctcctgtgataaaatagattgaaatgattcctggcaccatctggtgaagaggagcagccctggaggactgtgctttgagagaaagtgactgaatgctaagaaatgtggaagtctagggacacaggcaaaggatttttttttttttttaaagagcatgaacattaatacatcttcttgaggtttgatgggacatgtactgcctactgccccatctggtgcttatgatagcatggcatattagcatgctgcaagttcataatgtattcagggggaggaaacatcccttgcataccaattgaggcatcctctctttcagaactgcttttgaatttcaatgatgtttatatcttccaagccgcgtctgaactgagcatttccgctctgaggaataacttgagagagagagagagagagtgagagagagagagagagagagtgtgtgtgtgtgtgtgagagagagagtgtgtgtatgtgagagagagagagcatgtgcaagagagaatgtatgtgtatgtattctctccattaatttatcttcctctcttttttgtgatgaaattaagtagtttttaatattatgttggtatataatttttaaattttttttcttatttgaaaccatgtactactttgttatttcacgtacggcacttaaaacattttgccttgtggaatcatttgtatggttgtcctcctatagattgaacacttttcgagggttgggctggtacctaattatgtttgtgtctccatggcacctagagttcagtcatccatttaacaaatatttatttattgagctcacactatgggtctgacactgttatagatgctgaggaatcaatagtgagcaagactggtgagtccctcctctccaggcatttgtattggaactgggaggagacagacagtaaacaaagaaacagaaaaatgaaaaagatgatttcagatagggataagtacaataaaaaaaaaggctggagagtgacttactaggtggggagctcatttagattagattgtcaaggaagacacctttaaataggtgagatttttgctgagagctgagtgatgggaagatttagtgacagaggaatagcaaccgtaaagccttgagatgaaaacgattgccattttcaaaggtcagggtagcttgagccaagttcaggggccagtccattgctagaagttggggatttattctaagcatgtctggaagccatcagagggttaagctaggaagtgacatgatctaaattgccccctttaaaaggataacttgagctgttgtgtgtcttgcacttagtagtcactaactaaccctggaaagaatgagatgagcctttaaatccattgacgcaccatgtttaattggaattagcatgagttttaagatcagtaaaatgtctgttggattctggcctggccatttgctttatgtttgattttgagcagttatttaaccagttatttagcgtatgtttctcatccgttgaaagggaaaattaataccttaaggccatggcattattgtgaaaattaaatgagataatttgttaggagacccagcacagtgctcagtttttaataggtacctgatctatcactgacatagggatcataataaaacttttgggatagtttcaaggaacatttaaacagttggcagtgtccagttggaaatctgtttctggtactgttatcttcttaataaaacacttcaaatattaccatgatagtagcacttaacatctgtagtttgttgctcttgatctagaattatttaagaaaaaatactcaaggaattatatggcaaaatttatgcccagtgaaacaacctagattttcctccccctgatttcttcttcttaacaaaaatgtatttcagtgaatttgatttcttttacgaataacagtctatcatttactttaaatatattttctttttttttcctcaagacatgtttaacattgaagaagccaaactgccttattaattggaatgaaaattgtggttatatatatgaaggttacaatgcagaattttaattcataaaatagtaaccttattagttgcatagttattagacataagcctttcaaagataattttttaaatataccgtaatggacaaaataaggagtttcttagtttttgcctaaattatgcacttaatagcaagaacagtccttcaactattttcatagtctatgaggtaatgtttagcttctcaaactttctgtagaaggattgtgggattatgagtaggagcagatagtgttggggattgaatatctaaatagagttcgacttattgtgttaggcataattttttgaatatataggttggataagttatttggtatttgttttggggtagaggttcttcccctcctcagttggtagattgttttgtgttttgcctacagatattcaggaaaacaaataatgcttaaggaatgtggaggaggtagtgtgggtaattcaggcaagtttagtcagcacttatgagattcttgaaatgttttttgatgtcctgcagaactgtagagagctgttaacatctgcatgttctgtgagagaagtcacatttatggctgctgtattcttgctggaatgtcagaaaaagagggaaagccacagaaaaaggccacagaagattgggaggtgggcatcacagttcagaataaggcatctgactttacatcctaagatgtatcattttctttaggtaagccccaattgaattcttaacaccatcttagaagagtgataggcttgtgaggtttgagggtaattcgaaaaagatagttgccttgctgagaaacagcctttgtgaaactttgtaggccatcacagatattgtctgtccacaccttatatgtattttcattctcttctgcaggatgccgcaaatacagagacttaggtagtatttgtgttccactagaaagagagggaaagaaaaaccagctgatcaggtgagataggtacattttgctaatctgtgctaggtgtgctgggccacaggcctccagaagagacctgcatgatacagagtcgcatgtgacgtagccaccatacctcctcattttaatttgtttggcttaggcgctataatattgcaaactacactgctagatttctcctctcttgtctcttaaggacaatgaccattatcttgtataatacccaatttgtaattattttcaatttcagttacttggccaatgtggcctttattttgaccatttctctcacatgtttttcagattccaataatagaaagagctctttgtcaccctcacaaaacttgctttcttaggatattaaaggatatacgagatacaatgtacttaagtaaaatgaccatcatctcaccctccaaagaccaggttgagtgtcaaatatatggttctgtctgtctttctatcttcttacttttccccacccctccctttcttcctcccacaataaactttaaaacagatgttgtactatatatttaaaaattttttaaaaagagagatggggtctcactgtgttgtccaggctggtcttgaactcctgggctcaagcagtcctcctgccttgggttctcaaagtgttgagattacaggtatgagccaccataccccgccagttgtaatatttttaggaattaaaatccgtaacaagctttggtcattgtcaaatcacgttgcatacacagggtttaataatgatctgacacactttttccttgataaaattgaaaggaaatagggcctatatgttatttactgacacctcatttatattttgaggaaactagaagtccttaaacgtctaaaacaagtgtattgaatgttcatttaagcagtctatcagttgtaaatgtttacatttaaagttaattgtttattgaaaatggatcatttgaattagttcatttggtgagctaaacgtttgacaacattttgataacagcagatattgagcatacacaagttatactttttatgtggtccttcttgataagcagtgcaatggagttgtaaaaaaattatgtgagaacttttcttaaaggactactcagctgctcaaagctcagatccctgacatgcatcctttccattgtaaacttgtgcagtttacaaaggtctgtagcagatgttggaggaagtgggtagataagattaagtgggtgtggtgtcctaaaataacctaagaggcaattttggagcaaattgtttgaggttaaggactcttgtcttttcttcctttgtatcttttttttttttttaaatccatagtgcctagtacagtgttttacacataatatggatgatgcatgtttcataaaaataccctgtagctcagttatgataggtctgtaagtcatatattcatttaatcagtcatgcagcaagtatttattgaactcttaatacatgctatacttttttctagttactgggatgaatcagtgaataaaacaggcaacattttttgccctcatagaacttacattctagtgtatgtgaggtgggtggggtgtgggagtgaacaggagcagacaataaatgataaacataaaatataagtgagttctgtggtttgttggatggtgataattatggaaaatcaggataaggagggtctgtagggctgttggagcaggggtcaggttacagtttaaatttgggtaattgaaatgcacctctttgagaagggacttttgagcagagatttgagggagatgagggaagcggccatgtagagatatatgggagaagcaccttccaggcagagggtagagtgtggtgtggattgtttgaggaatgggaagaaagacaacgtggccaggttagactggtatgaggatgaaagaacacctggagatgagaccagagagtagcagggagcgtgaggggcagatagctcatggagggttcttgaaggccattgtcaggacttccctgtccaatccatttaacatccatcccacatacccgctgcccagcgcttggttgagtatattcttattcttccctgcataatgtcataaaatcagatgcttaaacatcatatcattctgaagacctcactgggcctcatggttactcccgtcatttattattccatgcctccagatatttactgtcatccaatccaatttgtgttttctgttttatttgttgttgtatggcagctgcattctttaacctaaacactgttctatgtagtgctagtcaaggctgcatgttaagtctttcttggttttgactgctatgttttagtgcttttaaactcattttagatataagatacccaaaacaggcatttgctgaaggtaaactaacagtcaggctgcagtaatattaaaaatcttggccaggcactgtggctcacacctgtagttccagcactttgggaggctgaggcaggcggattgcttgagcctagaagtttgagaccagcctggccaaaatggtgaaaccctgtctctactaaaaataaagaaattggtgggacatggtggtacaggcctgtagtgccagttacttgggaggctgaggtgggaggatcactggatcctgggagatggacgttgcagtaagctatgattgtgccactgcgctctatgtagcctgggtgacatagtgagattttgtcttaaattttttttaatctttgtattaatcatgtgttcatactaaggggcattatttgagagtcttattataaaccgtgatctagaatctgcttccacatttctcttagtaagcagcacacataccgaagacttgtcttgtcagctttcctcattcccctgcagtgagttaaggtggtacaagttacactagtatccatgaacatattaaaagtcaaatgtgtgatacaaatcattcttttctttcaaggtggtgacagtctgaaatgatacatgagtcggcaggtaggggtgaaatatctgtgttctttaggagagcacaggccatggggtaggcttcctatgtaatacaggcatgttcagtttaaattatttgagtaatttccttggacccacttaaattttctgacctccatgaagttgctgcaccgtctaaaagtacctgaaaaaaataaaatctactgaacttaagtggctatataggtatcctctcaaagtataacttttgagttttagtggctgcacaataaacaggattcaattcaatataaaaatatttgagtactgattctgggaacgactttctactaagcgtagcaggggttttaaagagaggaagacacagtcctggcacttaaggaacttaagtgtagtaggggatatagaaggagattgaaggattgagaggcagaaaagtggagactgattagggagaaattacaagaggtagcgcaggttccaaatcaacatgagaggattttgaaagcattgagttgaagtccatgattgaaattcattgaatgagtgtcattatttgggagaaaaggtgagagtggaatcaagggtactgtttgaattttgagcctgcgtaattggcagagtggtcttgcctcagtggaaataagaaagcaggaagaactcgttttgcagaaagaataatctcactgataggttgaattggagactcttacaatagtaggatccatcttgcctacagttgggaatgtatcatggtagtttgggtgaggaattgagtcctgagatataaactaaagtggaaaaaattgtacatttatgtgatggatagacaattttgagaaaatggaaaatactaaatgggtgttatccttagtctcattatcgaagctttgaaattccattgcaattatattatggtttattttggcggtgcataaattcccacttggtaattaacttttatatccttcctatttgtgttctatacttttattttccatatggaaaataaaatatatgtataatatatatatcgatatctttttttttttttttgtagagccagtgtctcactatattgcccaggctggtctcgaactcttggcttcaagcaatcctcccaccttggccacccaaagtgctaggattacaggcttaggcccctgcacctggtctattttattactttctgttacttgtgcatagcttcctcatagtggaattaattgactcctgagtatccttgcttgaatcaacatggtttccaggtggagggtaatatagtggttaagaagttggactttgcagtcaaacaaaactaggtatgattttctcatcttccctccttttacttgctttttgtgcctgaattttctcacctgattctcttgaggattaaatgaaataatggaaaaccatacatgttggtcctcaataagtggttggtgaaaggcagtagtggtgatgagaatgacagtaataatatttattccaaaactcattaggtttatccatgcttctgcatattgcaggcatggagatgtgaagtagaatagagtcccgcaatggaacatgagtttagtggttgctcagcccacctcttcatggtgctctgtgctctttttgccatctcttggatagactgattgagacacaacagacttataccctcttggtcttcttcactcattttttaccatagatgcacctccaagtctggaattgactttttcacacctacctttctgtgagaacttgcagaagtcacattggtttactcattcacaaaacatgaatacagccaactgtcagttacagcttgtttattcagagtgactaaattttggctttttctttcctgctgcctgtcttctgcccatatcgctactattgaatttttgtgtaagcgagtgcatattggttcattttagctacttatcaaggatttttaagagcaggtagcgaaggtgcattatttaccatgggcttttctgagttttgttttgtctgtctatccatacatctatgctgttcccctgactcctgttatcatggatagtaagataaaccaaataagcactatctgataaagaatttagaaactttggcataaattcagcttaaggtttttttttttttttttttgagacggagtttcactcttgttgcccaggctggagtgcaatggcttgatctcagctcactgcaacctctgcctcctgggttcaagcgattctcctgcctcagcctcccaggtagctgggattacaggtgcctgtcaacatgcccacctaattttttgtatttttagtagagatggggtttcaccatgttagccaggctggtctcgaacttctgacctcaggtgatccatccgcctcagcctaccagagtgctgggattacaggtgtgagccaccgcacccggctaaggtttttatgattataattattttttaaattgtgattttaatactgtcactccaaaattccaaggaaattacagctgaaaattttatgtataccatctttagtgtaacactctgtatgtttgttactataaaagatataaaataatcatactttttattatttcatttattttaaaattttatgtaaatttatattaaattttatgaaatgataatgtataatgacttttaataaagttttctctacttttgtgatagtttgctagaactagttagtttttttttccttccttagtatatatacttttttggttgttaagactgggactcagagaggaaaagaactctgtttcatttttggtaagggatttcacaaacttaatttggggacacttgaggatatctcatctaatcttggaaaatggatgtcagttttcttaaaataatttttaaattgaataaaattaactttttgtggaaactttatttttttggagggggcagaatgctatatagtcactagcaaagaggtctgagaaatatgtatagattgaaattcttccttagaacacctctttctccacattcacccattaactttataaccaataagacatatgccttcatgtgagagaaatgagaaataggagagactgaggtccaggtgaattgtctggatatgaacaaattagggacacaggagaaaggtgtgagaaagctcacatgcttgaataaaaatgtggttgttttttcaagtcttttttgggtaactgacatgcttgaatccaaacacagctcagggcactaaaataatgaaatggcacatagtcttcccaaggaaaagctgtgtttatttaaacagtggatgcttatcttttcctttgtgtgtgcgtgtatcatttctgttcagattctcagattacagtaatagctgccatttattagtgctttattatgttccagctgttgcataaatttttcacatccatattctctcatttaatctttagaaatcacttacagaggcagttgccaggaccacccttactttaaggtgagggaaagcagatcaagtgggtgggcatggtgccccatgcctgtaattccagcacttcgggaagccaaggacaaaggatcacttgaggcccttcgaaaccagcctggccaacataacaagacaccatctctacaaaagaaaaattaaaaaattagctgggcatggtggcatacgcctgtagtcctagccagtcggtcagaaggccgaggtgggaggatcacttgagtccaggcattagaggctacagtgagccatgatgacaccattgcaatccagcctgggcaacagtgagaacctgtctcaaacaaagaaaaaagaaatccagtaatttgcccagtttaagaagttggtctgggattccatttaaagtttagtgatctcaaactcatgctcttaacaacctatctggactgtttctgcgtatcatcatgatatcataggcagcaggcactttaccttcaaataataaaaccagagaatgtttacatatgaaagagataaagaaccaccccttcaggccaggcacagatcacacctgtaatcccagcacttcgggaggctgaggcaggtggacctcttgaggtcaggagctggagaccagcctggccaaggtggcgaagccctgtctttactaaaaatacaaaaaaaaattagctgtgtatggtggtggttgcctgtaatcccagctattcaggaggctgaggcatgggaattgcttgaatctgggaggcagaggttgcagtaagccgagatctcaccactgcattccagcctggacaacagagagagactatctcaattaaaaaaaaaaaaaaacccaccccttcattttttagcttaaaaaaataaaataaataagcccaaaggtttttgttttgttttgttttgttatttgggacaaagtattgctctgtcacccaggctggagtgcatttgcgtgatctcggcttactacaacctctgctgcctgggttcaagtgattcttctgcctcagtctcccgagtagctggggttacaggcgcatgccaccacgcccagctaattttttgcatttttagtagggatggggtttcaccactttggccaggctgatcttgaactcctggcctcaagtgatctgcccacctcagcctcccaaattgttgggattacaggcgtgagccacagtgcccagccatacccaaagttttaaacagtttttcattcagccagccaatcaaccatcaaatatttactgagtatctactatgtgccaagtagcaagtaagccaaacaaagcccaggcctttgtgaaatcctgctggcctttagtcatgtatttgatggtgggttattggtgggaggtgttagtcgaatagtatagtagttaaacccggagcatgggccgtgaaatcatgccccttggctttgcatgctgttcatttgctgtgggacaatggacaaattatttattctttttaaagctcagttttttcacctgaaaatggtaatatgaataagatctattgcattgtcttatagtgaaaattaaatgagttaactcatgtaaagcacttagcaagataactggcacttggtaaatgctcggtgagtattaactgctattaagataattagaaatagcctgggtgcagtggctaatgcttgtaatcccagcactttgggaggctgaagtgggaggattgtttgaacccaggaatttgagactagcctgggcaacagagtaagacctcgtatttgaaaaaaaaatttatattattttattttttttgatcatatctcactgcagcttttaacacctgggcacaagtgatcctcctgccccagcctcttaaatagctgtgactgtaggcacatgccattacacaggctaaaaaaaattacattataaatatttctagcagtaattgtatttcaccctgacgaggaaggcatgtacaaagatttttacaataagatgtgagttgtatgatggggaagaaatggagggctttgaaagcacagtagagccagacctaactcccagttggttcagggaaggttctggtgcagcaacactgttttccttttcaccttttttgtttttttaaaacttgataacttatttgatgccctaaatcctggtgttctttgacttaacagcagtttgccacagtgtatttattcagaattagctgtgtgctaagcattgtgcagaatgctggggatggaataatcaataggatgtagactcggccttttaaggaacatgtgtgtccgtgtgtatgtgtatatagtatacacacgggacacacacctgcaaatataatagttgtaataagtgatgctaagtttgctaataaatgtatgtaaaatagagcccaaagaaggtaatgatcaactctttgctctgaatatggggcaggggtaatttgggaagccttcatgggagaggtggcacttgttctgtgtcttgaaagatcataagcttgttgtagtcaaggtacatttcaaaatcagggaagaccatgacctggtatgaattgccagggctggagcatatgctgtgagaaagtaacagagggaaatgtcaagtcttataagtagaagtggtagaaagggaagccactggatgcttttaagcagaggagtcacattgctgggtttgaacgttaacatcactctaggagtgaagggaagggtagattgaagaagatgagatttgtagtacgctaggtgagagaacatgaggacctgatgggccacagtgtcaatgagcaagaagggaagggaggaaggtacaggctctagaagtaccaaataaacagaactgaggggctccaatgatcagttggtatggagccaggtatggtgagcagtggtgtctagagtgactctggattctgatatgagcaattggttgccatcaaccagaatggggaataatacatcgagagaagacagtgagttcactttgaaatgttaactttcagttttatttggtgtattagtgcagagatactcaatggcaaggtggatcacaggtttgtgaggtacagatgtatacagtgaaaaatcatcatttggagtcactggcgatagctaaaaccttttgagttgctcattcaggaagaaaacaagtggtataaagagaggaaaggcttgaaaagaatatgggaataccagggcaccagaaaagatgaagagaggagaaggaactgttatggaggttttgagagagtcaggtattgttaaaacaacaaagagtttcacaaagggagtggtgtacggggtgaagcactacaaagggaccaggaacagaagaggggtcaagatagccttttgggccaggcgtggtggctcatgcctatgatcccagcacttggggagaccaaggcggttggatcacttgagctcaggagttcgagaccagcctgggcaacatagtgaaacctcatcactgcccttcagcctaagtgagactctgtctcaaaaaaaaaaaaaaaacaacaacaaaaattgccttttggatttggccacctggaaggaaagtagcaggtaactttgtccttttgttggaacttttttgtggtggattgcaaagtggatggagcccctgaggtctgcccttaagaagccaggcagtgggagaatggaggatgtgccagtatagtctacaataaaggggaggggtgttaatttttctggatgagagagactccagcaagcctaggttttgagaaggagtggttagggccaaacaagttgaagataagagagagagtaatttctgggagagtgaagcccctagaggcagaagggtgcctcttctgagcctagaggcataggtgcagatacagaggagtttcgagggcagagtttgcagagatgtaggacccatgaccttactttgctatattaagtagactatgaggttatctgcagaggagagtagcagagtttggctggagaattgagatgagtcagtgtctttgagatgaatgcaacctggtttttttactggatgactttcttgcctcaccttgtccggggctgtaccatgttggatatgcttgggctcatttaatctcgaaagccttcgttcttcatttcctgtgtcctgtttggcttttcctctttgctttatcccacctcacatctaaccttgaccacagcatgaactcgtaactattcaccctccctttgtgtttctgttttttaatgacatctccttgtttcttttcttactgggtttataaccaattcactctccattgtccttttaaaagttagaatcctgccttcaggattttttatgcttttttatacagttttttttaatacttctatgccagacactgtactaggactgggatataacagtgctctgggagagagattaaactccaattaaaaggatataaaagaattttgattagctgggtgtggtggcacatgcctatagtcccatctacccgggaggctgaggtgggaggttgaggttgagggtgcagtgagccgaaattgtgccatggctctctagcctgtacaacagagtgagaccctgtctcacagaatacataaataaataaataaataaataaagaagaattttgagttgtgtaagtattgggaaggaaacaaaggggtgaaaattctccatgagataggatggtcaggagaggattgattccatgagaaggtgacattgatgttgaaagataaaggtgaaaatgagctaaccatttgcagaagggagaagggaaatagtaagtcttaaaaaatatttattgttttcataaatagacattccataagtattggattaactgcctggagctgtttgtggtactcttgggtcttccctactggtctttccttggttcctgaaagctccatagaagacctgtaacagattatactcctctgcttttaaagcagaggattttttttactttttaaatttattttttttgagatggattccctctgtcacccaggctggagtgcagtggtgtgattatggctcactgcagccttgacctcccggtctcaagcagtcctcccacattagccacctgagtagctgggactacagatgcatgccaccatgcctggctcatttttgcatttttctgtagagacagggtttcgccatgttggccaggctggtcttgaactcctggcctcaagtgatctgcctgcctcagcctcccaaagtgctgggattacaggcatgagtcaccgcacctgatgagaaggacttgtttatgtatttttaaaaaaatattgactggaaatgcagctgttactgaatacctactatgtatttatgggcagagggaagaacaaggcacctgaacatttctttcacttagttggatgatgtttctgccctccctccttctcaacatcagcatctgtggcttctcaaggcattggtcatccacaggacacggggttataaatttacacattgatgagaaagtttatttcagaatttctcaggtaattctgattcagtagcccattctcccaacccagttgaaaatcatcaatttttatttcatgaggcgatgagggtgtaggtatgtatatgaagttgccatcattagcccatcaccattatatgaattagttgaaatgactattggaacttcagtcccagaagtagacatttgggacaaatctgaagctcaggacattgagcctagatgggtgtcactatttagtatctttagctagggaacaatataagagttccagatttcttggagatcggagttagagggaggtactgaaaggaagctaagcaaaggagaacaaggaaacactgaaggttaactgtgctgacctcataattttgtctagagtcagctcaaataagttgacataaccacattttccagggcaaaatctagtgttttcttgaagcccaaacttgtacaagtaagttattgttctttagaaaaaaggagataaagagtagaatttgtgtaatggtttattaggcttcagaaaccttccggaggcatcctggcaagttctcctgaaaaggaaaggtattcaaaggtgctgtgttgatccctcaaaacagaagttcccaacagtttttcttgctgtcactcaaggaatgttgacattgacgatcacagtggtcttctgtgatagtgttgatcacattccaaaaattctatccctttgccttttagggaagtactagtgatattatcataggaatggttttggatatatcctaacttgagttattgttagtaacaagttaataacacaatgaacttagaaaattgagaacactttcctgtatatttagacatttattgctttcataattaatttatctgacaaataatatcaagaaggttgtgtttctgaaaacaaccttatagatctttagcaagcaacatttttcatttatatgtggaatgctctttgcagttgtccatcaatgtttggtttgattctcgccattataattcttcataagctcagagaagacatctctagtgctatatgaaatataaatgattcctagtaagtggatgggaatttagactgtcatcttaatttaataacatatatacccatatttacagtataaatagaaatgaggctacattaagaacttactaacattaaatttatgtatgtgttcacttgagacacttccctggaacttaaggtggtgtctgaattgtaaaaatgtgtcattcaaattgtaactagccagaattttatggttctaggttccccagtggttttcctggtattaaaaggtatgcttgcttttacattgtctggaaatatggaaggtgaaagtagacttacttagatgcttttgaatatatatatatatatgcagatatttcctgctaaggcaatcttgattttctgtccttagggaatatttattagcaattaattatttagggtaacttctctgaattactttattaagtaaggtcatgggtttccatgaaaagttgtattatgcaaagtattcactgatgtagaaactctattaagaaatgataaatatgaaattgaaacaaccgtataaaatatatggagttgatctccctttatattgaccatattaagccaagagaaaatcgcctttaaaatttttttttatgtatttagagtgtacaagtgcagatgcatttcttacatgcatatattgtgtggtggtaaagccgaggcttttagtgtaccaaatgtgatcattatacctaaaaggtaatttttcaactctcacctccctcccaccctcccactttttggagtctccagtgggatacctattatcccactcttatttttttttttttttgaaatggaatttcactcttatcgctcagacgggagggcaatggcgcgatattggctcactgcaacctctgcttcccgggttcaagcgattctcctgcctcagcctcccaagtagctgggattacaggtgcccgccatcacacccagctaatttttatacttttagtagagacggcgtttcaccacgttggccaggctggtctcgaactcctgacctcaggtgatccgccctccttggcctcccaaagtgctgggattacagggcatgagccactgtaccagcctatcccattcgttacatgtgtacccattatttagctcctacttataaatgagaacatgcagtatttgactttctgtttctaaggtatttcacttaggataatagcctccagttccatccgggttgctgcaaaatacatgatttgattgtttttaatggctgggtggtattccatggtgtgtgtgtgtgtgtgtgtgtgtgtgtgtgtgtgtgtgtatatatgtatatatatatgtgtatatatatgtatatgtgtgtatatatatgtgtatatatatgtatacgtgtgtatatatatgtgtatatatatgtatacatgtatacacacacacacacacacacatatatatatgccattttctttagtcgtctgttgatggatacttagtttgattccttgtgttgctgttgtgaatagtgctgcaataaactaggagtgcaggtatctttttgatataagaaggaaatctccgttaaatgcatatctttcgttctcaattaatgcatcaatataattatatgtaaagaatttgctaatataagtcacaggctgttcaaatttgtctttgggagcccttccagaggcctcaacttttagtgaaactgctttatggggtgggttccattttgtcacatggcacttactaaatgctttctgaagaatctgatcattttttgggggattgtattcttatggtgctctagtgtacttttggatttttccccaaggtgatctctagtcttttcctctcagtcagctagtgtttgtggacctttttcttactaaaataatattcattcttttattcagtgaacattgatgctaggcactgttatatgaatgggatacaaaggtgaataaggcactttttctactcgtgtgtgttcacgggctttcttgtgctccaaccgctatagataactccgcctctttaaccccttctcttcccttttggttgtcttgaatcctgctttttaccccttcactccaaagctgaatagccttggtagagttccaaatttaaaaaaaaaattttttttttttgagacagagtctcgctctattgcccaggctggagtgcggtggtgcagtctcagctcactgcaacctccacctcccaggttcaaacaattcttctgcctcagcctcctagtagctgggactacaggagcatgccaccacacccggctaatttttgtatttttagtggagacggggtttcaccatattggccaggctggtcttgaactcctaacctcatgatccgcccgcttcagcctcccaaagttctcggattataggcgtgagccaccgcacccagccaaaaaattttaatttttgtatttagctgggcatggtggttcacatctgtagtcccagctacttgggaggctgagacagggttttgccatgttggccaggctggtcttgaactcctgggctcaagtgatcagcccgcctcaccgtccgaaagtgccgagattacaggcatgagccactgtgcctggcctgacgatatatttgaaagttctgccccattctgaatcacgaacttaagaaatagctactcagtattctaatagagatcattattatacgtacccttctagtctttttacaaacacatacacatccatctaattgtcttaaaatagttttcttaaaaaacaggatcttgtaaaacatactgctttgtaacttccccccatgtggtagtagtatattttaaagatctttccaagtaaatatacacaacattgtattccactgtggatgtattagaatttgaattgccaaatgcctattgttgaatagttaggctgtttccagtttcctcattatgaatttctttgtatacttgatattatttatgtggaataatttccaaagagtggaatttgtgtattaaaggatatgtataatttagaggcaattgatgatatgtattgcctaattgtcctacaggaaaattattattttagaaaagtatattaattgaagtgccaatttatactctaataccatattataattaaaaaactatcattttgttggatgaaaaaaagatcttgttttaatttaaaaaaatactagagaggttaaactttcccttatagggttatgggtcattaatatttattttgtacattttctatttgtgttcttttacaatttttgttctgttgggctgttgaacttttaattattgacttgatggagctatttcattttttagagacagggcctcactctgtcacccaggctggaggcagtggcgtgatcatagctcactggagccttgaactcctgggcccaagtgatcttccttcctagctgtgcagagcactgggtttacagaattgagccactgcatctggcctgatggaactatttctatattaaggctatcaatccattgttgcccgtataccaatcatattttcttcatttgttacttgcctttttactttccttttactttatttatggtacattttgctgtactcatgtttattagtaagtgccattattggtcttggctcatcatggttattgtctcttttctcattctatgattaaataaatatgcacttacatatttaattttttactgcagtttttattcatacagaatgagtgaatttgaatatatggcatgagacgggtttatttttatgaattgttgtctgtctagtagttgcttgggaattactgaattattgaattactttgtctttttctcactactatgagaaattattgtatactaaattcttaaaggtatatccatttctgaacttagtattttttctattttttttttattctgctgtgttggccatctattcatgtactagcagcacactgttgaaatcattatagttttgtcatgctttttttttttttttttttttttttgagacaggagtctcgctctgccgcccaggctggagtgcagtggtgcaatcttggctcactgcaacttctgcctcccaggttcaaaaaattctcgtgcctcagcctcccaggtagctgggattacaggtgtgagtcccgtgcctggctaattattttgtatttttagtagagatggggtttcaccaggttggccaggctgttctcgaactcccgggctcaagtgacccgcccgcctcagcctcccaaagtgctgggattacaggagtgagccatgtcttgctttaaataaacgcccggccttgtcatgctttaaataaactttaggctgctgggcactggtttatgcctataatcccaacattttggaaggccgaggcaggaggattgctcgaggccaggagtttgagagcagcctgggcaacgtagtgaaactaaacctctacaaaaaaaaatttaaattagtctggtatggtgatatgcacctgtagtcccagctactccagaggctaaaggaggatcgctagagcccatgaggtcaaggctgcagtgagctatgttcacaccactgtattcccgcccaagcaatagagcaagaccctgtctcaaacaaacacacatgcttacatacatacatacattaggctaaatcttgtcacactttattttcaaagtgtttcctggttattttcatttttatttcagattaacttttaaaacatttgtaaaattctagaaaaaaatctactggtattttgtttgtaatgatttgagtacacacacaataggggttgaatggacacccgactatgttaacttttttagatggtttagtacaaaaaactaagggcctactatgtgcaagatgcttatgtttagacaccggagatacagcattgaaaagataaggcatcctggatcgcaaaggttatttagaagtggaattgacagaatattgggatggactgtagccagaggaagtcttaggatgattgtggtattttggcttggttagctcagtggaaaataatgctatgcccagagattgaaatataggaggaggcacacatttccaaaggactatgttaggtttggttccacatataactatcaatgggatatccagctagagttgttaagaaagcagtgagacctcttggtctggccctcaggaaagtatccttccttggagatatggacacctggcagaatttgttgcatgagatgtgaaggcctgtgtcagacgccagacaggttgaagccagttcagaagatgaggagatgaggaagggccagggtccaagagaattccattgcactcctagagatagctaggagaaggatgccactgcagaagaagaatgagaagtggctaaacagatcaaagggcacccagaggacaggtaagataaagactgaaaggtatgttttgggttaaccacaaaagagttggtcttttcaccggggtggtttaggtggaacagtagtgatagaagccccattgcagtgggaatgaggttgaaatatgagaaagtgatttcattattatcgtcagttgttattttattctttctattactgaagaaacttcggaaccccttctaaagagaataaggagtccaattgttttgctctacctgtaccttcaaatctatatttttaaataggaaatttcttatatatccactgtttactcatactaagtacttggcaatgtgatacgttctgggactgagttgatatgataagaattgatatgtccccatttccttatgggacactactctctggcaggaggtgttagacaaataattatacaattatatacaacagttgtggtaagctctacaaaaacagattaggtagtacgatattgcttataatacagtgggtaggataggggagaggtcaaggacgccttccttgagtaagtgaatttgagctgagatggattttctagggagagggaaaggccctgaggtgagatgaagtttgcagctgattaaaccaatgaggcatgagatgagataagagaggcccatattaaatctatctaggttgttggtcatttgaaggtttggattttatactaagagttatggtaaaccattgaaacactttaaataggggaatgacttgatcggatcattagaatgtaaagttcttgagtgtagtgatttttaagaatttttgttcactgacctgtccatagtgtttaacagtacctagcacattttatatagctcagtaaatatttttgaatgaatgctttttttaaaaaaaatgagtgaaacatttggttttacaagaagttttcatctgttgtttcatgtaaacagattgcagtgtggtgtgagaggttgtaaagtccaagtggaagatagtggtggcttgtatgctagtggtggcagtggaaatggagaggcacatggaggaggcagaataatttgatagtggcaagtgtgggagacgaagctacttgggatattttatacacgaacagcacagtaccattgatgaagttgaacttatcctgtcctttttccaaatacttcttccagctgggttttggcattggtttttaacatcaccatgcacctctcggttcctacttattcgagggcatcttactgagctgtgttaacttgagcaatacttctgaaatatctcctgaattttccccttttctccagtcttacagccatttccatactgaatgcctgtgttctatcttgcctagactattgctatccagtactcctgccctgttgccacttttatcctattcatactgtgctctcagatacactatagaaatgaacatctcatttggctgcctaaaatctcagtgccttttcattgcctataatgtaaagactaaactaacagtactttttttccccctagagtacattcaattaaaatcaagaaatgttcatttaaactcctgctgtttgcttgtctacgatttagccacaggtacataccctgggcaccttcctgattgtctctcttgatttgctaattactatctggatgatcataactgactctactgagtgtctgtgctaccgtttttctgcagcagctctctgaaccttctctataaccttctttatccttgtcaaataagacaaatgttattagagtaataattgtcagttctttagatgataaaaggtttggatcactaatgacttgtttttgttttttgtttgtttttttttactttccagaatgaactacagtttgacaacaaaatgttaacatacatgcttatgttcagttttggggcccttgtgataacatgcatctttctcttctctttggacaaggaggagtgacttctgttatttgggcaacttagttttccttcctaagtattgttaaccttaagtagacatttgctatttgcctgtgccaggggctttaaacttttctttgttaaacaaggacccttatttttaaatgagatcttaaatagaacaccagggtgtaagtcagattaacctggaactagcctatttgaagtgtattgacttcacctatttgaagctatttgaagtgaagtcgttagatcccaggctgccacttaatatccatttggtaccttaggtacctccaagaagtggtgattagaataagaagcaagagtcactggaataaaggtggtaacagctgtgggagggatgacatttctgaaggacttagacatacaagtaatgcctggcatccaccagtattccaatgacagcagatctttccttacttcatgaaatgagtattatttttctgtccagaaccaccatttgctctattgaactgtcttaaggatttgtttcaaacagctaagttatttgattaaaatagtgataaaattgaaaaaaaaaaaaaaagaattactaatatgtctctagctgttttggcagaaactaacctttcttccttcctttcatccatccctccctcccctcctccctcccttctttccctccttccttcccacccccccccccatttattccatccgtctgtccatctgtccgtccatccaatgcctactatttcaggcacttttctaaatgctacagagctaacaaaacagagaaaaatctctgttcacgaagctgacattatggatggggacacattcaaaaataagataaatgtgccatgcatagctagccggataagtgctatagaggaagggaaggggaattcctgttgtccctgtatggagatgagccaaacatttttttgaaattagttttccaaaaatagtaatcgattgccatagatttatctcattctcttacctggtttccctcttaatccaagttcactcccattaaagaccatagggatgtgctgcagtcatctctgattctgggccagctgctgactggctcatcccaggactgtgagcctgtggccttgtcctcactggcatggtcaccttgatgtttactgatcacctgaactgagaatgtcttgtgccggcacttcttcagagctcatagcttacatatctttgggcttcagacttgtttttcctatctcatcatcatcaaatgtagaaacccagcatataaagcaactgaaaggtctgaatggcagcggaagatgtttaggatgaggctccagacaatcctcctgctccccatccctttgggctgccttgtcacctccatggacttctgccacagagctgttatttctagggtaacatttcagagtcattgttctaggatgccattgtccttttctgatgacagaagtgttttataactgagctttctaacatagtaaccatcaggcacatgtaaatttgagtatgcagctagtgtgactgagaaacgaaattttaaattttatttaatcttaattaaaatttaaatagtcacatgtggctagtggctactgtattggaagatgctttttttgtttgtttgtttttctttttttttttttttttttgagacggagtttcgctctgtcgcccaggctggagcgcagtggcgcgatctcgactcactgcaagctccgcctcccgggttcacgccattctcctgcctcagcctcccgagtagctgggactacaggcgcgcgccaccatgcccggctaatttttgtatttttagtagagacagggtttcaccgtgtcagccaggatggtctcgatctcctgacctcgtgatccgcccgtctcggcctcccaaagtgctgggattacaggcgtgagccaccgcgcccggccgtttgtttgtttttgagactgggtctcgctctcttgcccaggctggagtgcagtggcacgatcttggctaactgcaagctccacctcacgggtttacgccattctcctgcctcaacctcctgagtagcttggactacaggcgcccgccaccaggccaggctaattttttcatatttttcgtagagacggggtttcactgtgttagccaggatggtctcaatctcctgacctcgtgatccgcctgcctcagcctcccaaagtactgggattacaggcatgagccactgtgcccagccggaagatgcagttttaatgtaatgctagctacagatttaacgtttactgagtgcagttcatatcccagttttccagatcatgaataaaatgacagtagttttagaggataatgaactttgagaaggcatggattaagacctgacttaaaaccttgggcaaatttttcaatccctctgagcctcagttccttttttataaagtgggcaaatttatagtaccttttcatagagaggtttaaagtgagataaaccatgcccaacatttggcacaatgcctaagcctgattgtagctgatttatcctaatagggttttgttgttgttgttgtttattggggcatttctttggcttgtaaaatgtaaaatatgcccattatagaacagagaaaaataagaaaataaacataacctgtaccaccatccacagacaaaacaacagaaaacttgtagaatgtagaaaaaagtatgtctttggttcacaatatgcttttctctttgttttgaatgtgtacatgtatgactacactgacactactattgtaaaacagtttttagaggccatagatcatatgtgtataaattgccttacaaactttttttctaatatcatatactaaaaagtctcaggaaatatgtggttactgagagttgttagaaaactggtgaattgaataatccagtagtatttttctagatttatctttagtgattaatttttccagaatataaaaattcttttggaattctttttggatgatgagaggaaaaaagagatacatagatgatttcatcttgagttaaagctgtgtgtcagatactgctaagtgctgggactataaaaacaaataaaatgtcatcattgctcttaagtaaattgtggtctaaatactgtgtgatcagtgctgcaggagggatctagacagtctaatatgagaacttgggacaaacccggccagctggggatagaaaggttgtcagcaaaaggtttctggctgaagtgacacctgaaggaagttttaaaggaatgatggacttaattaggcggtgatggggtgaagagtattcaaggaaagggatgcagtgagtatgaaagccagagtgaccatgggcatttggagaactgcagctgtctagtatggaggtcagaggtggggatggggtggatggcagaaatgaagatgtgtctggagcagctgcaggaaccagatgggtcacaaaggtctttctatgtcctgttaaggagcacagactttaaggttataagagatgtttaaagattacaagaggagagaggcaggatctctggtcacaccattggcatacatagaaaaataactggatgtggtttggagaatgtatcagagacgggtgggagtccattcaatgacttgttgaataggtcaggcaagagatggtagatgattcaggttgtagaaatgagtagccctctggaagtttgggtctagaatttgggagggatattgactagagttattctcatactggccacggagtgaataaagtcaccctttccggagtgcttaccatgtatcaggcatttgaccaagaatgcaatacacattatttgagtttattcccacaatacaggggttgcaaaacatggccagttttacatagaggatggcaaattccagtcctgtctctgaagcccaatgataacacaaatgaaatcactaaggaagagtataaagtgaaaatttgaaaagggtctaagaaggaacttaggggaaaatgtcagtagttatcacagagcaggaaaaagaggagcccttaagagactgaaaaggagaagcgaggaaagccagagaaagagagtattagactcatggaattctggggatgcaaatggttcaaggaggaagtggggaagtgtcagatgctacagagatgtcagataaagtagtgtacatgtttcttggattaagaataaagagacaattgagaagaatttcagtggagtttaggaggatatcttgatgctacatgccagggttgctttttttttttttttttttttttttttgagttggggtttcactctgttaccccagtggcaggatcttggctcactgcagcctctgcctcccaggctcaagagattttcctgcctcaacctcctgcgtagcaggaactacaggcatgtgccaccatgcctggctaatttttgtattttttgtagagacagggctttaccatgttggccagggtggtcttgaactccagtactcaagtggtccacccacctcaacctcacaaaatgctggaattacaggcgtgagctaccgcactccaccttgcatgccagggttattttatcagcatttcttggttttggtgaaaatcagctcaatctcggttttaggcaaagtagggattgtttgactaggaatctgtagaaggtttggaagacccaaattgtaggaattttacagatatgacaagtccctcgtattcactagaatgagggactttatttactactaccatgataatctctcattacttctctttgcttttttctgcctgttagttgctggcttttgtgctgtagacctgctttctagatgtggagggtagtagatggtgcagttttctaccctcaactctaaatataaagatcttggagaaggactgatactgcctatcttggactaggtgctatgtctgggcctgttggtgtcttgggtacaagttcatgaaagaacatggtagttcccaaggtagttatgagattagagggaatggcagtttccagcatgggaagagaaatgtttagacagacagtcttataggtttctgctcctagtgcatggaagatggagtgggaaatgaagaaccagagaaagtgactatagattctcttttaagagcctgggctatgaaagaaaatcctagtgattgttttggtgacaactaaagagggagaattggactttagaatgcttattttataactaaatcattgatgaggagtgaaaatgtatctgaaaagaggaggtagacattaattttaatgtttatgggagaaaaatggacatgcagacattcttgtggacatggaaatttatgtgaacagaagaaggctagttatgatcatcactttcaaagtgattgtatttgtggtcacttcattatcaaatatatgttttcagggtggtcatctttgtgtttgtaatgatcataagccatatctatagaaagaaaccagagaatattagtatttgcaaaagatctttagaaagaatacaacctaatatgcttaattcatagataagaaaagtagaattcaaaaaagtgaagggaagtaattacttacagataaaatagtgcctattagaagagaagggactatttgctccctgggtccctgtttagaaagtgaggatgtctttctcacaacctcttcagtagacctcctttcatggcccattgtccagaatcgaatcacatcacccacctctgaagcctgctattgagaaagaaactgtgataatctgactaatgtgcaacaaggagaatttgcccccaaagattgtgggaagaggaagagtacctgaacaaagtcagggctctccagcaaggaagaaagcaacaagcattgctaagaactcaacagtgtttgcaacatggactaagctaaagaggttatattttattccatggacaatgggactctcctgaaggttttagatcagagaataggtaagatcctatttgtgtttcagcaaaaatgctattcataaaacatctatggtcttagtccatttgtgctgctatatcagtaccttagactgggtagtttaaacaagataaatttatttctcatacttctggaggctgggaaatgcaaaatcaaggtactgacaggttgggtaagggcctggtctttgctctcaagatggcagcttgttgctagaatagtgcctttttacatggcagaagagatggaagggcaaaagtggcctccttagctctctccaacccatttgtaagagaccgatcccatccatgatggtagagcccttatgggctgagtgcctcccaaaggccccagttcttaatattatcacattggtgattaagtttcaacacatgaattttgggaaacattcagatcacggcacctgtgataagacatgaggtgagacgtcattctatataagttagttgcaaagttgaactaaatttcaggtctccagcatcttcccattgttatctacattctatcctctctctgtgtatactgttgatggtgtgtgtttgtcttttaccatgaaatttgatatctttgaacggataataatatagggaatggatttctaatagttagaaatgtaactatccacaattatattactacatatttattaagaatcctcctcaggaggaattttaaaaaatatcgccatcaagtgcttaccatttgcattggttggaatgtttgggtgtataatatatacatgtgtccatcatacagaagggctgtgataaatgttaaaagaaaggcagaggtaatgtgatatggctgttgctcggggcagttgagggaagctgaaagaggatgtgtgatctacagtgagcagtgaagaatgtgcaagtgggacgggtcattctagatgagggaaacagcaagtaaaagaaaggcagaaaagccagggagtaccaaggtggctggtatttgatagagcctaggattgagagaaaagtcaggaatggatcatggagttgaagacacaagagaatgaagctcacacctgctggtacctaatataagtaggcacagtgctagggtttaaaacgtgcaatctcattcaatttcaccacattcctatgagggacagaggatcatttttgcatttttttctgatgagggactgaggctcgggaaaactaacttgcttgagaactcactactaatggtggagagagtcaacatttgaagccagtctgccttaggaagttattctgttatgccaagtatcccactgtgtcatttcatgattcttagcatcttagtgtttgactttcattctcgggcattgcagaagggttctgagcaggaatgggcattaccacagtgctcatcagggaagggtggaggctggatggagggcagaagcgaccagcaccattgttctggtccatggatagtctcctgtaacatctgacacccagacattggagtcactacatagcatcattttcagaactgtatttgccatcttttccagtgaaataaaaattaaagttctatacccaccttgatgcctctctagcttccttcttctttcctgtttcctgttacaggacttgcatttcactttggcttatcctctctagtacataccttctagcttagccaacacttattcaaatatgactaactcagactaactactagttgtccaagaagttcctcctaatccataacatctctgagacttcgataattgacctgataaactgatagaaaaagatgtaccacctaccaatacttgaactccctttttgttgttgttgttgttgttttatactggtcctctctagaatgctatgtaaacaaggaaaatgcagaatacctactttttgtaccttagaaacacatctggtgctatttgaactaactaaaagtaaagtaagtgccatggcagattatgccataccttttctttttattgaaaaaaaaaaaaaaaaaggaaatgggaaacataccacttctagaaggccctgacactgaactggatattgaaatcatataggtaatgtattaatatatgccacatttgttttccatgcatcaaccatctttggtacatatgtgttggatatttgccatgtgagagaaacgttacacagagggaagatcgtcttgtttagaagtagtatgaatcgctaaggtagaagtaaagtcagcccttttttattttacttacctttgctacatgatctgatggaggttttttcttttgcttttttcttttgacttttaatcattttgtgtcagtctttgagtatatgtcagaactcccctattgcaactaaaaaatggaaattacataccaggacactataatttccatgaacttaaaaaattatataagaaatattataacttaatattggttttaccatgtcctctaatttgaaatggagtgaaatgcttctgtggttaaatcagcttgcttgtgctgtttgctataaaagtttcaagaatatatatttcaaaaaaagtttttaaataatccaaaacaaatgcaacagggctcagcatacttgaaacacattttccgcatttatcttaaatctctgtgctccagagagtgttcatgtgtatgtggattaggcctggctggttatttcaccatctatctccatcctggattgattgcactgaacagcacagaatgagttacatatggtcccactttgtctcagtttgtaggacctctgggctggaactccatttgatcagagtgaagctaaccattgcagaaatttggctaatgtaaaaaccctgaatatatgcacatatacatatattctggctagaatgttcatattcctattagaagtagtggtgtttcctatacattgtctctgtagttattgttgacatttcaagaattaaaaaaataatctatggatgatgatgttgctgttctggataggagtcgttacaagtgtggaccaagacaatattcagatgttttcaaatcaaaattatgaatataccaaaaactttctaaaattgggaagaagataggaatacaaagattatcttaaatacaaacttaaaattgaggaggaaacttattgtcaaatttatagtttattttttttagggtggtctattttaggaaagaaaaatagccttcaaatatgtttaagtttagatattgctccttaactctataaacttgagtcaggtagggggctgtgcacattaaggtccagcttgtagacactgagggtaaaggaagctgttgagggtaacttactcccccatcaggctcttgtctctctattttgttctttttcctcctcttctttttcctcctattgctttatttatttttttgttactcccacttcccctccccctcctgctcttcctttctctgtctgtgcaaccacgtgcttcaaatctgtgtatctggactgccttctctaacagttccgtgtgagtgttagcagaatgaaaaccagatggaccagcagttcccactgttatctcccagccgactctggcaagcctccctttttccctccctccttggcatgacagaaatatttgcctttatttagggagacttgtatttgctgctgtacctcttccctcagctgcaacataagtgggaagctatttattcccttgttgctgaggttggttgaggtgagtagaatgtgcaaatgaatttaactgttgaagaagcggttttaagcctgcctaacttctgtatttttctagaataagtgacttactggttgtagcaatctgaagacaagtttttaacaatagataaaggtgaaaatgctcttcatgtgtgtctctaccatcctttcactcagaacacttttattcactatagggacatccgttgttattcagccagaagtatagattcagaaatggagaccctgatattgctgttaactcatcaataataataataacagcttattgtgcaaatactcttattagaatgatgattattttcattctcttattgcatcttccctaaagtgatatcaacattatttcaacttttaaatgttgtgttttattgcaacccaagtgttaagcaattgctttgaacaaaagtgaggtagatttggaattgttatagtagtaatttgggtttttctttttctttcaataattgacctttaagtgattttgagattttctcactgtggttattataacatttttaaaggcttgttctttcttaatagttacttcacttttctaaaagcccaagtgtgagatatttgtgtctataactgcaagaggtgcctcaaaatacgttgggtgtgtgtgtgttcatgtgcgtgcctacacatttgtgaaagaattagatctaaagaaccaaaaatagagactctgatactgctgttgactagctcatcgtgcaaatgctcttatttgaatgatgattatttttattcttttattgcagcttccttaaaatgataccaaaattatttcaacttttaaatgtttattataaccaaagtgttaagaaattgctttgaacagatcaaaaggtctgttgctttgataagtagattagattgagaaaaacagttcagaatgtcaagggaaaagtatacttacagcagttctgaagtatgaatgtccattattgggtaatcaggaaatttcttcatatctgccacatactcatgaaaaaaatattagcagtgtctagttctttttagttctctgtttgggacttttacattcttaactctgtttgagattattaattggagtattggtttcatgcttttaaaatggcaggtcataaatttacaccttttaagtaaataatagtttcacttcattgtataacacatttcacctatgtagcagtgatttttaaaacagggcaggaaaaattgaaatgcgaaatatgcctggaagacgataacctatttcatctaataggccagaaaactaaggacagcacagggatggcaggtgtaagagaaaatcattacaaagagctggctcctaccagtatctcacctgcataacagacttcaggtttttgttatttctgagctgtcatgaggggttcattatcatcccacttcctcatctattttctacctcttgctaacattggcttcagcttccagtgcagttgtgctgctgcatataacactaccaaggtagcatctgcctaagccagaaataacaataggatataatataacctagttacaaatgaggtcctgccatctgtgctataccttcttaagtggggtttggatgataaaatcctgatttaaacgtcagtagataagtgtattttattgatagaagatgttgaatttcttctgttcacttgcttttaaaaaagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgtgtaagtagtcatttcaggcttttgagtttcagttttaaagtttaaattaaatttttttctgcaaatgaaaaatcaagggaaaataaaattcagcatcaatgtattatgcagaaatgaaccaaaaaaaatcatttgtttgccagtaagtaggtactgagcacagaagtatcatagcttaggtctaatttgtgtgactgccaatatttgccttccttttcattattgcttcgaagttgcagtctgctatgattttagcaaatgaagcagcatttggtctgtaattccagttgttaccactgtaacttctaattcatcttaatgtggagctctttattttagtttgttcagcatgacttggaacatggaaatgtgctattattatttctaggttacttcttctaacaccattttcatctatttcaagtggttacaaataatgttaaaatataatatccttgtgttaaaaagggtattgatatgcaacaatatcatacagaaaactttctgaagtgagaagtgcctttcttgcccttttttttgggtggagggggaggacagaatctcgctctgtcacccaggctggagtgcagtggcacgatctcagctcactgcaacctctgcctcccaagttcaagcgattctcctgcctcagcctcctgagtagctgggattacagtcatgcgccactgagcccagctaattttcatatttttagtagatacggggtttcaccatgttggtcaggctggtcttgaacttccgacctcgtgatgctcccacctcggcctcccaaagtgctgggattacaggcgtgagccaccgcacccggtcgtgtctttcttgtcttgaacctgtcagactcttattaaaactttactccattcctgcttggctcaagttctgagttctctcaatagagtgtattgctttcagtacagtccaaaggaaaggatagagaattctgacagaattgcaacttcccattctttcctgtgtatttcattagggatagtgagtaactgttttaataaatctcaaagtcctggttgaaattgtcatcaaggaattgtgaaactaataaatgttatcggttgcagctattttgcacaccatgtgccatgaaatccatatgaatgaaaaataactaaaaggcaaaagtagatctttgggactataagggattagcaaagtacgcatctcaggctgtttatgcagtgttgcactgccatttaaaagacctttccaaatgtgtaaggagcaggtgactgtgcaatgccaagttgtaaccgtgtcatcttatatttggtttgttgttacccaaagccacaggggtaagcatatgtctcctgtgagatgtcctggtgagctggcatttcttgacaggttattatgatactcagttgtgacaagagaaccattttattatgtcaaaattgaacttttaagcataacatggtctttaaaacattttcaaactatatcaaaattatattaaaaagatgggtttgataaaggtctgcttatcaaattaattgacttaacatgataaaatcaacattttctttaatgcaaacgatgcagatttttaattctagttcttatggattatcaactttttgctttctttttatgtacttattaatgtacatattaatgggttacagagtgacagggattatcgtcttgatgttcaaacaaattttatcagaaatgaatttactgaattatcaccactccatgctcttggctggatttaggtgtccctttttgatttcttgaagtaactccttgttaaacaccatatccattttggctttgtacataaaatatgcatttttcctaaagaagtggttaagaagtatgagggggagaaaatagccttctaattgggtggtggaaggttaaaacttgaaagtcctattcctataaacacagctgtcagttgtgtgtacaaaacatgattaaaaatgttcaatgataaatttagtctccaccaaatgtacactttctctaggggagcagtttggaaaggaatagtcctgttatattgatgtaagcctgcgacaaaaagctgacatccgaagctgtctgttctatttttgaaacatttcaggtggttggcatatgtgcacatgggaggcagggctggccctgggttgcagcagactccatttattgtcagcctctgtgcaggataccatcactcagtatgaggagtagacccatttagttatagagtacctgagaatgtagtaaccctgtgaagtccaagcatttttaaaaagtcccaacatttaaaaacttataaaactagtagatgtaaaaggtaggaaacttggtggcaatttcctcatgcatgttctctgtaagtttatgacttccttctgattttgtgctcttgacagtaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtggtaagcaaatggaaaccaacccagttttcttggtgtaagggatagtgtgggtgggagactcagacatgtagacaccgttctcgcaagtattttgttataatagtttctacatctgaagattgtgtgcaagtctgattcatgctatagtgacagtcttttaaattctgcattatatattgaccccaccagagttttttttctcactgtttgactaataaagatatggttatacaaatttattgttatattggccataaacatgttatatatataaatgtgtgtgtgtgtgtgtgtgtatgtgcacgtgtatttcagtatttcagtaagtacactttcctggcatgcctagtggttttcaatgatgacaaaatggttttgttatgttgagtcactcaatctaattggatgctcattttaatttcattgctttagcggatttttatcattggcccagatgaacaagaatttgtaacaacacattcttcttttatctagtgtcatttttaagatgaataacattgaaattttttattgtggtaaaatatacatacagttcatcattttaaccatttttaagtgtacagtttggtggcattatgtatattcacattgctgtatagccaccaccactgtccatctccagaactttttcatcacctcaatccgaaaccttctgtattcataaaacagtaactcctcatctcttttatccccagctcctggtaaacactaattcttttttgttaaaaaaaataaatctttgttataggtagaattaccgaaaccactagtttgagaagagaactgttggtttttgcatattacactacgttctgcacattgtcacactagaaaatagaacatatatctttttttgcgttctaagtcacttttccatgtgttgtgattttctgtagaagtggaggattttcgagtatttaggaaggctagtctcccatatcaaactgagtcacggagaagctatgaatcgtatatgcagttctttcattgtccagggttatggtcgtctccactttcttgaaatagattatttatttttattatatggacctatcaggggcaaagccataccagttgtgttttgcaaaagaagtttcagaattagaagtctgggtaagagactagctcagaagacatgcttcaaatcactatatcccacatttgacagagattttgcaatttaatttttaaccattaactgcctctcctccctactccaagaacaaaagacttccatgtttctcacagtccatcagctccacctcataaacttccaagacaggaaggtgattttcacaaaaggtgtgttggcatacttcagatacttttgtcagtcacttatcttttcctttttattcattcttgaatttgcataataagcttttttaacatgtaaataagttagaccaaggaaccacaaagtaaatccaaagtaataattgtatcaagtaaatggtgaatgtgttgttcttagcaaaattttttttttttgaaaattgccttataaatttgacatgttctttattaacagtggttccataattgaaaatgcagaaaaacttggtagctttaagtagatttttcccaagtggcatacttttgtgtgaaatacttttaaaaaatatattttttaaaatctaaaagcctagagaggaaaataggggaggacattaattcattataacttgcatataataggcagtaaatattcattgagtagcagacttctgttaaacatttggcttacaagccattttacataattctcaggactaccatttgagagagtgatttttttttttttttgagggagtgatttttatacacatttgacacatgggcaaactgaggttatagaggttaagtaaaatatgcaaggccacccaactggtagtgacagatttgaacctaggtactaaatcatgctgatgcttaggtggagttaagaaaatgttaggaagtactgtcttttttgttttttcttttaaacatttttttttagtaatttttttgagacagggtctttctctgtcacccatacccgttctctgtcacccaatgcattcgcatcggtgccagcaaggctcaccgcagccttgaccttccaagcataagcaatcctcccttcccagcctcccctgaaactagaggcacacaccaccacacctggctaatttttttgtgacatcatctcactttgatgctctggctggtctcaaactcctgggctcaagtgacactcccaccttggcctcccaaagctactgggattacaggcgtgagccactgcactggaccggaagtactgtccttttgaaaaggagtcatagaaacaaaatgatagattttaaaaaattggctccttgacatttattgttacacataggaagttattgtttattcatagtttcatatgaagatgttttgagtgtgggggtatgaagaacttagaacttggtgctcgtgtactttgttataaaaggaaacatgcacaaaaaagtgggtggagcaatattgtaatgacgttaggtcacaaattcccaaattttgtcagtcatcagaattattgaagggactgaagaagttgagaatgagttgtgatcctgcctgagaaactaaagaaaacgaatgaaatgagggttaatttactcaatgcctttataattgctttgttgttcattaagtagatgcttttaccaacacacattatctattgtaggatacaaatcctgagtatttggggcttgtttttttatataaggtaggttagaagtgaatctgagttaattttgcttagtcttgtttgggtcaagcagttgcctctaggataagtggaatgtcttcgataattgggatttttctttcaccttctacaaaactcattgactcacagaagggtcaaaccttttctttggctttattggcatagcacactacccaactttgatgttcaccctgagcaaagatgctttggcagacaaagaaagaatacaagatggaaatacaggaggaggagaagaatatttccaccagcagtagtgctgatgtgacacgtgggataaatcttgactgagaattctgacacttgccctcggtcctttaagtgatctgttatgcttttaaatacatccaagtgtgtttgttttccataaaggcaatattagaagattcttcataattgcaaagacttctctgataattaaaccatgctagtgatcatgcacattatcctcaaagtactatacataatgtgtttcattttcagatgtaggttttagaagtgagtgatgcaataaactgtgtgatcatttttacaaagtcaataggttttattgaaaatactggtttctgtcagtatgtttgcttgttattacactgtgttgtaccagtcttaataattaatttgtttgtgtttttactatttaccaacaggctaatgtatttatactacatattttcttccatagaactccactttgacaattgaagaatttcattccaaactgcaagaagctactaacttcccactgagaccttttgtcatcccatttttgaaggtattgcacagttcactggtctgtaaagtattttaaaccatattgttgctaggtcataactgtgtgcttttttagtacatttaggggctctttgatttaatttaatggatgaaaactatctgaatcgattgtatttatgaccatttcctaagtagtctgaaaattacaaggagtgttttaaataattacctgaaaagaagtaaagtttgaagaagagtttagaagtctctttgaataaaggttttgttcatttttttggtcatatgagatatgttattttacattttgcttgtctttagagtgaacagaagattggttgagctttgtagttgttcaggatttttttatcctcctaattttatctttgtaacaacttaacgggaagatcagaccgtcatccttttgtgccagtgaagaagttgggagtaagtgacatgtccaaggtgtgcctggctgaggactgattgaggtgtgggattcgaaatggtttttaagtctctgctgtgagctttctgtctcctccaactgctgccacttcagtaaagcaactggaaaacaaacaaacacaaagttcacaagagaaagaaggaacatttttattcagcatagcgggtagttaattcactgatggatactaaaataactggtagttttggtagaaaagcagattactaagatcccttttacttgggtaagcatattgcttgggcatagtggattctcaataagtttatactaacagtgggcttagcagattgataaatgtgaaagtttcatttgcactcccctttgaaggtcactttcaaaatgagcactcaaggaagcctctgatttaattatttgccaaggaggatttacctttctgtctggttcctagaactttgtttgggagacaccagaaatataactgatcagatcctgtgtgaaatttcatctatttttaaaactgtatcagacacataaggttcaagtaagtatccagaagcctagaaaggtttgtctgaaatgagccccaattctgaactttctggatattagtctttcctgttgttattattaaggtgaaatgaaatattctgctttgtgagtacctacaaaccagaaattagatctgtttgtgtggaaacccagattacaattatattcttttcgttcttttctaagttgtacatttaaggttaaaggtataatgtgttagtgttttctcccaaaatggcttatactataatactatattcttatttaaaagcaaattgtttgttgaacaatttgaacaagtttgttgagactagaatctttgcctttctcagaaagcgttgttttctgtaaagatttcatcatatgaatgccatttcctgtgcaaataccactggtttctgtgctaaaaaagaaaaaaaaaaaaaagaagaagaagaaagaaaaaataggctcctttcagggtcaagttggcagccaaaaaaaatttaaaaagcttacaaggacacttccagattcttctatcactgctgcacaccatatggttaccatatcatttagttgggatcattggaatcaaagatataacttttttttctaattttagtgcttttcctcaaaggagacattaatgacaaaaaccatatggttgtgggaactcgggccttaataagtgcattcaaacactgctgtaacaatatgcattaaagtcttgttttcattaagctaatgtaacccgcagaccctctattccattttgcatttatggagaaacatttactggaaggatattagacaccattctaattacctaatctggcaccagaattagagcaaacaaaattgctttgtattaccatattttttaaattggaagaagatgtttatggaatcgctaaattaaactgagtaccacgtgtggaagcctcttgtcttgtaccatccatacgtttaaatttgaaactggaggcatgcatgtttcccattagtcactcagctgtgtggcaatgaatgtattaaacatgaggttaggagcctaccaaaacacagataagatgaattctaaagaaaacttcttcagtgaaagcagtcatagatacagcatcttttcttattagtatcttaatttttagacatcaatgaaaaagtttatgctttaaccacacccaatttctatagtctcttttgtgaaaatatatttgcttcatcctgaaactaagaaattgctatctatctataacacatagccaaataaatgtgcattttataacttctctccagaagtactatttaatgtatcttaaaaatcaactcttgtactgaatatattaaggctgtttctggatgggagccagcgaatgctttgccaaaagacatctgcacacaagatgtccagcctgtgagtcaattctcctgattatcattcaggaatttgtctctctgagctggcataactatgtttgcctgcttggttcaatattgctggcattcttaacagaaggaatatgattgttttagaaaggtctctatatgttcagatagagcctttacctgaggtcccagctgactctatttaatacagaatggcacatagtctcgtgtgtgtgtgtgtgtgtgtgtgtgtgtgtgtgtgtgtgtgagagagagagagagagagagatatgtggcacccaaataattctttttgataagaagaatgtgggagacagtattagtaaagtcaagcaacagtcttcacttcccccccgcttcctcatcgttctgaatatcatgctctgctaatagagtcctgaagatactgttttttgtctcctcatttgttactccatttcttgttctaggatttcttatctttgggatccctaaagaaccaagagcagagagctttgcagtgtattgttttggacaatttaaatcttatgcatatacagtcatgtgctacatataatgtttcagacaatgatggactgcatgtacaatggtagtcccataagattataaatcatatttttattgtgtccttttctttttctttctttcttttttttttttttttttttgaaacaaagtctcgctctgttacccaggctggagtgcagtggcacggtcatggctcattggagcctcgacctcttgggttcaaacagtcctctcactttagcctcccaatagcagggactataggcatgggccactgcatccaaccgattttgtattttttgtagagatgaggtttcaccatgttgcccaggctggtctcaaactcctgggcttaagtgacctgcctgccttgacctcctgaagtgtttttctatggtcagagatgtaaatacttgtcattgtgctatagttgcctacagtattcagtacagtacatgctgtacatgtttatagcctaggagccgtagactataccatatattctaggtgtgtagtactaggtttaagtacccgcttttgatgtttgcgtgacgaaatcatgtaacaatgcatctctcagaatgcatccccattgttaatcagtgcatgactgtacttcagaatgattttttttttttttaattagactgagtctcgctctgttgcccaggcaagtgtggtggtataatctcggctcactgcaacctccatctcctggtttcaagctattctcttgcctcagactcccacgtagctgggattacaggtgcgtgccaccacacccagctaattgtttgtgtttttagtaggaatggggtttcaccatgttggccaggctggtcttgaactcctgacctcaagtgatacacccacctcagcctctggaagtgctgggattacaggcgtgagcaagccactacacccagcccaggatgaattttaaaaactttaaaaatgttcacatagaaatgttatttttgctttattattttatgacacaaggtatctaagctctctctttactgaggacaaaaaatagtttaaaaaatatatacaatatattacccacatgttcatctttactaattacaaagagtttaattttagcattgttatcctgtaggaagtcatttccattgttacagtgtatggcatgcatttatctttagcaaatatcctagtattttatatcttgtgtagaaatatgctttggtgtgattatgagatggtttcttgattaatactcttagaaaactgacttgagggcggttggtgggtgaggggagagaaagcattaggacaaatagctaacatatatggggcttaaaacctagataatgggttgataggtgcaacaaacgaccatggcacacatctacttatgtaacaaacctccacactctgcacctgtatcctggaactcacaaaaaaaaaaaaaagttaaaaggagttcttcagagtaaaggaaaatgatataggccagaaacttggctctacataaagaaataaagagcactgaaggaaaaaaaaaatgaatttgaggtacaagtagccagccgtagttcctgtccatgattctctagaaggctattttttaaggctgttgggcccaaaaattgaggcagctgggacctctcctgtattcagaaatgcttttctacctgatgggttaatcggtgtacatggcacctggttcctacaaatgaaatcttcaagttgcaaagagatttatgtgattgatctttcctggaattaagtgtgattggggatgagtgctgttcactcttcccagtatcttctcctttcctctcccttactgcccctccccaaacaataataaaaataagagaaagagaaggcaatgacaatctggatttataatgtcaaagtaagttcagagtaaaatgccttcttaggttttcattttaatgcctttactatgtgtgaaattgcctctttctctcttattacatttgaaattgccagaattaccgatcagcctatcaaccagcccgttctttattcaaggtgctgacctagctgaggaggaagagtgaccagtatacaggatttcttctaacattagaagaaatatgtgtgtgtgtgtgtgtgtgtgtgtgtgtgtgtgtgtgtgtattcattccttagaataagactgatacaaagaaggcagtttacttttgtagactactagaatatactgctttatgcattaattccatctgggatatgtgactgtacccaggccattacttaactattgtctgaacttgatgactatggaaaataatctctatgttcatgtctatatttttaagtgtattttcattaagttagtacttgacaaaagatattttctgggattagcctgcttgacctttgtgagtcaccagatacaaaattgagtgtgtcagggaaactattctgaaattaattggactgtgtatatattttttataccctctatcttccctgtggagaacaaaagttcttatgattggagctaggttctcacataccgtagaacatacattcaagtataaagggaccctaaaaataatgtgccacttgcaatgttatcagtgaagaaataaaagagaggtaaagtgatgtacaagggtcagtcacctcacacttagggcaatctgcgcacatggtagcccagtgctgagaattgtgcctgtggttccagcccatggcatgcatttgacctttgatgtagctgcattgcatactcttctccagtgttcgaaaagcagagtaagtcaacaggacagaagaaaactttcagtccgtcctctcattcctgtcattcccttgcaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacaggtgagagggaggaggagcctggatgaaccatgacctttttcccatacctgtggcatgaggaaacatttcatgtcacaattaaaccgctggcctatgtcattcttgcacaatagcaataagccattgtggccatcttgagaatctggctctggcctgggattttacagagttttgaatctctggcctgggacagtttggcttttgtgtaggttaatcttttctgcttgtagtattaaagcgaaatggtgaagacgaatgatttttctgatttgccaagtaccactgatggctcttagatgcacatcaatattaaaattctcattcattatgtaatttaacccaaccacatattttacttcaatattctgaaattggctgttcctagtttccttaaaatgtgatggtttggaagcttgtctgtatgtatttcttaacacagtacagtagttatttgttttggtttgtatatgaactaagagaaaacttctgggacactagatgaactgagtgaagataagagttatacagtagagacaatagatggtatttttgctgaaaattttacttgttagatactgttctatcagatactgtgctctcataactaagaattctaagaaatgtaaaataaaaccacttctccattaaaccctacagagtaattgttgaataaagcatacacatgaaatttcccatttaccgtagtaaaataatttttatgaatacctcatcctcatctataattatcttctgatataggaatgcaaagtcttattagcatcattttgcatagtgtttttgaaatatggagaattttacaatgaaactatattcaaaaacttatttagcatatactttgctttctttctctgcttatctgttctcttttgctgcatttcatcaggcatgggtataacagcctttgagaggttaacaccctgacacagttatgttccacattcataggagcttaagatctttggagctgctcagagacatctatttgtgactgacttagctatccttaaatgtattagctgctttgcaaatcagaatgttatttaaaagccagccagtttacatactgttattacataatcctctgttaagcagtttttatgctacaatctctgtaattttgttccccttgacatagaacctcttaatagtttaaaattcctaaagcaaacagttaaatattagtccccttttgacgtattgtaggcctaccttcatatatgacctacaaacagagctactttcttattcttgcaaatcatattttgttggtcacatttaagagtaaaatagagcacttagtgctttagcttttaaagggaactgcttaatcctgatgcctgagtggcatgtccacatgatgctgaaaaccaagaggtggctcaacaataggtgatttacatgtgcattcctgtttgacctgaactgatttaccctgcagaaaatgagtatgacatacagatactgagatgttttagctccatggtaaaagaatgaaggagagactcgatggaaaattggaagaaggaaatttatttagggttgttggggtggaggagagtgtaacagggaaagatttagatagctaagataaatgtagagatgatcctgcaggcaaaattgaaaatggacacaacttactctggcattctgaactgctaaataaccataacagggaatatgaaaatctgtttcattcatttctctgtatttccagctattttcccaccagctctttcccagtatttcatatttgaatgtattgtgacttttgactatccttgcacagtcttaaggtaagtgctgggcagtatgttaacactgatatgaaaacttcatcttaaattccacagaggctcagcattcttgttttgatgctctgtcgctgtgcatgcatcagtgtatgcattcagtcaggtagaactctcctaaaaagagtctttggtctgattttccctttggtttttcatggatggttgccagagtcagagttcacatggttaatctttggatggaacattctttatcaaatggggcactgaaatatacattatatctcaaagatggcaaatgggtttccttagagttaggaggaagggtaatgagaatatgttgtgtaaatacatttgtatcttgtgggaatttgatcagagccaagaaaatatgggcctctacagtattttttctttttgcatatattttctgcatcttgtttgcatatgcattttcctcttctctggttatttatctgtatatccagatctactatatgaaattttatagagtatggagctgtctgacagcagagctttttttgttttactgaatgttttgttggtgcatatggtctgacatggatgagcagccacggtgagattttggagtctattaaactggctcattaaaaagatcaatctgtttctgtaataacactgggagccatcagtcactaaaagagggaaaaactgacacctgaggagaaaacacattttggtaatttgttcatgacatgtcatgaacaaaagagcgctctatattttgtttacaactttgggagcttaaattctgtgacgattgctgagttaatgtactaaacagtcatcatgtgtttcagggatgggttttggcaaatttaactttcttcttgtccttaaatatgattgtcactggttatgttttttttctttaaacattattgttatttacagagaaatgagtactctagggaagtctatgaaattgttttttgttttttgttttttgttcctgtatggaacagtgaaatgttttctactttcttttaaatgtagctctggggagtgtctctgaacaagtgttactgattttgtaggtctgtgagagaatattgtagaacccaaagtagaaaaagataatttttattataaaattatgttatttctttcctaaaatattagggaaagtaagtagaaaattctgatttctattctttgttaatatgtaaacgtcatttatagtaaacatttattcttttaccattctgtggtgggagatgctgaagaaaggaatgtgatcgtttgttttggagccatgtaaacgaaatgaacactcttacagatagagagtagaagctaagagccctctttaaaactgctcaccgtggtgactcgtaaagacacaagcacttttgtgtaggaggagggaaaagaactgttagataatgctttctttctttgagactgcagaatggattaaaattattaagatttaaagaaaataattgtgttaggatgattatcattgctgtctttcttttctcagagctttgatatcacagcttttcgatctaatttgccttcagtattgtgttctcacctgttatgctacttttctggtttaggatttttcttgcttaagaaatcaaaccaaataatctttgcttttgtgtgggtaacatggttgttttgtttcccattttgtaccccctactatctcaaatgatggatgttaagtatgaatccccttcttatatgccattattttaatgtaattatgctttacattactctcagtttaacgcttctaaactttcaatgcaaaggccatgtagttggattaatatgtatttcctcctcccccaagggttaaacattattctctaaaaataattggttgaactttagagttatgtaatttgtcagctgggagggatcttatagatacaccaggccccattctttttatgttttttttccttaggcatggtctgcaatgttgcccaagctggtctcaaactcctgggctcatgtgatcctcccaccttggcctcccaaagtgttgagattataggcatgagccaccacaccctgcctttttacatttcataccaaaacaaaaaaatcacacatattttaaatttatggatttgctcatgggatgttatctgtatttttttttttaagacagtgtctcgctatgttgcccaggctggtcttaaactcctgggcccatgtgaacctgctgcctcaggctcctgagtagctaggactacaggtatgcaccaccacacccagctggcccccatctttttattcttgcacaaactaaggcccaaataaattgcctaatgttgcaaagcttcttagtggagaaacaagcatatttgcatacttgaaatcttccagttgcataaaatatgttttaatgtgcagaatttaaataaggaaactcaactaagacttaagcttctcttttttcaccttactttccctcatttattttctatagttgctcaagtgggtagatgccatagtataacattctgaggttttatatatatttttaacgacagaagagccacagctagcctgtgttcctggcttaatgagtcagttagaaaatgctgaaggttggaggatcaaaggcaatcattttaaaatcatgttggttgtatttgtgagatttgttatgacagtacacaccaactaaactgaataggtccatttttttgtttctgtaaaatgaaagagatttcactatttttatctttctaaaagaaaaaatagatacactttacaaggaattgtagggtcagttgtgcaaataagaattaaatttgtataacctgcattcggttttctatgaaaaaaatgtagggattttatgacacatttatttattctagtttgtgttgcatctattatgtattccacagttgcaaggagtgatttttaaaaatattaatcacatcaattgggaggcctttcagtgaaatagcacaaaattacatttatttatttttatttatttattttttttgagatgaagtttcacccttgttgcccaggctggagtgactgatctgggctcactgcaacctccacctcctgggttcaagcaattctcctgtctcagcctcccaagtagagaggtatcagatgcctgccaccatgcccggctaattttttgtatttttaccagagacggggtttcaccatattggccaggccggtctcaaactcctgacctcaggtgatccacccatctcggcctcccaaagtgctgggattacaggcatgagccactgtaccgagccacaaaattacatttatatgttaaagataacacagttgtacggggcattttgttctctccacattccagcttcaactttaacttgttagcctgatttcttgctgctttgttagggtctaactttactgcatactcctcacgccttagtctctattccagctgatggtttctgctgtctttcctaattcttatatgccataattctattaatacctcatggcctaactcagtatctactatttgaatgaaagcttcccaattataaataatataataatggttactatttactgaacacttcagatatgctgggccctgtgctaaataattgacagactaacatatagcacttctttcctcactatcctatgacatagattccagaaggccaaataatgtgtgtgaagtcacatggcttgtcagaagccctaatgggattctaaccctgggttctcagactcaaatgcccatgctctcatagccgtgattctgtatcatcagcctctgaatgcccctgcttgaaaacaaaatgctttgattaacttattgaatgccaaattcatgttaggttcttttcttagattctttcctatagttctctccatagctttgagataatcatttcccattttgcaggcagaaacactgaggctcttagaggattaagcctcttgagtttatatggccagcaaatagcagagccacaatttgaagccatctctatgtgactccaaaacctctgtccttatgagtacacattctggagtaatctctcattctgctctcacataccacatttgttctgtttttaatggtaccttctgtatacatgtcctgtatgaaagtatagaagtcttgtagctccaattaaatcattttaatggtaaagaattaaagtctgccctaaataataatcttatggaaggttgagggaccatgtttctctcatctttgtactgccactgaagtgcaggatagtgcattacacatactggggacctaaaacaaagcaaaacactacaaacagaacaaaaaccactattgaacaaataattcaaattaaacttaatgcagtcatttttagtagtgtattaaatggtctctcttccaggcatctttatttttttgtttagttaaaaaatgcatctctgaaatacaataaaaacagccacagacagcccaggaaccaaatgctgtgattggttcactgaccagaaaaaactggagggctccaatagaaacatacaggtgacagattcgaataagaaagcagagttccaaacagcaggagcagcaaaaattgaatgcttcagcagtggcagagattagaaaaggcaagggaaacagccagtaacagcctaactgttgagcagatggtcagcttcagacacgtgacggaagcattccaccttctcgctgctggagggaaggctcagatggctcccccaacctgcatattgcaatccttgaaggtctgggcatcacgtttgtgtgtctggagtggcacgtatccatctgcctcttacttacttctaaaggtattagcacactgctcagaaagttctcactgctaggtggttgtttagcaatggagagattaaaggtgcttctctccacctggcccaataatgatggtcctgtggcattcagctctctgttcttcatcatctaaatgtccccctccctctagagtgatagcaaaacagagaaaccactgcaggttgtcatgaagaattaggtttgattttctttttaaggacgctggggaatttgtaatgtattttgtttcaataccttattcaataccaataaaagtgtgttacgtgaaattcatatctaaagtcacctctttcctaacaattcctgaagagatcttttgctgaattatgttttaaaaataatgatgatgagagtgattttcccccccttgattcaatgtctagtcattctatggcaatcttaacaaactgcacgtgttagaaaaggaaaggaagatgtgtttgatgttattaatgtctttggtctgcgtttaatagaactaccttcctaagatttagatacagacttctaaaatataagaataaaataaagtaagtctccagacttctaaaatataagaataaaataaagtaagtcttcaatgcctggtcttaaaagaattttagacccagtgtctcactcttactcatttttcaaggagctacagtctagggatgggacttggctgggctgtggagacaaacagcaaacaaatctgggggcctgtggctctgggggatactggcaaagtgggaccatggtgtgacaagggccaagataaaggtatcctggggcaagaaggagggacccgtatagagatgcttgagatcagcaataggacttggatttggaaaagaaagttgtagagtgacttcaagtttctactcgggtgactaggtagaagatggtacagaaagcaaaagagaaatgaggccagtttggacttgtgaaatgtctgtcgaaactcagataagtgagtgtgtaaggcacataatttatttaaataaataaatgacaggatgaatattagaaattaagtttcttctttcttaggtttattgtgctctaccaatttgccttcccctaaaacaatatttatagtggtagttcctcacattaaaaaaaatgttaatgtagagaaaaaaacttacacccgcttctgccatgtagatttgtcctcttgttctacttatgtcatgattttatgatggattttttcatacttccccgtttccttgaatgttatacactgttttatataaatgttactaaagggattaccagcacacactagctaatcatcatcttaaaaatatttcatgtagagtttttgtttttatttatttttattttttccttgagatggagtctcgctctgtcacctaggctggagtgcagtggcgcgatcttggttcgttgcaacctctgtgcctcaggttcaagtgattcttctgcttcagccttcagagtagctgggactacaggcatgctccaccatgcctggctaattttttttttttttttcttagtagagacggggtttcaccatgtcggccaggctggtctcaagctcctgacctcaagtgatccacctacctcaccctcccaaagtgctgagattacaggcatgagccactgcgtccagcctcatgtagtttttaaaggacatttattttcttttcctaatagtttacagtttctgttattgaggagctggaaaaaaaaaaagagcctgagatagggtaaagtataaattaggttgtctcttaatttgttagtcccatttcactgagcagaatactgaagccagaaagttaagtaactggagatcacacggctgagtcctaaggatcccctgagcttagaacattaaacctcgagagagaagtgattgggatctaaatgttgaagtggttagattgtgttgaggaaaatgtctcctggtaaggagatataacatcctcaggtagacttaaaaaacaaataagccgggcgctgtggctcacgcctgtaatcccagcactttgggaggccgaggcgggcggatcgcgaggtcaggatatcgagaccatcctggctaacagggtgaaaccccgtctctactaaaaatacaaaaaattagccaggcgtggtggcgggcgcctgtagtcccagctactcaggaggctgaggcaggagaatggtgtgaacccaggaggtggagcttgcagtgagccaagattgcaccactgcactccaggctgggcgacagagcgagactctgtctcaaaaaaagtaaaaataaaaataaaaaaaataaaaaacaaataaaataaaactttcagaaatccttaagacataatacagttacctctcacttcagatttctactagaatttgagttatttcaagggtatactggtatgggacaatgaaaagtctttgctaattttgcctgatacactgaaaagggcaatgaagaatgcaaatatggagttcaaccgagcaaatgagatataggtagttgtaggcatttctaagaagcagacagacaaatggcaattaattgtttgagttacccttctgaacatacatgctttgaatagaactggccttgtaagtagacattagtaatttgaggaagcaccagagagatccttcatagctttatttttgtggacagtgaaagtttttgtgttttctttttttccccttttttttgagacagggtctcactctgttgctcaggctggagtgcagtggtgtgatcatggctcactgcagcctcaatctcttgggctcaagtgatcctcctgccccagcttctggagtagttagaactatgggtgtatgtcaccatgtccagccaactttttgatttttgtagagacagggtctcactgtgttgcccaggctggtcttaaactcctgggctcaaacagtccttcctcctgagccttccaaagtgccaggactacaggtattagtcactacacccctgcaagtgttaatgtttcacaactgttagaatgtaaactatccttatgaggtgatgagcttttattatttcagtagctagcagggtgatgggccccaggataggacagtaagacctgattgaagtgagagaacagactcaggccctagcctgccttttaggacattactgcccttgctttagaaaaaaaatgctttttacctcccatttaattgggtcattgaagtaatagcactgaacaaagggtttatctaaggatgaagataaattgtgtatctaaccatttaagaattattaaaattactccagtgttgttgtttttgccttcattgatcaaggagagagaaaactagtaagttggggtggtttgacccaaatcagtcaaagatgtttcattatttagaaattctgcaggggctgccctaagataagaggatattttctaatttttgcacaaaaaataaggtataaataataaattgttcaaaccaaggaatggagaacttggctaaggtggttgccttagatacttatggtttggccagaggactatcagcactgtgtgttttgatctgcataactatggcatttagttgtaaatatagaatacttgaattgcagagtttgcaaactagaagggactgcagaaatcatctagtccagtggttttcaaacttgattttagccgcagactttttcctttaaaaatgaaatcttaggtggaaccccagtgattgaaacaaataataagaagtgggttcctctggcactttaaatcttgagaatcttgattgttttggggaaaagttcttcattgcctaccttcagcacctcaggtggcacagtttgaaaaccactgatctagtccaaccctttcattttacagatgaataaactgaggtccagagaggttaagtgacttgaccaaggtcacacagctagtcatggaagagccaggactagatctcaggtctcttgattcccagtccagtgctctttccactacaccacaatgccagtaaggtaggtgctgtgttagcattacgttcatagccactaatagtcttcagtattttccagctgatttatgctgataatatgcattgaatattgaagtgtattttttagaaatttgtgggatatgcaaatacagattagaatcacatgggtatattcttagatgataaatcagtatctagaatgtttcagtttacttttaaaaattattttaaagcaatgcaattaggtaatgtctgagctacattggatattttagtctgatatcagtgatcaatatgtaaggagtcagtatgttttagtgtagacacatactttgaagggagcagcattaggactcctggccaccactcccttgggggccatgctttgccatcatttccaatattggccagtctattcagaatagtgcatccctcttagtatgtagtgggcatgttcttcaacattaagctctgcagatttaccctcagtttttttgttgttgttgttgttgttttaagaaagagttttgagtttgttgcccaggctgtagtgcagtggcacaatctcggctcactgcatcttccgcctctggggttcaagtgattctcctgcctcagcctcccgagcaactgagactacaggcatgcaccactacacccggctactttttgtatatttagtagaggcgaggtttcacagtgttggccaggctagtctcgaattcctgacctcaggtgatcctcccgcctcggcctcgcaaagtgctgggattacaggtgtgagtcactgcacctggcctcatgtagagtttttaaaggacatttattttctttctgtaatagtttacagcttctgttattgaggagctggggggaaaaaagcctgagatagggtaaagtataaattagattgcctcttaatttgtttttacaaatgttgtttcctatcagtcccattttactgagcagaatattgaagccagaaagttaagtaactggaggtcacacggctgagtcctaagggtcccctgcccgctccataatagtgcatccttcttagtatgtagtgggcatgttctttaacataaaactctgaagatttaccctcagttctttctatgcctataccttctgtctctaagtcctttattcttctcaacctggtgtgtatgaattgtcactggggcgcccaccctaaagggccataaaggatggttcattgtagaatcctgttgcccctgattatctctgttgttgattcagtttccacctgaattgctctagtgttatcagacaaagactggatgccatcactagatgccgggaaagtagaagaagtgcctctatgctgttgttttactatctaaaataaagaaggcatgtagatgtctgcagccactgtgaactggtagaattcttatgagaaaacgtccctgggaaaatagatgttaccacctgtctaaagataagagtgctggtcttgtaagtaaaaagtaagtttgggagcagtgattagtcaaatttgaatatggtttgtttctatcttattgaatatattaggggctagtctctatgcagtagaaatatatacagccagaaattactgctttactcctacttttatttgagaatcaaggaatcgtgactagttatcaggtcttatttatagaatgcattccttctgaaagccaagtttagagttctgtgcatcacctgatggtgtgtcgtcagggtgttcccgtcctgccatgtgacctgataaccccagacaggatacattagctctctgggtatgtgtttcctcaactttaaaataagggggttgacctagatcttccttctaggccaggctagctctgtatgactgctgattgattaccttggtgactcaagataatgtcagggtcccagacattgcattgcatacggtatttgctcagtttgatccttactttcctatagaactttctgtgatgatggaaatgttatgtatctgtgcagtccactactgaagccactggccaagcgtacctgttgagcacatgaaatgtggctagtgatactgaagaactgaattttaagctttatttaattttaagtaacttacattttaagttaaacaaccacatgtagctactgtattggacaacacagttcttagatattctctgacacagaagtcagataccaagtggaataggtgtaccttaagtgttcatcaagagagtagtgatgttttaccttgatgaatcttcatcaaatacagtcggtcttagggtaacttgttagaaatcaagcactgttttttgaatgaaaatgttatctacaggagtcttgagtttcctcttgtttgtgacttaaccacatgagcttcaactgaaaagatatttgctaatttgatgagaagtgaaggattttttcctgtctgcaggcttgtgatcatttaggtctcgacacaggtctcagtgaattcccgtatgttttctgggaagctgagtttagaaggtttctggccaataaaaaatattctgtttttattccaagctcaaatatgagtgactgaactgtgctggtttctgaatagatgatgaaacaaactcttgttttttccccctttagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatgggtaagactgaaggacctgttcacttcttacgggattgggtgcttgaagacttgcaccattatttctgaacttaacttgaggcttgaaatctgtgatagggatgaagattctcatatcttgctttatattgtctcctttatgaaaaaaacttgattggtattaatagacttttaacagctgtactttctctctcctaatcacttgtattctttaagacagtacactaaatttctttggaggagggcatctagattaatacaagaccctcaattgttgtgttggtaacaaatgcaaaataaatttttagcttgaattctctttcaacatgagacttcatatgcagtctgcctgccacaaatatttttaaaaatcacttgattttcttgtgttgtatcttttgtttcagatagtctctacgtttattttgatttttttgagcctccatgatattccatatttccaaagtgtgatatggcatgctatctgtggcttaacagatgtttcccaaggaatgatttggtacttttttttacttgaaaatgccagtgattaaagttaatattgacagttttgggtcaaggatcagaatactgaagaagaagtgaatttgggcaaatatgtgttctatttccctgtgttcattccttctttgcataaaactattagaagtaaagcattttgtctgggtgcagtggctcacacctataatcccagcactttgggaggctgacacagatagatgagtttgagctcagaagtttgagaccagcctgggcattatggcaaaatcccgtctctactaaaagtacaaaaattagccgggcatggtggtgcatgcctctagccccagctacctgtggggctgaggcaggaggatcgcttgagcccaggaagcagaggttacagttagatgagatcatgccactgcaccccacacactgcacctcagcctgggtggcagagcaagaccctgtctcagaaaaaaaaaaaaaaagtagtaaagcattttgaagacattgccttctatagaacaaatgtctaccatgaaaaatgagagagaagatgaacaaggtaagtttttaaacatatgatcagtggttcagtggtggagatgatagtgtatcagagggttatcagtaagtacactgttactgggatgtcttcaattcctaattagtgatgagtctcactgagagcaatagtcagtctcctcttctttttccatctcctgtgtccacatcacccactaacaggacttaatctctaccttgtaactaattgctggcaaactttcctgatgagggcgacttagtgacctggacactggaaagagcaagggatgaaatgcaagtagaaaaccagaaagtggagctgaggatacagaattctggggaatgcagccagccagatattcactacttgattacagtgatggtggttgtttttttgtttgtttttttgtttttttgccacaggcagagagagcctaatatatagaagtttacattcaatttccaactacattgctagcaaacaggggctccacgtgtagggccttttttacctttctacacccaactccccaaatgtttagaaagcagaaagagagtcagggtgagaggaggggtgattgaggctttggttgtaagacagtaaattagtagttctggttctccacaacagtaatttctacgtttatatagtgtgtcagacaaatggctatgcatataatttgtgctttcttaatagccagtctgtctaatgttctcgcaggtaccatttctgaagagctttcaaaggtggttatgctatttcttgatctggattgatattttaaccccaaaatcaaatgtgataacaactcccttctacacaaagccttaccacttatttatgacttaaggactgaaaaccatgattgcatgtttttaaatagcagtggagtcttcaggtcacggtgagaccagttcaagggatcccattttgtagatgtgttagcaaatggcctgtttcttaggcagcaggtgctattttgtgaaatattagttccagtgcactatacagtaatcagcaaggaagtaattacacttatgtgcaatgattatgttttcatcaagtaatataaaatatccctttatgaattatatctgtatccattggttttatgtgattttcttcagaccatgttccttaccttttaattatattagcttataaaaccaatagtgctaatctctataaatatgtgcagctactaaaccatccctaaagtctggcagagtttagtgtgtgttaatgtaaaataaaatcttgatgtatgagcaacaaattatggtgttacatcaggctgccattttgagaatataaaaattgtcataaagatatacttagtctggtacgatttataaatgcctattatgtgtagggacatatactcacgagaatccttcagtaaagtaacttcttagcagcattagtttataagtaagcttagagttttatcctagttagttaaaatattctaaaacaaaataatcagttgagactcaacattagtgtcaaatttcccacaaatgaaaatgtgattatgagctatttaatgattatgagatatttcccccggtacatccctctggtattatgactataaataaaaattgtgtgctgctgaatatttaagtatcttaaatagagaaattaataaacataaaatcttgatttattttttatttttaaagatttgattatatctaacaaatgactttcaaagttcaaaagcggcaaatgaatcttacattttttcaccaagtacttgagctcaaacatgtttctaatgcacttaatatttttttaaaaatgagatgaagcttagtactgtttcacaaatgctgaaatcccaccaccacagatatcctgttgctcattaatattactccaggcattacagcttgtgtcattattgatttcttctgctgaatttttcaagcttttgagacctctggaattcttgtccttaaaggcaaatattcagatgcctctaacatgaaagtcactgtcacatttatatccttatcactttctggttgttttgtatggtgactaattttaacagtagtggtttttctctaaaacccaggcaacaaataagttaacaaaaattacatatttgcaaacatttcaacttgaaataatcacaacagagcagtagctaaatactattctttcccaatgtctttatattatgcaaattaataaaacatatttgcacttttacttttttaccaataggtggcattgacaattttaacttttaaaatatatctcagaatatgttctaattggacaggaatggtacaaagcatcttatatttagctttttatttagtctgagaaggggctatcataaatttgttcacttccatcagttgtaaatgaaatcgttttatgtggttggctgaacagtcatgtgactcatctttatttgtgtaaatcagctaaaaaaagggatttataaccacttaaatctcacaaaaagtaaaattcagtgtcttataactcctatggtcatttaattcttacataagttccacagagagatagctcagttatctagaaacccaaactataagaaactttatacataagttccacgagaggaagcccagttatctagaaaccaaactataagaaactctatttgctgttcagagtaacattttgaaaattggtaaccaaaaataatagttttgatcatttaaaatgcaaaataatgccacagcccaggggcttttcctatacagtagaatataaagtgaatatgtaagaggaataacacgtttccagatttctctgttcggagcctttcagcctctctttttagtgagacacatttacttcctattttaatgagcatcctagctaaccgcttaattaatattggtgctcacttggtaaacacttatgtattactttttcatggacttcaaattaggattttcagttggttcacttggatttatgatatttgtcaaattatatctggtatattaatttttttttgaagaatatccaatttacttttattttttaatttttggtaaactgaatgagtatatgtagctccatattatacaagccttttcttcatggtctaattttatcacggaggtatatgtattaggattgtattcatttacacaaggctgacatgtagaaaaatttaccatgcttgttttgggaaagcataacccttcctatgtaaaatgacttatgctgtctttatttttaatgcaggacagcaatgctttaaaaaccacttaatgtctacttgtggtttcttgtatttattaagagttagaatatatttttacttacagagtgttgcatggataactagttgtggagttggtgtcacttaactgtctccttatgtgtaaaataaaggcttctgaccaggtgacctctaaaattccttctagttctagtattttatcattctatgaggaatctgttaggtaattctgaatctaaatatgactcatgtctccatccaaaatcaaacgtatttttacatcgagtttgcccacatagtccttgctatgagtctgtgtgtttatgggttgtgtactgaatgctttagggttattcagccttctctatttttgtagggttgcatggcacacgtcaagaagaaatgattgatcacagactaacagacagagaatgggcagaagagtggaaacatcttgaccatgtaagacatcagtaatcatttgggattaaaaaatgtttggaaaacaactggagtgaggttatgtgataaaataaaagcttggtgatcctttgaaggcattgtttttcctgctatccttgaaaaaaaaatgagcgagaatatctgaagtagaatataggatttgatttctaaattgatatgaaagtcacttgagagaaatgtttagatcttggaaaggaattctcaaagccagatcggtgggctactgttctattgtgaaaaggtcatttaatttataaagtaatgggattagtatttggagaggtggatttactggctataatgccttcaggtgaaatttcccttctgactcgtgttcataacacttatcttctcattcccattgaattttccatctattggctctgaatttcaaatctagtcatagaaaatactagactgaaaccttcagggataaaattgcttccttcattgtcctgaaatggtttgtttcactactcagcaaaatctttaattgtgatgatttatatgctcttccctattctcccctttcccaaatagctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactaggtaacttttcttcagatgagtatctcgaaaacacatatttcttatgctgttaatgctgacttcatttttatttttaaaattaaaggatatgcaaggaattttaagacaataaacaatttacatatcctccaatatgtcttgtctatctgttaggaatttgggcagattggcatagacagagatagccacaaaacttaaattccttttccaggtgagtgtattgagctgatggcagcgtttcagcactgaaccagattttcatgtgcataactaaaacttgtgctccttcgtaatgcctcaaaacagcaaaaacaatctcagggagtgggcctggggcttaggcacttccgtcaaggtctctagtgaattctgccactgcataccaatgttatcactgcacatggggatgtatgtttcaaattattaattcagaaaacagcctgtaagacaatcttgttagttgaatcatatatatatatatttatattttaaacttttttctcaaccccccgcctccaggaagagagacctagaagctatatattttgcctacagctattttaaaattaatgataaagatgtagcacccttcctgtgatttgatcttaacttagattacttaatcatgattatattaattctagttttatctagttttataataggactcataatatagttgtgccttagaaatggaatgttagtatgtaactatttcttattgatatttgggaattgttggggttacagatagaatataatcccatatatgttgaaagaaatcttcaacctgaaagaatttttgtgtggcctgtgaacttttacctaaattaataatacggttttgtcattgacattgccacccattacgtgtgaatactttttgagtaaacttacgaaggtggatttctgtggattcttgttctctcatattatcttatgcgttggccccatacccatctgctaactcaagttactgtccatgctgcaaaacgtgcagattaagttcataattttggcctcattagtaccatggctgattatccaaagtttaaaacttgaagtatattatctgttgatcacattactgttttcaatttgttcccagccagtgtagtttcctatgcacttaggtttgtagatttctgctgatctctgaatgccgaatgcctattatcataagtattaaataatgaaagagtctaaggcagttaatttacctaacaagcattattctgaagcatattttaaaaacaaaattgtatttgtcaggtcacattaaggcaagcaacgaaaacagaattacgtttggtttgagccaatattggtcgaagccaaactatttagagcagagtggaaaaaaaaatcttgtgtttatttccttattatgaacaaaaattgattaatcatcagagatttgcttaggacagaggggatatttataaccgtccagtctaggcaaaaattgagagctttaaagtaaataaaacttagggagttaaaacatctagtttggcttattctattgaacacattcattgagtcagtacttatttattgagcacttactatgtgccaggcaatgtgctaggcattctaatgaaggaaaaagtcttcatttctttctttgagggcctttgggtctagtggaagaaggcaagggaatagctagtgttcaagccataggatagctacctcaattcagtcggccaaactgaccagattgctattatctgccatccactataaaagaaacatctccgaaattgatcagacttcatacctaagcgagttatcagcacatagaacaagggccattttgtgtatagtcactactactacacacagattctggtgatataggtatatatcatgttctccaggaagagaggttcattgtccctgctacataaccaaaagaataaacttggtttaaaaaaactcctttttaaaagtatacaaactatactattttttagtgatgttcaatggatttatatttttgttaaacctgagatatttgtttggccttaagcttttgtaggttgtattagtcaaagggtacaagcatttaatttctttgtttatagacaacattaagacattatgttctttattgtcacagaatcctaagttgccattaagacactatcataactttagagaaaatctgtgtagaactctgcagtgtgcaagttttagcatccagtagtgcttttacagttttttttcactgtgcatccttactagctgattcttgcagccttgtgtactattttctgggactgagctatggctgtaaataagaggacaggtggtttgtaattatgggccacaatcatttacattaagtgctttctaagtccctcttccaggctttggagttgaatggattgatgtgtgtaatgaaaggattggagattattggctgataaatctattttctgtgactgggaagtgtttaatggagtgcatgtgcgcagataaagatatggatatgtctatatctttatatacatttagatctccgtatcccacagttgtatgtatttcttttagcctaattattttgcttcttaaactactgtctggtctcaaatgagatcttcagaatatattatagaagatatctttggttcaaaatattgccctacttatatccctaacttggaaacactgggaacgtttagtcatacacacattcttagcattttaaaattatatttggggactgcacaggggagaatgtaactttcatgattgatgtgttgtacctgttaaactcaatcccattctcacttttgaaatatatctgtagtattgagtgagtatagggggttagtaaaataactcgattaatctattactaattgaattttaagagttttcctggctgggcacagtggctcacacctgtaatccaagcactttgggaggccgaggcagacggatcacgaggtcgggggttggagaccagcctggccaacatggtgaaaccccttctctactaaagatacaaaaaaaaaaaattagccaggcatggtggcgcatgcctgtaatcccagctactcgggaggctgaggcaggagagtcacctgaacctgggaggcagaggttgcagtgagccgagatcacgccattgcactcgagcctagacgacagggcaagactctgtctccaaaaaaaaaaaaaaaaaaaaaaaaagtattttcctaagatattaaaatctcttttttgaataacctctgactgaaacaatttttaacactgagtatacactgaattcataatggtatttctattctttaaataaaatgcaagttgacatcttgaaggacttttcataaaatagattttcttgaaataatagatatttatcgtttttactgttgttactcatttactttccagggaaaactccaagtatccaactcttaacaaaattagaaagcaaattttaacactgctgtctctattttcaaagtatgacttatttatacatttaagttttattacatggtatgctccacagaagagcaagataatgtgatcagaattgacagatttgaccattgaagtagaattacttttatatgtatagaaaggcagttgctggttagcactttgtatgttttccgaagtgcttgtcagaatctccttagtagctctttttcctttctttgtctttggttcctttttctctcagaatgttgtcacatcactttcttggctcctgacattttatttcttttaaactactttcctttttactggcttttgactattctagaatctttctgtagtttgtcttgtatctgtgtgcgctctttttgttttctagaagtcttccacatcgttagggttaattttttttttttttttttttgagacagggtctcactttgttgctcagggtggagtgtggtggcataatctcggctcactgcagccttgaccttctgggctcccacctcagccccctaagtaattgggactacaggtagaccaccaccacacccagctaatttttttgtattttttgtaggagtggggttttgccgtattgcccagtctggttttgaactcctgagctcaagggatctgcctacctcggcctcccaaagtgctaggattacaggcgtgatccactgtacctggccaaaatttttttctaatgataggtttagggctaatgtcaggggctggacataaactctgaaatataaatgcactttccctgtgcttttaaaacatgtatgaacattgtgatgacatggtagtaaatttagaaaaataccttcactctgttttgttaagagtttagtatttgccagagaaagaaatatcaaaaagttttgtttgtttaagtgtaatgaaaaatcaagcttagcatttataagaaacttagagccaggagtgttggctgacgcctgtaatcccagcacttggggaggccgaggcgggcagatcatgaggtcaggatatcgagatcatcctggctaacacggtgaaaccccgtctatgctaaaaataaaaaaaattagccagataatggtggtgcacccctgtagtcccagctactcgggaggctgaggccggagtattgcttgaaccctggaggaggaggttgcagtgagccaagattgtgccactgtactccagcctggaggacagagcgagactgcctcaaaaaaaaaaaaaaaaaaaaaaaaaaaaaggcttagtaacttaggagtttgttgaattaataccatcccctgtcccaagtgggttggtagaggaattagtattttaaaatactgctagctggcaagttttatgattgtcatatgattgaattatggaatttctcattgctctctaaatccccgggaaatctagcatgaagactgaaagcacaaactcagtcagtagaatttctagattcgaattactcattcctcttcatattagttttgtggcctttggcaggtcataatctctttgtgcttcagtttcctcgtgtaaaatggggatggtaatatatatttcataagcatttctgtataatgagttaataggtaaaaacatatgagacagtgcctgacacatagtagaagtgttatgtcttagctgttatttagatgtgcattctcaaaaagaactttctgctgggagtagaagtgtctcatgcctataatcccagcactttgggaggctgaggtgagaggatcccttgagtccaggagtttgagaccagcctggaaaacatagtgagaccccatctctaccaaaaatcaaaaaattagctgggcatgatggtgcatgcctgtggtcccagttgctcaggaggctaagatgggaggattccttgagcccaggaggtcaaagtgacagtgagccacgtttatgccactgccccgcagcctgggcaacagagcaagaccttgtctcaaaatataaaattaaaaaatttaaaacataaaatcaaaaagaactttaaagaatagtggtaaatgaaactagtaaagtttttccttggcattcaagattgtgaagttacagtggattcataagtattttttcatctacaaagtacttctaagcaggtggcttctttaataggcacagagattagaaaagattcctgtcttaaatgtagtaaatctgttgtacctttgggaccctaattcataatacaaggctatggaaaaatagatttctcccagccaatgaaatatttcaacttctatactctcaaaatatgaaaaccacaaacaagttattctgtgtatatttgcatgtaaatgtttggagttttgtacccttgtattgatttctttaaatcacatcatgaaattaatctcacagtcattcagctgacttcataatgcaaatgcctactgtacttaactatattgggtttaaaaatatgggactattagttaaatatgtccatcttttaaaattaagaggagatggttacttcctggagcattaagtatgtttgttgtaaaagatggaaatcctaaagcagttgctagcttctaggttggatttgggcttctgaaacctagtgtgaagatttctgaatgtattatccttaaaaacaagtggcatttgtaaagataaaattacttaactctttctttcttttgatggtttttgtaatagatattatcatgatcacagcctcattctgcccactacaggatgaaggccatacctaggtgctgcccagctttgagcattgctgtcctgggtcatatgaggtcacattgcttctccaaaggctatcagctcatcccttcatgtatattgatggcggcccttgcagtatctagtatccaatggtctccatcctgtcgtaagtgtagtgcatcttccatctctttcatacatcatagattgctctttctgttctttcacatttcttacaccattttctgtcactctgacctggtctcctctcttcatagatgtgaattattttcaagaggctcccttcatcctcatccactctcaccaccaccccccgccccaagcaatttgcatcccaaagcaagctagacttaatttagaaggacttttctataatgttttcatctttcagtagttgcatatatatatacgtttaacattttagaccatatcatagacgttcttctgtctttgcatctaccactacattttagaatgatgattcctttttctagcaattgatattttataggtacttaagagttaacgggtaagaattagcttcttttgaatctaagccttagaatcttaggatgttttaggtagatgtgtttagattagccagtattctaaaatagtaaagtcctaggagagaattgtcccttgttttgtttttcaaactcagttttccctatatagattttgatattgctgctgcttaatcagaagaggagatattaaatgtattagtcatttggtttctgaatctattaaagtagtgtttatcaaggtatcaaatagatttctgaggagtatacctactaccaatcactctgttctttctgttggtagacctgatgtttatcaagtacactaacttagaactggagaggatattgtaaaacacgtttatataattatttccctttagattctgctattttgaaaaactgtcttttagaaggtaggttagcattaagaaaacttttgcataattggctttagcatttctattgggtttctatgtcagttaaagtttgggcctatgtggacatggcagtatgtcagtgagaaatttaggaaggtatagccaaagtgaaacattgcacaactttccagtgtggtatatgtacccccaagacacctgtgcagcccatagaaggtggaaggtcaattgagcctggcacgttaatatttgagtcaatttgggtgttataaacattcatgggtgaggctcaagtaaaatttttgaaagtgtcatctaagaaatttgaagattttgcttccaaggacaaaggcagtgaattgtgaactatagaaatattttctatttccaagtgacatagattctgggagtttaaaaaattacttggtgtatattgcttaatccaaacttcttcaatggctttgttctcttcaaaatttgtggtatttggatttttaacattgagagaaaagataaactttaaaaggaaataattatatagccattcttactagaccacatagtaagtaataataatgataataatgaggataatagcaagtaccagataatgggagtttaggatgtgtatgtaataggaggtacttccttcaatcttcacagcagtgctctcaaataatagtagtattgtcctcactttattatagatgaggcatctgagacatggacaaactaacatacccagtgttccatggtcaatagctagcttcactgggtgctagaactaactttcttcagcctatgttgcctggggctggtaattagcatctttcatgcatggactttggatacctaaacattacctttcctgttctttatcataatgattgactatttaataaaaaaaaaatgtttataggctgggcatggtggctcacacctgtaattccagcactttgggaggtcaggtgacctgacgtcagaagtttgagaccagcctggccaacatggtgaaaccccatctctactaaaaatatacaggttagctgggcttggtggcatgcacctgtaatccgagctactcgggaggctgaggcaggagattctcttgacctgggaggcacaggttgcagtgagctgtgatcgtgccactgcactccagcctgggcaatgagcatgactccgtctcaaaaaaagaaaaaagaaaaaaataagtttttattaactacaggtctcttcttaacacaataaatgaaaaaaaaattgctactttgaagtcacgtttttttctttcttcaaactttacagatctgttcttattcttatccaataaattatgcttaaatccaagtcttttctccttaaaagttgtcttttaatgtcataagtaaatctctgtgttgtactgtgtcacatggctaaatatgaacttgattgcactttatttcttctggaaatagttatagtggtaaggaagataatcttgataaatctaattagctgtatcacatttccttttaggttgtttatgcagcagttttatctcgccttaagaatgaaagttacttcagtaaaaacgtttttatttttgtcatttactttatagaaatgaatatacacaggagaatgcatagatatttccagtccatcctattattaagtagtcatgacatcacagtgtaaacttttgaaaataaacttttaaatatttggaataattttagattaaaaaattgcaaagatgatatagtttccatatattcctcaccaagctgtagtaaatttttgctaattcagaatagttgagaaaatctaatgttcttgccagttgataatctgtgtgccctgcaagaattcaaagcattcaaatgtatttaaagcattcaaatgtaacaacatatacttagctaaactcatcgtgcttttctttatttttgacattgtgtagcaccataaaatataggagactggactaaatgtcttcatcttcaacataaccattagataaagcatttaaaaatatatgctactcaacatttactgtacacatagagaaaatttcagttttcctcagaatttatcatgggcttattaattaagttttataaaagttaaaatgatttttttcttaccgaactcttctatataaggaggcttttattgaaaatccaatatggaagacatgaaatgcatattttagctatggaagacggtatacactttgtttacttttgagcatatgtaagaactataaaatgttttgtgttaattccatgaacatattttagaagttagcattcctatatcaaagttattagttgttttcttaaacttttaaaatttgagacgcctagtaagcacagcatttaatttaaagtggaacttcatttccttttctggaaagcatgggctaattctctctgctcaacagaatgtctgtgaatccattctgatgagtctttctggctttcacgtatgtcaaatccatatgatctaatttgtgtgaaaaattttaatggtcactgagatttttaagaattaagtatgagaactggttagccatagagtggagcttgctattcattgaaaggtggcagaatcagagctctgtggaaattacattacctgaacatttgattgtttaaccaccagtttgactcatgaaaggaaaactaccaaatacaatttatattccttaacaaaatatatctatagaagtctccatagtcagaaagtgctgagaacagtgttcccaaacatcatattgtataatgaaatcaagttgctttggctttgagcatgcatggcatttagaccaatgaccctctgttttccttgggctctgatgacaggccttgctatttttatgtgttttcaagaagtgaaatgtttagccttttaaaattgcgtttttgtagagaagccaggagaatgggcattgcttactttcactctgtgcgatgacacaagtgtgcttacagtactctcctcctctctccacccccttcccatccttttcatagacgcgcatcgggaattccttcacaggcctgcgtctggatacgtgccagaggagatctggaagaaagctggtaagaattgtttaaaaacatgagtttcgtgttctggcagctgtgtgcagttgttaatgtagtgatgtgaggaatgacaagaaaggactttactgctaacaacaacaacagcaaaaacaaaacaaaacaaaaaaaaccactaaacaaaacacctgattaatattcttaaaccaggcctgattacaagatgaaatcatttttattttagtaacatctgccagtttcactataattgagaagctggcaatatttccattataaaactccatttttttcagggccataatgatttcaggctgaaacttggcataggaggtcttagcttgcatgcatttttttctttgatgaaaaaattccagtgtcttagaaattaaattgcgtacttcagccttttctcctgcatccaaaaaaaaaaaaaacgaaaccaacatcaaatctagttgacttgttaaagtactcagataattttttggttacaatcgacttttaaagttgttcttctgtactaattagtattcaacgatcagagctaaattactctttaagtgaaatgacaaagttactaaacatttatttttgcttttcatatacactatctgctttccattacaagatgctgctctatattttgtaatagtagatttaaagctcctcatgacccactgacttgttattgggcttaaagaagtccagatctgtgagaattttggtggaaccacctagcaagcaaaaacctttatgaaaaccaactcaggagatgaaacataaacctgtttcaagagttaaagaggccatgaaaaacatactgtggctttcagctgctgtaactccagctcttaaaacagtttgtctttttgagttgggaaactgggaaatgctacttctacaaacagtgcaaattgaagagtcaggggacagattttttgtttttttctacagaagatttctctttgggatttcactcagctgtgtttgtagttctgtgtaacttgctgactctctagtcacatgtatcttatccaagtatttttatacattttccaagaaatacctgtttttgtaagagtgataatgagctttaaaatctgatagcattctaggtttagtagcccagattaagaattagaaagctgtcttgcacgtccaatacgcaaattagataggtccatttagcttaaaggttaaaatacatatgttgctgaactgtgtagttttaccagatttactgtaatagtcatgtagtattcccaagctgttaaaaatatgccaagtaccacctacctgaaaagacgggcaacatcttccttctgaccatttttctcttccatttctaagctgtcagtgcaacttattccaataagaggtacaaataattgtgattttggacagaagaagggtgactttatgttcagaggagtgagtcttttctctgcacttccctttttaagtatatttaagttaaattcttgatagttcatagagaaaaattaccagtaaggtcttgtgtaatccgaattctttttgtgctattatctgctcaagtctttgtttgactgctattaagtgagaatagatttttctgaatatagcacctttgttggaaagtcaacttgaatagctatgtacaaaggaagtcctaccataagtggtaagcaattggacgcagattcaaaactgcactatgtattttccacttaatcagttgtttattttttcctacatggcatattgttatctattgactccactattatttttctttactgtctgttttgggggtttttaaacctaattctgggtgtaatttaggttttggggacttaagagagtagagaaagagcactacttgtttttgttgtgtgcttgccctctccaagaagggttaaaccttatctaggaagtgtttagattatttattacagtgtctatcatctacagtaggttttcaatctaaaatatgacattaaatttgtattcttctcacagtggtatccctaaactgctgcttaaaaacagtttgggaatagttttctatggatatatgctaaattttaaggagtatattaaatccacaaagtatggatgatagtttcatctagaaatctccagtaactacttataatatttatctttataggtttcttaaatggcatttctagtgttcagtgtcaaggcatccaacatgatgaaaacaccaagggcagaatgtgacatctgcactcagcttgttacaatttgaaagcttttatcctagctttctaaaattggctatgggcaaaaaaattttttgaagaaaatctataaagtgtgtctttgcaatgaaattattatacattatctttgttgcaaaacataggtgaataaagtatttgaaaaatacaaaaggggcagaacacccaaaacttgatgtagcataacaaatgcatccactttcacagaaaattgtaattacaagtataccctgtgcttgaaagtacatcatatagctttttgcatcattttattttgaaatgatttcaaacatgcaggaaagttgcaaaaaaaaagtacaaaaaattcctctataactttcacctagattcccttattttatcatatttgctttagtattttctcttttcctccctttcatcctcttctttctcttaaatatatatatatttctaatcatttgagagtaagttgcagacataatttctctttaccttaaatgatttgaatgtcagtttaccaagaacaagaatattctacataacttcagtacagttaccaaatcaagactttatcactgatagaagactattatttaatctacagaccctatgcaaatctttcacattgcccccaataacacaatataataacataacaacacacatttttaaagattagaaatccaaaaaattgttcaaggccatattctcctctaaaagtagtattttttaaagcgaaagtaacaaatgcactcaaaagttacaaaggtctttatgaaactggaaaaaatctaacataaagatggttttaaaattgtaacaatgttttcttcagtatatttctttttacatgatcagagaatgtttgcagttggtaataaatattcaagcaccttgcaaatgtcctaccaattctctttgctgatctgtatatgcctgtgggattagaataggaatgcataatttaaatgtaaattgcctgatttgcatatacaattagtcaagctacagctttgatcgtaagcaaaaattattgttctgtactaccacttagatagaattttaattcaccttgaatattcaaactaaattagaccctggctgtatagttagaagggcagtacttcccttgtgccccaagtcatttatgataggataataaaggcatcttttcacctcctggtgaagaaggtgctataagctgtttgcaatactctgattctgtacagattttaaatgcatatcttaaagcagctaacaacggcttaatataatttagttaatatttccactatggatcttttacttatattttagtttataaaacctagcagacagtaattgcaaagaaatgtacttcagatataatgctgctaaaatgacagaggctacaaaagtcatgacagttaattactagtggagagcttctgatgactctcaagtcatggacaatagatgtgtgaaataaaccagaggaattgaagaaacaataggagtacttgcatctcttacatttttaatctacagtaaaacatttttattaggaatctatgtttttaattaaacagaacatttaattaaggtgctttttaagtgggtgaaacaattaagtgcaaacacttgaatgaaacatgtcataattagttttaatagagtgttaattggtactaggtttgccaagttaataattactgcttattaaattttcaattaatcattgtcattttgctttgaataaagatgaaaattagataaactaattcagggggaggatattttcccctgttaattagaacagttaattttttaaaatggaaattacttgttttagttgtcagtcttatgttgtacattagttgaatctttgcaccctttcctcagccaaaaataaagagcttatttgacaccttgcagactcatagtcaggcctgattgttttggcctgtggtatgattcagttatatttgtctagtgcaacagttggttatgcaaaaccactgtatatatttggtaaagtaaatggacaacagcttaaaatgtaaaaatgagattattttttaaaacctctatcatttaacctataaaggcacatatttatattactcaggaaatgacttttcaaaagtaaaactggatcatccattatagcattgatttttcattaaaaggtctatagtaacttaattgctatctgagttaccttttcactattgtgttgtagattatgccagcaactaatagtttgcacttatttgtttatgtgtaaaatccattctcggcctctcttttttttctgaactcttgacctgtggaccctcctatattcatgttaacttatagcattgtggaaaactgactttatgtgtctgaattattcagacaggtttcttgcgaatgaccttgtcctttaacttcttatctggtctcagaatcatttctggaggcattagtttggttaaaaaaattataataatgatataggagtttcaaaaaatatttccataaattcaagttaaagaaacattttcaccctttgttttcctaaatgtatgtcaaaagatctgctagtttttagactgctggaactgcccaataatttggatgagagtcatgcttcttctatagaattctacaaaaaagtaatcagatagtgggcatggtggctggaaggctcctgtaattccagctgctaggggaaattgatgcagaggataacttgagcccaggggttcgagaccagcctcggaaagaaaaaaaaaattaaaagaaaagtaatccgtatccaatgacttcggctaactgagaggtgttttcttgtctggtttggcctgactggcacacagaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgaggtgaggcatcttgggaagctccaaataaacaagatagttttcattcattagagtgctcattcttcattcaaggtgatcactttagataaatatttggaaaaaaatttagaacagtgtggggaaagtcaaggtattcatgaaatttgccaagagctgatcacatttgtctttttattgaacacctaatctttgccaaaaaaggttttgaatgtttggtaggttaccgatcaaagtgaaattcttataacttcgcagcattatttagagactcatagctcggctgtgtgtgtctgttgtgtatgtgtgcatgtgcatatgtgtatgcttgctttccaattgaagggatttaatagatactgtgtaagctgtggtctccaaagccatctggcaggcttgggattgaaatcactgccttagctattggtcctaaagtccaatgctaaaacaatgtttgcatcaactgaatatttctaagagatcttagagacagtctgtacttccacattatttgtggtaacccatatgatggtcatttcatagcataacattgctgctagaggtaatgttacatatattattgttccagtataataattctcacacacacacacacacacacacacacacacacacacacacacacacacacacagctagcctaaatggctcaaagatctgcaaagtaactaaaacacaatatctaacaacatgatttttaaaatattgcctgcaaaatcagcagaatagtaatgctccacgttaattaatatagcatcacgatccttaaccccagagtaactttagataaaggactacaatgggctgctctcaccaagccgaactcacaatggcatggactgataaatcaatggtctactacaatacatatctataatttgtgagggagagtaagtatttaatttgtaccaggcttttctgtagatgaaagactctgcaggaatctctcaatgcccagagtttctatttaatgtgtagcagatgaataacaaggggacaaaaggaattgattttcaacatttgaaagtttctcaggaaaagagggacaaagggaagtttatctgccctttaactgctgacttttccattgttcaattaaactagacataaattcagttttattggtatcttgtggctaagatataaggactttatgttttttattttaaaaacattattagcatcttttgaggagaatttgtccttctctgttcaaatgagcaatatcgtgaggcacagttgatgtcatatcattaaaactgtcactttcacatgaacattttagggctgttaggtatgttaagagtactttttaggtcaccaaattctaaagacagatgtctaggaagaaattgtcaattaagtctttgtactcaggcagtaacatgctgtattccttcagtatttataagctttgtgtctttattcctaaaacctatttagaaaatatgtgatcttgacaccaatatttagcattataaataaaccctgttaaacagtatctgtgataggttattcagtcatatctactactaatgtaagaatgatcttctgtaataattgtttttctttttttttttgacctcttgggggaactgatctttaatatagcattaccagtgtcttcagtgacacttccccaagaattttaaagcagaccatggtagaggaaagggtttggaattcagagggtcaaacttaattcctggctccaattcttacaattctttgatttttgagaaaaccactgaacctgtaaaagcttcaattttatcatgatctgaagaagagtggaagtgtctagtatatggcttgaaccttgagtcatgctatggatgaggaaacttacctggctaaagttacacagctaggaaatggcagagcctcaacaggatctcacagcatgctttcagtccctatgttgttttgtaacaatgaaataaggatcttttcatagggatcattaagataatttttgtatgcagataaagacaggcagcttaggtctgttttcttattctttaaagtgcaaggaccacttttaagacttggggaggaatcatctctagaaggattaagcctcttttctccaaaaatgctgtaaataatttcccaagaatagaagaaagaaagatggaaaaaaagatctctttacgcccaataaggcccatattgccttgtgctttaagtattttatggattgttctgttttctaagaaaaatgaatgttctcatttcttagaagtttaatgtgcaaaacttaccggagagtgcactgtaacctagggtgcagggcaaccacacctcccactttgggtggagctgtccattgacacctagtgtcccaatataattattacgagcgcccccttccactgtcaggtgtcctgtcttcattgataagttgaatggtcccacctcttaaaggccatgttcatctgatcagatgatcgtcttctgctagcacagctcggaggcagatacgtgtggcagaaagtatctgagaggaggacccagaagtcctgaattatggccccagctcagttactgtctcagaggtccttcggcaattcattttattcctgtcagcctccatttcttcttaaggaatgggacgatattcatttaccttacaaggttgtttaaaagatttttaaaatagtgtttttgaaagctataacacaatatattattatctgctcatatttcccacagtttttaaaaaatcacagtatttactaaagtattcctactgaaacaatattctttcctccctttccctttctttatttgaagccaccacctattgtaaacatctgcccatctcttacctaggtcaggtatgaactatataatccaaatctaaaacaacgtatatgtggtaagatacacacattattattctctttccttcatagggattgtaagaaggaatctaagattcgcgatcagaagaccagagttctaggcctagcttggccatttatgtttcttctgcgctatttgtgttaactctagatacctctgaattcttctctctgtaatttctgaatttgccctttctcttcctatctcagttttctttcacatgtataaaacggagctaatgatgctcattctgcttagaaaaaacagtggttctgaaagattggcagtggaaatgtttcagaaggaggagaggagttgagaacatttgactggggagaccagcagaaagaaggcttggaggcaggaatgaataactcatggatattatttgtaggtgggcgggggaggggggcgtgtaaaatttatcatccaaactgggatgccttttggagtaagaaagactgctcttgcttagacagaccagtccggtaaaccaggccatcccaggctcatgggaacccacagtcagccaagttatcggaggttgcatgaagtttgttttgcctgagatgaaataagacgacctacgatgagtgtttaactctgaaccaggcatggtatgaagtgctttctatactttagctcgtttacttctcacatcggctctgacaaagtaggtagtgttactttcctcattttactgataaaaagctgtgccttgaagggattaggccacttgctcagtgtctcatggtcagtaagtgtgagctggtccttagttcaggtagcccgactttcaggccaccttcttagtagctacatggcaggagtgggaggtttttgtttgtttgtttgtttgttttttcctaattgtgtactgtatctatttttcactggacttcatgattatttctacctagttctcaaactttacttggatttataggctgatagttggtattactatcagttagaatgacactggacttgcggcagatatctaagcaatgtgatgcttactgtactttctcttttcccagtggattatatatttaacccagaatataatgccaacattagcataaatcagaaatttactgaatctgatcatcttaaattcttttattttctccatatttatttctatttttcatttcctatctgtgtacagataaagctttttccaatgaatgctctcagattgcagctatttccaaggaaacttctacagctttctttgagatccataccttatactagcttaggtgattgaagcaagaaactgcaagtgagcacagaaacagataaatacttttattgttctaatagtttagagttttaaactaccaaagtgatgtttttcccccagattaaaacagcctttatttatcattcttatataggtgcagagctgcacagttataccaacctcagtggaatctgtgaagtttggcccaaactggaaatgccacctgtgtagactctgaataaaacatagggacctcacagcatgggtcctgtcaaagccttcacaatctcatcagaccagttgattcccagaaaaatttggagctctcagagcatgagctatgatgctatgttacatatatatatatatatagttatacaatatacaatatgtacaattatatatatatattttataaatatatatatatatgccagctgtttgattccgtagatgttcatggtatagtagacagggcactgggctaggattgacctttggttgctcacctcttgaagctttggttttctcatctgcaaaatttgggataacgtttctgtgatctgcctgctttgcaaggtggtggagaggtgccaatgagatgaggagaagtattttattaaaagaaaagtcaccttacaaatgagcagtgtgtctatgtaagaacgaaagaggaaaacggagaagaaaaacagttaagaaatgatcctaacaggaagggtggcgagagaattagagtagtgactatgcgattgaaaaggagagagaccacagaagtagtctgtggggtttggcactgaatggttccaggggctaaagaaagaggggtttgcaataaagtgacaaagtcttgggcatgagtgttgccaaagactgaaatggacccaccagagttgggtttagggaatactgacttagaggagcatcctggtggaggtacctacagaacaggcagttgaaataggagcacaaagctcaggaagaagataacaaggagaaacaggtttgagagtaatttgcttacagctgatcattgaaaccacaagatctcacaaggggcagcatgagaaggaaaagatattccttttctttatgccagcatccctccctccctcactgtcaactacagggaaaagaacaaacagcagaagaagttattgtataagaaagagaattttagtaggggaaatttcaacaagaggcatttaataaggaagaacggggaagtaatcagcaatggtaaatcttcagaaattttgaggacagcaaatgaagttgcggaagaaattattagtcactaatgaagtatgaggagaagtaagttaatgttcttctcctgtagctgtcagtgcccatgggtgatagcacttaatttgaatgggaccatcagccttctaattctaaaggttgtaaggtgctggatctggagcaaggactgtatctactctctctttcttccagtcagtaccaaaaggagggagtggtggtagtacctgccatttattcaggacctatgaacatcatgcactgtgcttagcactgacataaccctgaataatcctgcagttattattcctgctttacatgttctgttgctccaagggttaagtaagtggcttgtggttctaaagccacaaagtgatgaagttggaaatgaaatgaagttggcctggcttttgaagcctgtgccattttcattacacactctgacaccttgtctttgctgcctctgactttatggttcaatttctgtccatttttgggagttaagtgcctgctaacctgttcttgccacaatgagagctaataaaagatctgaaattgacaaagtgtggcattttagaaagaatatttttaatttgtaatccaaacatctgggtgaatcaaactttggctatgtaattttatatttttgtgacttggggcaagccttttactgtgaaaattatttattttgagggtcccagtttctgaaactgcaatcatgtgaaaatgattttaaattgtcaagtgcaatgcaagtagatgatgatgcaatcttaatgtgaatttaagtcaatgtgttgccttctgtaggattcttaacatttgaggagtttcaattacaatcattctattatatttaaatttattacacatcgattttgtgcaagtttttctgaagaattatagatatgtaagacctggagagacttaaagcagttcagagacaaaataaaagatattttgtccttcagaaaaagatttttctgcagtaagaaccagaagggatatatgcctgtacgacagaaagatcattctctaaatgtttttcttagggacaaagagaaatgctgatttgaaacaaagtgtcgaataccttcagtatgcagtgttggcattcaaaagcttcagtccattgattctgtatatagccttgtatttagtatatttagcaaaggggaggttcgtgttcagccacaaattcttcatctgagtcacaacctaactttggtcaattgacttattcttacttttcagatagggaggaaaatattctttatgccaaaaagggaataacattatcacaaataaaggaatactataaagtgccatgagctttgggaatgaaatttgctgtgatatggatatccgtgagctttctacactattatggtaatttcagtgacatcactccttagaggcctgaaagggaagctcagtcatttaaaaataaataaataaaacaattatcaggaaatagtatcttgaatataaaatgcacaaactgcaaaatgtaaaattagattaagccattgactgcctttatcccagcccttgtggatagacacgtggctgttagacacagtttgcaatttccacctttgtgaacagtagaaagcttagaatgatccaaattggagtactcaaaagattctgcaccttccgctgtttccagaattgtgactattcaggggctgagtgccactgatcaggcatcagtcttgcaggtatggattagccaacagtaaattcactagagcatccaagagaaatatattaatagaaattgctctttcagttttctaatgagcttttaagaatgaatatgcgcattggagcgtttgttagttgaacactcactaaagttccctacacattcactgcaatgcaatgtcaagagaaataaaaatttgcagatttttttttaaccagatcattaaaattgctctttttgtaacttcctacagctgaaggttgttttttcttttgtcccagtggtgggtggtaaatgaatagtatcaaacaacttgagaatgaaactagaggtaaaactagccagaccccttaactcctggatcagaaccagacaatactatgcaagaaggctcaattcccagcagcttcacgatccaaaacatctgtttctgtatttggcacaattccacttttttatttgtaaaattgttcccatctttgaaaacactttaaaaaataaagaagcccccattctgtctccctttccacttcccagcacatgcatctgtaattacctggtttagtctgtgtgtttaatcagtttaaattgagaatgttgcatacatctgatttcaatctgaaggagccattgagtattggacagttaccaccctgtgtctgccaaaacgtgcctctgccaaaaaacggataggactcacaccagggtatttcctaaagaagccacttgactcagattagatgtttaatttccttaaaatattgttttggatgtgagtctctgttctctaattggaatattctgatgtaatttaggaatatagcttatttgctgagtttgttccaggatccagctggcattattctaaaagcctaaacctcaaggaagttaacttcactctgagcactgagtattatacctcacagctttgaagggtgggccaggcccacgtttgctcacgtctttgtggaaccattgtacatgcaatgcagttgaattaattttgagagagaaaggcttcttgttatggtaatgagacttgcgatcagagcttcacatcttttgagatagtttcttaaattaattgaagtaggaaaaaattgttttgttctactactattcattcaaattttaacttatgacattttttgacatatcaaccaagtttctagatttcctcagcaatagtcacttaaaacacctgtcattggccagagtttgagattttaagtttttgttttgtttttgttttgtttttccgtgttggattgtaatttcttttttatttctgttttttgtttgagcttttctgctcaacatagcaatgtctgatggttaaagaaataagaacgtggagctgggctctttctaaaagttttaaattggagttcttgagttcaaaggctttcagcacatgccagcctctgggagcccatttatttgttaacaatgttaggatggctgctaaaaattcccttgcacgttttgcacagtggtaaagccatacacagggtgatgggctgacgtttcctaggagtatagtattgtcagcagctcatgagcttaccttaagccacacaaccagcatgctggaagcaaagcaaatgtagagaacacagtagggagacctgtgaatacctatgtcagggctttaaaaatctttcttatcacacaagcacatagcgtcagctgtttggggttaccagattgtagtcagaagtttgtttttcaaggacataatcaaaaccaatgaagttaaagaataaaaagttgaatgacataaagctaagattacttactacagttttgcataatgggatcggtcttgccaaagaaactaggaacatttaaacatttaaagtcagctttgtgaggtccccctccccaccacactcataggaggatccctgaaggttagtttcttcctcattcctccttgcctgcttagggcctgtccccaaaaggtgctcttctgtctctggtatgtttgtgctctaattcgtgatgcatttatcttaaagtttaaatcctggtggcagcctcagtcccacttttctcatgtcttgcaaaacactgcccacaactggcagtgaacttactagggtttgagttttgttctcatcactcccaaatgagccccagttccctctgcttttctgacttcccagagttgctgaggcacacaggagcagcagagcagctccgttggctggaaagaactgtgtgcaaatagaattgttatttggctggttttagcatttctcatttctcaaagccaaataaggcgtagtctaattcattcatttcacaaatatttattgaacacttctatctatcaggcacccattctgggtgcttcagatacagggagaaaaaacaaactgaggatcctgtcctccagggagctgaggtaaagggggttgttttaacacagtcctagcatttggttgtaaggttcactgaatggatgcactgaaagaactaaagacatagagaggttaaaggactttgcctcaccttgtctagtctgaaggagcagggaatagaatcccttatctactctattatatttatttgaatccaatatagatatggttctggtagtttctttgtgattccttttggtatctaaaaggaagaagcttctgctcagatatatctctgtgtctgactattgtggtataggtattgggaaaagatttggaaatagtaattgctagtcagtatgagtgaagggagaatttacatacaaagataaccaaacctaaaaagaaaggatgttatagtaagaacttaaaaagtcttcaactgctttgtcagatgccatagtagttgttggcagagcagtttggacaaccatcccatcaaaacctgcatcttctgtgtttagtgtttgtatccatacgtgaacacctggatttttcatcctgactgtatagttcttgaaaataaggctacagtgatgcctaacatatttgtcagactattgtcttaacagtgtattaatttgggatcttgctttcttctgccttctcctttagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggttta

SEQ ID NO: 14143 - DNA, 143550 bp, Human
aaagacaagtcctatttataattaattctccttaggaaagacagctttacttttttcaagtggtagaaaatataaatttctttcataagttctttgcttgttcatttctgtatcaattcaattcctactaatgtaattatcgtaagataaaacattgtttttttaataagggtgcttgaggctttttcatatgcatgagttagatgaatcatttattataatattattataatttattttgataagaataattttcatttctatttagcttcaggaaaatttttctgaattccctcaattatatgttcacaatatgtgaaagttatgggatcttcttttctgatacctgaggctctcctctcaaagtcattattacttagccaatcaattcagaaaaaaaagaaaatagtgatttacttttttatattcaaaatatgacaaaacaagtcattgaatactcctttctgcttttaaaggctatttttaacataaatatataactccttctcataaattaagatattgtctgtaaaagtatttggtaaagcctataggtaacagttataattgacaacttcttaagaattgtactgtaactaatcaagtgcgagtttgattgaaagtcattgttgtatttattaaagatgacatgcttcaaatatttttaatgaaaatacatttatgaaaaaatgacttatgtttgaaggatcaaatatgtttatattttataattatatgcatatatagatggacatataaatacatatatacacatagatatacagatatttatacacatgtttataatctatctcatggacatgaggacaatattctatgttatggcatagttaatataccctgagtaaactttatcctccagaatatgcgtttttaactttaaaacgtaagactctattaacagagctattaaatttatgtatgtagaggtgggtgtttatgtatgcgtaatcacagatgggtatttaatatttttcatttctttattcaatccaagggttcatcatgcaaaaatgttaaacgtccctctttgcactactaagataaaaaatgtgattttttacagatgatttatagaataaaccttatcagtttctttattttgcctaaatacttagatctagttctccttaaagttgttttctaacaaaaatagtgagtttcttagtctttgatacgtgttaatatgcctcctgcctataatctctgtttaagtgtccaaactcctcaaatgttttccatcattaaacattgataactctgccaggaagctatgtaaattgttctataaagatgaaaattagcctctgcttaaatcaatatgaccaccttagttgaaacttctgaggagctcaaattgtaaaatgttcagcacactagcactaggaatagggtggcaggactacccttgagggaccatgtacttattattattattatttttttagttggagtctcactctgtcgcccaggctggagtgcagtggcgtgatctccgctcactgcaacctccgtcttctgggttcaagcgattctcctgcctagcctcatgagtagctgggattacaggcatgcgccaccacgcccagccaatttttttttttttaatttttagtagagacggggtttcaccatactggtcaagctggtctcaaactcctgaccttgtgatccacccgccttggcctcccaaagtgctgggattacaggcgtgagccaccgcatccggccgagggaccatctactttaaggaatgcagagagatagacatcttaatttacttaataggatgtttggggcatgggataagtaaatttttcaaagagacagtattcatgcattggtaagatattgtttttctcagacgtgtgactttatcccaaaaatatgctattttaaaagacatttcttaaaatatgtatgtgtatgtttgttgatacttgcttattatatagctcatactgtttattaaaatatatctattacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaagtacgtatttgttttccatgatttgaatttatcattatctctttatgtaaagtaaaatgaaatacttgaacagtgttatgttactgttttcttaagtggaattgttctgtttttgtactatatgatcacccttcttcatgtaagactcatgaaatcactccagctattgtcttctgaacctaggaaataattgggaatgtgttcggagttggagtttcatttggcatcaagttaaatattaaaaatgatgtggtggtactaaaaaatggcatcttgcctttggcgaagtatctgtatattcttaaagtattcatggagatgttgaaaaggtattttgatgtgaacattcttttcatgcaacattattccatacattctgtgactgaattttttaaaaaaattcttcatgttatgaataaatgctgtatacaaatgcatgcatgtatgcacacacacacacacacacacacacacacacacacacacacgcatcatccaaaagcaagttgaagttaatatgataagatgaggtctcagagtaaaatataagacttgaaaacagaaagcataattcagtaggcaattttggggggagaggagaaatatgaatcctgtgggtttggagggagatggtgtttatgacatgttctgaatgtaaaggatataattataatatatttgagtttttaaaaatggaagatactatagataacattttatacgacagtcactaataatcacaaatatcctacagaggagttgtctcttatgttcctcttacaaatgatgtctaaaaactgtcataaattagatcctttggtacgtcatacaggctcttctcaaatcagcgcgaaatgcctttctcagctttatctcttgtctcttaatagcatttgcagtacacctcaggcctagacactgtggaatactgcctcctcctaaaatataataacactttgtacgtccttacttcaactaaaatttttccttattcacggccctttgttaaaatccctgctacaagtttctctgaagttcctgttgcagaattagaacagttttgcaattaattcctgttgcagaattactcactcttttttccctcttgcacagcacttttgcatgcttgttcgtgttatactaattttccctcttgcacagcacttttgcatgcttgttcatgttatactaatttctgcaggtacatagatccccttgcacagcacttttgcgtgcttgttcatgttatactaatttctgcaggtacatagatccccttccacttatgagatcctctaggaagacgcttaattgttttgcgaacttaggtgttcagcccagtgagggcccagcatttgataaatgattcttagtgagtaaattagttgaatttaaatactctgtcaaaccatcattattaaaagattattattaaatacatgcaaatcatagtcatagttaaataaaaatcattttaaaatgttgatgccagagataagataatgttacctggtgcattcatgtggcgtttgctctatgaagaaagtatatatcataggtaagtccatattttattgagccataaaatataattaaattttaaaccattttgcagattaggatgaacttttgtatcaatgttatcacttagttcaacaatgtgcatatacatgaggtaaatgttattatttcatagattggtacaattgaagttgaagataaagataataagcgataattcagactcaacagaatatactctttattataatttaggataccaacttgcctatcttgttttcaaatagattctaccaccactattttaaagatgtacattcatattgtagccttaatagacagaaaactcaggttgtaaatcataggattcagtaaatgctagtttgtagtaaatatagcatctcccactctctctttttctccatttcttcctaaaataattattaaaattacaggtttattaagattgactttgcagatgtacagaaaattttaattgtgatggatataaggaatattattcatatagatgaatatagatatataataaagagatatttgttcctaattttattatgttgatcaataatagtgtcattgttgaagcatcagtgtacagtgaaaataatcactttacctgacaaaacagaataagtgtatactctctgagttaactcattgtgtctaatgaattctatgtttcttcagtcagtaacattctggcagaatgactgacagatgtaaatcctgctgcatttcaaggtgttcttagagttttgaaaaggaggcactacacaatcagaagtttacacttggggtttcttaaaagatactttatttcgcactccatttgaacaaaacaattctgcttttgcaacagtttggtgtcaccatgacaaaagtagcttgtagtaaagtgctctttaatttatccataaattgcagcttattaaacagctatgtacctagtggggaagtattgtaaactgcttggagaaaagaaataatataaggacttgtattcacaaaataccatgacatgcgcaagtctatacacagctcaaattctataaagttcatatcctgtcatcaaatggatccagtagttgaattgtttctcttaatgtgaggtttttacagttgccctttctacttctttctctcatcacctgtctgagacagttatacttcttacaattgacacttgaataaacatccctaactacaaattttgcaaaaatattctctcaaagtgttttttcctccatgcttaatctaccatgcttgagaaagtgagtaggctagttatattgcatggtaattagttatccctttatcttgaagtaaataggctttgagtaagtgttagagaggtagtaaattagagctagtaatttgctttacaatgtctctactctagagagttacaaactcagtagcttaggatacaagtcagataaatgtcttggaggaaacaggctgcttgtcagtatcaggaatgtgaaaaaggagcatagagactggataatgcatgcccaactacaagggtagctactatttaattcaaattgatgcctacctctgggctacatggtgttggaaaaggagccactcaaacaaaacaaagcaaaacaaaaggactcatagtgaaagaaaacaaatcagcccatctatggcttgaaattctactcaaagtacacaaacgatgtgtacttctccttctagagaaaatcatccatctaaagatataaaattccctagtgtgtgttctttcattaaaggtaatctattttattctgccatttcctattctagtttttaaaaactgtattctgggttatggttgttgcataacttattcttggataggttaaaaagtcactgacatttatttattctgcacaaaccatatgcatataaaattcaataccttacatgaaagtttacaaaacaaaccttctatatcctaaatggaaggaattatattgttgtattgaggattgctcttgtaaggtaagtcatctagtaacagaaagaagcataacacatgccaaataatcacaatgaatcaacctttagggcttgatcctccaatattacattgcaccaactgcagccacaagtgagcttcagtttttggaaatttgctatcattatgttagcttaatctaacataactttctccagaacttaaatgatagtaaattgccaagaacgtaaactcacttgtgactgcagttggtttagtgccatgtaatattggaggatcaagctctaaaaattcaatagatggcagtatttcccataaagttagtaaacatcacaattgtttaactggtttgggtaatttctaaagttaatgagaaagaaaatattgctgaagatattggcattgattttttttggggggggagctgttgtttttattattttcattgttatgggtacaaatatgaatttatataatattttcatcattaaaattttgtttgaaacaaattaaaagaaaaagaaaacaaagcttctcccttgacccatcaaaatatgcaggattttttttaattatcaaagaattgaggtctttctagtgtcttttgaaagtgatatctgggtcattttattatagttgtaggcatatattttgaaacgttttgagcatttctttaaaatgccagtatatatttgattttgataactgttcctactcactttgaaataagataaattctgcagctgcatgtttagtattctacatatgtaaatttcattcaagtttattccttgtaccattccaattttctatatccttatagaatttttgctcgtctgttattgagagagatgttaaagtcttccaagatgatactagatgtttccatttctcttttttcctctgtttaatttttcttagatgcagttttaaaccatgctattggatgcacacagatcgaaggctttgatatctttctcttgattaaaattgttttattgtgaaatatatgtctatagttctaataatactccataccttaaagtctaatttgtctcctatagctattccagaggtttcttttttttcttcatttctttttggttatggtttgtgtggtataatgttttctataattgtactttcaaactttattgttcttaattttttattcttaatttataaatgtttcttgtgaccacttagctaatatttttgttgttgtttagtttaaaatgacattataatttctcttgcttttgttgatttactacactgataagtatcttaattactgatatagtttcatttaggtatatcatttgctatttggctaatcttttcttctccttttttcccctctctcatattctttgaattatttaatttcattcattttgtcctccattcactttttaaaaattttacatttttatacttttttctatttaaaaaatactgtagatattattatttatttcactctaccttaaattataatttcattgcttgaaaatagaatgactttaaaactgtttaatgtcattaaccctttgttgttgttttttctatttttgtcatcttatatattcagtcctatatgaaattgtcattgttgctgttgtgttaaatagcaaatcattattttttaagacagtaataatttacccttcctggtactatttatttctccttgaatttctgtgtttccttctagaattattgttttctaaagggaattgtaaatttcttaaaatattattttcccatttttagtgacagaaaactgccaatgaattttctcagcttttctatataaatttacaattttgcctttatttgcagaaggtatttccaatcagaatagaattttagtttgaaggattttctccatttcaataattattaatataatttgctgtttaccattttgttcattgaaaaatcaactgtagaattcctttactgtacaatagtttactgtagtttattggacctttcttctattaagatattctttgttatattttgttttcaaaaatttaacctacaatgcacctaggtatttactttttaaaaatctgactaatggttgtaaagattttttaagctatcttttattagttttgagaaactcttggtcagaattttttcaagtatttcttcgacctcattttctcacttcttttctattagttctacaaagtatgtcagctaggtctttcagttatataacattcatctattactgtctttgctgtataataattattattctacagtcttctacagtcttctttaacctggatattttatattaacctatattctagtacaccaatcctttcttctgctgtttgttcagcaattaaacccatctattaaatatattaagtacacacttcagcattgacatttttgttctaaaatttttatttggtttagtagataaagattattggtatctgttgaaattccccacccttttctttatttaaacatattaaccataaacatattaaccatacttatttcaaaactttttgtagaattctaatatcataatcatgcctgggtcattttttaaattttttccttcttagttttagccaatgctcatttttaatcatgactttgaattactgattgaacattacataaaggagttgcagaggttcatgattgtgcaatctttcaaagaggggcaagttatttcttgcagacatatacagtgtggattacttaaatcagttggattctgttagcactagcttattttattgctctccttacttccgggaagtagctcttattcctggaatccggatctttctttacttactctccactggtctcaagtgtttaccaatttctgactctccagtaactcatggctgctgaaatctctgcctagcgcctttgccttccagatgcactttctgttggtttctcagagcctctacaagtgtcaaagtagtggatgtgtctacaattaccacaagaaaaattgcatttgtttttttcctcacttacctgaggtttcttcttctctgtgcttttgtcctcaatttctcagcccctgtgccagctctgaactccaacctgtctccaaaagctacacaatttttgcttggactctttcaaccagcactacatatttttaaataccctcagtatatgtgcatataaaatttgttttgttatggtttctttctctcaagaatcatactccatcctgagttccctacattaattgccttcaatgccttaaaacagtcattttctatatactatgcatcttttagagttgttttatatgacagagttagatatacccctccatcatatccagatttgaaagatcattccacttaagtttaaatagaaagattatggaagataattagatgtattctctatcaatttgtattctatgtggctaaattgaaaggatgaactctaaaataaagatgaaattattaaattaactttaaatgagtaatattattattttattttcatttagccttcatagaaacacaatatttttatcttacatcatgatatttagtttataaagataattgaaaattattatgtatttattataataagacacatacacctgtagatcatattctttctaacaaagtaacagctataaataaataatagtattacattcttctgattttagaattgaatattttgaaattatatggagctctctgtttagaaacgtactagtcatgacatttcaattgtattacggtttgtttttaatctatgtggttgtgtactataataaagttacagaataattccttttcctttacataatattttgtttaggtaggtatgtttatggtaataagcatatatttcttggaaataatttgattcttatagttaggcattacaaatcaatttgcacaccttcaaagaatacttaaaaagtggactgaatttcaattaaaatttctaatagtctttcttcaagcatttatgtgttatttatgattaagagtgagagaaaacaaagaaagtgttccactataatacttgagagaaaaaaaaaacattctatagaataatcagctttcctatagtgcatgttgacacatagaaacagaatgtattgggttaaacgattttaaagatatttcttagaacagtaaagattctgatagaggaaaattgccctttttatttatggcattcaaatggcagtagtacttaaatttactttatttatgttttaaaaaacattgcacgtagagccaaccacaatgcttaataatcaatattcagcttaagtctcttaaatgcaggaaaatctcagaatactttgtgtgtgtgtgtgtgtgtgtgtgtgtgtgtgtgtgttttaatttgaaattagcattctcagcataaactgtatttgcataaacatttaaagtggagattataaaaactgtctggttaattttatcaggaaagacaggcaaactctgtaagtcagacatcatagtttctaacctctcacatgtcagtcagttttccctgagaagcatctcactttctcaagtaaatactataaaatagtaaatagttctaacaaatgtaatgattaaatttattacagcttttgtaagatagggccttggggtaatcatagggaatgacttattcaagtaaatgacaaaattactgtagtaaagacacaaggtcttttaaaaagcaactagaatcagtgctgtcctggaggaaaagaaagtatattaaaagggacaagcctcagtgagacaaatgcccttttattattcccaccatgtcttccttccttaagtgtattttccataatcagtagtatattatgatgcagtctaagaaattatgtgaaaagatcacatgtggcatacaaaactatggtgcatccagatacaaagctgttacacagtgagatctgtattcctaagctgtgtaaaattatgtagtcttaaaaccagaataaattattctagtactacttgaagaaattaaaaagtaaaaaaaattctaatgagttagaacataatttatatatattttatttatgtatttataatttatatatttatatatattttattgatactataaacaatttggtgcctaaaattgaaaaatgcacattgccctacctcatatctcagaaaatctaagcctcacacactgaaaatccaagcaaaactagcattttgaagataattatatattttggtagtaatatcactttttgtgattttggtcagattttcatcataaattcccagcatttgttgtgtctcttcttcatttttctattctgaaaaacagctcaattactagttgttctcattttgattttattttttgtagttaaaaaatatatacaataatatttatccttttaacaactctaatgtgtgcatttaaataacactacgtatattcatattgttgtgcaaccaatggtactattgaaatacagaagtcttttcgtcttgcaaaagtaaaactttgtacccattgtttaatgggtactttcccattttccctctcctgagtctctggttattcaactttctatctctatgaattttactgttctaggtactttatataagtggaatcatgcaatatttgtctttctgtgcctggctaactttggtaaacataatgtttcaaggttcatccaggctgtaagatgtatcaaattttaacttattttgtaatgataattaatattttatttaatgtgtatactgcattttatcagttcctctgttgctgcatgtttggagtgattctaccttttggctatcatgagtaaggtggctgtgaatatgggtgtaacaccccactttcagtgcttttaagtatatatccagaagcggaattgctagatcatatggtaattttatgtttatttatttactttttttttgagatggagtttcgctcttcttcaccaggctggagtgcaatggtgcgatcttggctcactgcaccctccgcctcctggattcaagggattcttctgcctcagcctcctgattagctgggattacaggtgccctccaccatgcccagctaattttttgtacttttagtagagatagggttttatcatgttggccaggctgatcttgaactcctgactgcaggtgatccacctgccttggccacccaaaatgctaggattacaggcatgagccaccacgccctgccatgtttaatttttttagaggcctccatactgttctccacaatggctataccatttcactgctccactaacagggcacaagagttctaatttctccacatcctcaccaacactagtcattgtcttctttttttttaattttaattttttatcttttttggagagatgtctattccagttctttgcctatttaaaagattggattgtgtgtgtgtgtgtgtgttttgcagtgttaacttataatagtttgcatttatttatgtctttaatttatttccacaatattttgtcattgtcagtgcacacattttttgttagatttattcctaaatattttatcatttttatggtattaagaacggaattgctttattttcttttgcaattattcattatcttgtaactttgctgaattactttattagttctaaaagtttgtgtgtgtttgtatgtgggggtgtgtctgtatttgtgtactccctatggctttctatgtataagatcatgtcatctgtgaacagagataattgtattacttccttcccaatttggatgcttttaatttctttttcttgccttattactctggctaggatttccagtattatgttgaataaaagttcaaaagtaggcatcctcttttgttcctggtcttacagtaaatgcatttagtctttcaccattttagtgatattagttgtggggttttaacatatggcttctattatgttgaggaagtttcttttatttatagttctattttatgtttttttaaatcataaaatggaattgaattttgtcaattgctttttctgtagaattgacatgaccttgtgatttttttctttattctgttaatggaaatgaaaattaattgattttcatatgttgaactaagcttgtattccaggaaaaaaaatcccaattgctcatggtgtacattcctttgatattatgctgaaatcagtttactagtattttgttaataatttttgtattaatattcataaggaatattggtttttaattttctattattttagtgtctttgtctatttttggtttcaggagaatgctggtcttataaaataaattaggtaatttccctctttttttactttttgcaagattttgagaatttgtgttaattctcctttaaatggttagtagaattaaaccagtacagccatctgttgcagggcttttctttcttgggaagtttttgatggcttattgactctccttatcagtagtatgtctattcagaattttcatttcttcctaattttgtcatggtaagtcatatttaaaagaatatattcattatttatacattctccagttagttggtatttgtttgcaggacttccttgtaaaatccttttatttctgtaaaatcagggtagtgtttctactttatttctgattgtaattatttgagagtcctctttctctttcttagccaatcaattttgttgatctttttctagagagaacagattcttggaactgggctttgtaacctcttgcagaccaagatctccttgccctgggaagggaatggggcaagagcaagttgaaacaccacagatgcttaatgcttgaatttattttttccttagttgaggattttcttgctttctgtacacgtttgaatatttccaagagcttttataagtttatttcacctagttttaagtcacttgttccctcatggaaacatcgaaaagcaacttaaaactagctgagctaaacttataaaaactctgggaaatattcaaatgtgtacaggcttggagctttgtaatctgccatttttctaatgtaagtcccatctttgtttttttaggcatttaaatcataagtgctaccaatacatttaatttttccagataagaaaaggattccaccttaaaaataatgtaaggcattaaaatactacatatcctatagtacatattagtgtggtagatatttcattcaaggaaaaaatttctccccatgtactttctatttttttcatgaaagtatctaataattgccaagaatggacagaccttcatgaaaactatatttctttttttcaagaaaaaggacagaaaaataaattcaagtgtataaattactgttaaaataattaggtatctagtatgaaaaaataatttaatttagaggagtgaggagagacaacccttagtgaccctaagcatcgactttagtgttatagagaacagctggctcagtagatataagttaatttaagacattaaaagttggtaccagctgaaaaactctagaggcttatttatttttatttttatttttaattattatacttttaagttctagggtagatgtgcacaacgtgcaggtttgttacatatgtatacatgtgcatgttggtttgctgcacccattaactcgtcatttacattaggtatatctcctagtgctatccctcccccctcccccacccacgacaggccccggtgtgtgatgtttcccttcctgtgtccaagtgttctcatagtttaattcccacctatgagtgagaacatgcagtgtttggttttctgtccttgcaatagtttgctgagaatgatggtttccagcttcatccatagcaaagtgacctttacagttaaagagctcccctgttgcatggctaaataggtgctccagtgctcactgtctctcccaccctgaaaacatggagaacattatgggaattggatttctttctattgaggttctgttttggttttgtttttgtttttgttttgtttttattgagacacagtctcgctctgtcgcccaggctggagtgcagtggtgcgatctcggctcactgcaagctctgcctcccgggttcacgccattctcctgcctcagctacaggcatcttccaccaccatgcccggctaattttttgtatttttagtagagatggggtttcaccgtgttagccaggatggtctcgatctcttgatctcgtgatctgcccgcctcggcctcccaaagtgctgggattataggcgtgagccaccacgcctggccggctctgtgtttttttagtcactctttactgctacacaaatcagatgaaatatcgtcacagagctgatgactattaataactgggggtgttcttttctcacttatgtatatgatgaccaaaatatatactgtaagtgtactgggccagcataataaatatgaatatttttatattcataaaagcagagctacgtgtaaagcagcataacatctgttttacttagtaaatacttgaaaaataaattcttgcattttgaaaatacatgttaaatgacttgaatttttataaaaagacacataatccattatataacagatattgtttacatcaatttcttcattatatcaactagattcatgatccatgtcttttagattatataatcttaggacatctatgaatatgttgcgtctattatataacactgtgtgtacatatatttgtgtatgtaaatatatatacacacacatatatggaaattatatttgaaagtttaaagttattatcttttacggtagaatactaaatatgatatcactacaatcacaaagcaataaacattatcaattgagtcatatgatttttaaaaaaattattttagtgataaaacaacaaattgccttttttctattttgtctattccaatttttcattaatagtcacatattagtgcatagttataaataaccctttgttataaatacaaatttgacattttatttgcaaattttagtaattctgtgaagttggacaaccagattctaaaagttatattaccattactgtttctatgtggcttaaatagctggaatttactaaagataacacatctcttcattgtgggatgtcctttgctacagccaacttgagtaatttttaatactaaacataattatttaacagttgtaagtttcatggacataaacaattttagggaagtgaggagataatttaattttgttatcaaattgatattttaaaaatacaattatcatttagttttttcatttcttgttttttatttgttttgttttcaatatagtttgtatcagcaaatggggagtgttacatgaagtttaaccttcatatttggttcattcagtttcctatgtccttcttttgttgtaaactttaaacaatttattcttttttcattgttctacattttaaattttccaaatagtttcaatttccttttttaaaaaaagatgcaagattgtaaatgcccagcgtaaagttggagatgaccatcctttgaatattttaacagaaactcaggatatagtagaagtgactattcatttgggagccataagtttatatgttgatgttgaaaccacagggacaaatgtacctttctagagtgtgtatataaggaatagaaatgaggtactaagttacggacaatactctcttttaagaaaaaagtgaaagataagtctgtaatgaaactgagatattagcaaagtagtgatacaaccagggaaggtctgtgttctaaaactctagagagggccttttttatagctgtagcctaagtaaattttcctgcatgtgaataaggagatatgtaaagtaaaattcatttgactatttctaaattagaaaaatataaggttagataacttgtagcatattattaaaataaacactacattctaattaacaaactagaactatatgcgacatcttagttacatctcaaattatgattttgaataaaaaatacaaaaaaagatgaatataaacataaaatctaaataaccatactatttgaatatgtatttgtggaaacacattacattaatatttttaagttatataaggggatgatcatggttctgggaagatgagctgagaatttgattatagcaaatggctcacttagaagcatcacctatgccttcaatagtatgttactttatcaaatgagaactgaagcaaatacaccaaaacattaagatttgacagcatacgtgtgtgtttcatgacattttttatttgtttttttttctgttagaaatatatcaaagtataaaatcataggaggagaaataatcagcaataagggtgcaatagaatcatgttttgtttgtttgtttattttggttttcagttttcctcaacataactcacagtgccccaggatgacaagaacaataaaagaatgcatttgaattagcaaatcactggcaactactgcaaaagtgtgtatagcttatctttgcctgtgttgcaaagcattccaattggcatattaaaacaactaatatttattatttcacaatttctgtaggtcaggaatctagctatggtttagatgagtgcctttggttcatgcttatgagattccagtgtagaagtcagcaggggctgaggtcttgcccaaaggcttacctcagtggaggtggagctggtttctgcttccagcttactcacatggcttttggcaggcatcactcacttgctctatgggctgcaacgaaacataacagatagcttgccccagagagtgatacaagagggagtgagaaagtgttcccatgatagaagccacagtctttttgtaacctagtcttgtaagagatgtccgattacttttgctgaactccatcataagtgagccactatatctagccaacattcaagaggaaatgattactcaaggacatgatcagcaggatgcatggataaaatgtggccgccttgaaggctgtctactaaaagttgactcttaatttacaaattataattctcaactcaatggagagtgtacaaaatattaatcttaatgcactcctttgtttaatgggacatagtgaatggggaagttactattcttgcaattcttaaaatgtgtcaagaattatcaggttttttttctataaacataatctgcctgtaccaggaatctgtttcatattttaagacccagcctaaatgttttctgggccgtgagtcttttgtgacccatttgaacagttttttgcaatccgctttgtgaaaacaaccttctttataacgctatcatcatagtaattctataatgtatttatttatctctgttaactaagacatctttggttttctagtgttaccatcctagtattaactacttgacaggtttttgaaggcttatgtaatagtggttaattctggtttagttggaccttggagaccacagcatccaaaaaaattgactccttctagtctctgtctcaaaatattttagagaatttgtaccaatttattttgtaatatgtctatacattttgttgagcaaaacagtgtcccattatagatgtgacttttcaggaacatcatgatattttcaaggccagtgcaaatcacatggcttctctttgatgctgattttatgccctcaaatttggcctttcaacatcaattttggaaacacgaccattgacaaaagcctcttcttagtatttcatagctgtgccaccaaagagagatgaaagttattttctagttccagttcaacatttttgagaaatatactctttttggagatgtttgaaaaactgcctacccttcaccaatcaactgtgagaacgaaggagggatcctataacatttgggtctcatgcttttcccatgccaattcacagaatcaaggaagatagatcttttagtaatggtagatcttgataaaaccatatggttaaggtcaagggattgtttgtttaaaagaagagggtgttttacacaggaaaagatatgttggttgaacatacaatttattcggacatttagtttagttagactaaaagctaatgtctttcttactttgctgtgagtttattccaggtgtattctccaatgcttatgaaagagagctgagaaaaatatttgttgaacattgactaaacacaaacacatacatgaacacgtgtgtcaacccttagtatctatacatgcacatttaaaattatacatttttgtctttagaagtttatcaaatgatttttttatttttgagatggagtctcgctctgtcgcccaggctgagtgcagtggcacaacgtcggctcactgcaacctctgcctcccaggttcaagcgattctcctgcctcagtctcccaagtagctgggattacaggcgtgtgccaccacacccagctaatttttgtatttttggtagggatgggatttcaccatgttggtcaggctagtctcgaacaggtctcgagccaccgtaccaggttcaaataaatattttaaaccatgaacactgaatgtctttccatttatttgtctttttacatttttcatccatgttttctagtttacggtgtataagtccttcacttccttttgtctttttacatttttcatccatgttttataattttcagtgcatgagactttcacttccttagtttatttatacagattttattcatttcaatgctattataaatgggattatttttctaactttttcaaataatttttattagtgtgtatagatgcaactaatttttttgttgattttatgtctgcaactttaccgaatttgtttattagttataacaatttttgttttttgtggagcctgtttttttatatatgtaatattatgttatctacaaacaaggacagttttacttatttcattctgatttagttcccttttattttttttaaatgcctaattgctctggctatgtcttccagtactattttgaaaagaagtggtaagagtgggcatccttgctttgttcctgatcttattggaaaagcattaagcttttatgtatataatgttatcagttgcactctcataaaatgtctatactacattttaactctacaagtacagtaaaatccctatcaaaatccaaatgacatttttttacagggagagcaaagaacaattctaaaatatatgtggaaagacaaaggccctgaagaagcaaaacaatgttgaaaaagaagaacaaagctggaggcaacacacttgctgatttcaaaatattttaaaatgctgcagtaattaaaatagtatggtaatggcatacagacagatatgtaggccagtggaacagagtagagcctctaaataaatccagacacaggtagtaaaatcatcttcaacaaggttgctaagaatacacaatgagaaaaggatagtctctttaaaaacaggccgggcgaagtggctcatgcctgtaatcccagcactttggaaggcagagacaggtggatcacgaggtcaggagttcaagaccagtctggccaacatagtgaaaccctgtctctactaaaaatacaaaaaattagctgtgtgtggtggtgcgggcctgtaatcacagctactcaggaggttgaggcagaagaatcctgtgaagccaggaggcagagcttgcagtgagccaagatgcaccattccactccagccagagtgagattccgtgtcaaaaaacaaaacaaaacaaaacaaacaaacaaaaaaatgcattgaaaactcattatctatatacagaagaatgaaaatggcttctttttgtatatcatacacaaacactaattcaaactggattaacaagttaaacataaaatctgaaactgcacaactcttaaaagaaaaaaataggggtaaagctttatgacgttagtcttgataatgattaatctgatatgacctgcaaatcccaggcaataataacaaaaacagacaaatgggactatatcaagttgtaaatttttaacacaacaaaggaaacaatctacagagtgaaaagcagcctgtgaagtggaatgaaatatttgcaagccctgtctgctaaaaggcttatttccaaaataaaactcctacaactcaataataaaaggaaagaagaagaagaagaagaagaagaagaacaagaagaagaagaagaagaagaaggaggaggaggaagaggaagagaaggaggaggaagaaggaggtagaaggggagggggagtgggtgaaggaggagaaggaggaggaagaacgggagggggagtgggtgaagtagaaggggagggggagacagaagtgggaaagaaagggaggaggagagggagaaggagaagaaggaaggaaaaaaatgatcaataacctgattaaaaaatgggcctaggacctgaatagctgtttctctaaagaacacatacaaatggacaataggtacgtataaagatgctcaatgtcaccagtcatcatggaaatgcaaatcaaaactacagtatgataacacctcatacctctcaggatggctatttatgaaaaaagccaatgacagaaaagtattgttgaggatgtgaagacatttgaacccttgcaaactgttggtagaaatgtgaacttgtgtagcgtctacagaatatagtataaagattcctcaaaaattaaaagtaaaattactatatgacctaatgaccacacttctgagtatttatttaaaaaatcgaaatcaggattacaaataaatattagcattcctatgtttattgcagcattattcacaatagctaagacatggaaacaatctaaatgtccatagacagagaatgtagagaaaaatgtggtttatcaaacaatggaatagtatttagccttaaaaaaagagatcttgcaatacgcaacaacatggatgactactgaggacagtagactgaattaaatcaaccagtcactgaagggcaaatatagtactgcatatttcaagcagatgaggtatctaaaatagtaaaattcatacaatcaaagaatggagtggttgttaccagggactagggaaggtgagtgaggagttgctaatcaacaaatataaaattgtcattatgcaaaatgaataagtcctagagatctgctgaaaaatactgtgtctatgaatagcaaggctgtgttgtgtagaaatttgtttatcggatggatctcatattaagtgttcttatcacaataataaaaaatgatattttcaacattcactagattagacttttgttttcagtatcatatcactaatgacaaatgattgtctcactgaaattatttttctagagattgtgtattcacttatctatatagtctatgtccttgtatagcattgaatcactattaatttaatcttggtagaaattattttatcaaattacattttaattcaagattcctgggcttctgttatttataatgttttgaattttctataataaattgctctaataagcttttttaacttgtcaataaaacaattattaaaaacatgttcattatgcttcttaatataagcactatagaaacggttccattcgacatttaatatcaggacaaactttggaaaaatgatctttgtacctattagacaatgagagtataaaattaacagtgctttaaaattgttagctatctatctaatctatctatctgtctatctatccatctgtctaatgagctacttgtgtacatatacttttctatttggattgtgtgaaatctcattaattcttcttctagtaattacaattgtatattgatttaaaattgaatattaacttgtctgttgaatactatcataggggagttctaagaataaattggttttaacacttagagaacaataatcaccacttgtgtatataaaatatcactgtcttcacccaaaatattaggtgtcaaaattaatgctaattcacaaatgctgtttaattttctatagctatttactttctcatgcttcaactctgtaatcgatttttaaaaattttaataactttgttatttaaaactttattatgaagccacctcaaatcctttttagaagctgatagggaatttatgctaaagaaatatgtaactacattcacgttctcggacatgactgtatatctcactattcttgataaaaataattatctatattcacaaacaggctatggcattttatcttgtttttctgttgaattccatatttccatactttttgtttccacatttttatatttgaacttcacatttacgatgggtggaagaataaattgggattacactaatacttgactaattcagttttggttcaaaatcagaatgaaaactttacctctcttctaattgtctgtagcttaagggtttagagctaataaaatatttcatattcaaatatagaaattattttcatgcaaagtattttacgtaccttttaaagtttatataaatctagtatttaattacaaaatagtctacttttaaaatctaaaaaagtccatttgatgcattacctaatatagtcttcatttgaatatgtgctctaaatatttattttttcttgtaagattatttcatgaacattgtatttaaatatgtttaatatgaaatgtcttccagaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaaggtaaaaagaacatactttttgtgattcaggcaactcactcatcttttcctgaatggaaatttggcagaggcatgaataatccacgctgtcaggccattaaaatgataaaatattgtcactttgcgatataattacattttaattgttgtttgtcaactgtttagatcttttcttcagaaaatatgttttgctgcggtgggaagatctgatgtagactacactaacaatgtttctctccatctttgttcattttgtctctgctctaatcttcctgaaatgtcccaatgttaatagtcaagaattaaataaaagtaatttcagtgaagtgcaaagaatcaaagcatcatcctaataaagctgtggtgattctgttatagccagagaggatgacgaagggggctgagatatttgccattttaaaatgtactccaggtgattctacagtagaactatttagataacaggctgagatattttattctaatgtgcctactgtagatgttgatgtgagcctgttgtctatctatctatctatctgtctgtctgtctatctatctatctatctatctatccatctgtctagctacttgtatacatatacttttctatttggattgtatgaaatctcattaattcttcttctagtaattataattttatattgatttaaaattgaaaattaacttgtctgttgaatactaccatggggaagttctaagaataacttggttttaaacacttagagaacaataatcaccactggtacatataaaatatcaatgtcttcacctaaagtattttctcattgtaaattttttttctcaaattgtcaaacctaggtcaaggggataatgaaaagagacaatttgcatatttatttaacaaatgtatttattttgagttccttcaatgtgtcagttgctatgttccacatgagctatgcaaagaataagaaggataagtctggagcaaaggcagactcagcccctacatgcacacagcttctaatctatggacgtggacagacattaatcaaatatcacataaattcctagatcaataatatgtttactatgaagaagagttatatagtgctacaggggaaaaatctagaatatttaatcctttctggtattcagcaatagttaaagagagaattgaaagaagcctaggagtaaattagatatagactgtaaggatgactatttcaggaagacagaaaatgtaccaagtgcctgaggtgagtgaaacatggcacatttaagggatcaaaataatgtggctgaatccagagtagagggaatgaggaatgcagtcagtgggcacaagagcacacaaggccttgctgaattttgccaaatggaaagccattgaagagatgtaagaaaaaagtgactaggtctaatttgatgtcaagatttctgattgctgaattaagcaacatgatgccaaggctgtgtgttaacttatcactgcattcccaacatctagcatttttttctgacacagagttggcattcaataaatattagagtaattaatggatgaggatgtggatacaaaggtgagaagaggattgcctgcttttcattttatgggtgacttctttactcaaaataattcaggtaaactggattaattttttctaaaagattaatctgacaactgattgtttaagaaacaagcatgaaaacggaggaaatataatcttggaggaaatcttcaaataataggagagaatgttggcattgaatattcccaagggacgctgttcaggaggtagctagtcatcaaaaagtgaactgttctagaaatttaaaacaattttggattataaacattgattggattcggctaaaggaagtacaggattgactgggtgattatcattagcaggttgtatttgatcaactttagagtaagtgtcatgtggcaacgaggagaatgtatattctgttgttttggggtggagagttctatagataactatcagaatctactaaatagatatcttctagagccagagctgagttcaggtcctaaatatctttattacttttctgtcttgatgatctgtctcataatgtcagtgaggttttaaagtctcccactattattgtgtgggagtctaagtctctttgaaggtttctaagagcttgctgtatgaatctgggtactcctgtattgagtccatatacatttagtgtagttacttcgtgttgaattgaaccctttaccattatgtaatgctctttttttgtctttttcgatcttttttggcttaaagtctgttctgtcagaaactaggattgcaacccctgctttttcctgttttccatttgcttggtaaatttttcttcatccctttatgagcccataagtgtctttgcacgtgagatgggtcttttgaaaacagcataccaatggctcttggctctttctccagcttgccactctgtgtctttttattggggggtttagcctatttacatttaatgttagtattgttatgagtggatttgatccagtcattatgatgctagctggttattttgcacagttgtttatatggttgcttcatagagtcactggtctgtgtatttcagtgtgttttttaggccgataacaagtttttctttccatatttaatacttccttcagaagctcttgtaaggcagatatggtggtaatgaattccctcagcatttatttgtctggaaaggattttatttctccttcgcttataaagcttctggccagggcaatcaggcaagagaaaaaaaataaagggtattcagataggaagagaggaaatcaaattttctttgcagatgacataaccctatatctcggaaacttcctcatctgagcccaaaagctacttaagctgataagcaacttcagcaaagtctcaggatacaacatcaatatgcaaaaatcaccagcattcctatacaccaacaataggcaagcctaaaacaaatcatgaatgaactctcattcacaatcaccacaaaaagagtaaaatacctagcgatatggttaacaagggaagcaaaggacctattcaagaagaactacaaaccactgctcaaagaaatcagagatgacagaaacaaacgaaaaaaattccatgctcatggataggaagaatcaatatcgtgaaattggccatactgcccaaagcaatcaatagattcagtgctatttccatgaaactatcattaacattcttcagagaattagaaaaaaatgatttaaaatttatatgaaaccaaaaagcctgaagagccaaggcaatcctaagcaaaaagaaatctggaggcattatgctatctgacttcaaactatactacagtgctacagtaaccaaaacaacatggtactggtacaaaaaaaaaaagacacacagaccaatggaaaacaatacaaaacccacacataagactgcatacttaccactatctgatctttgacaaacctgacaaaaacaagcaatggagaaaggattccctatttaataaattgtgctgggacaactggctaaccatatgcagaaaattgaaactgacacccttccttatactacatacaaaaatcaattcaacatgcattaaagacttaaatgtaaaacccaaaactataaaaatcctagaagaaaaacctacgtattacctttcaggacataggcacaggcaaagatatcatgacgaagagccctaaagcaattgcaacaaaagctaaaactgacaaagaagttctgttaggttgatgcaaaagtaattgcaggttttggcatttattttagttgcaaaatcacaattacttttgtaccaatctaataattaaactaaatagcttcttcacagtaaaagaaactatcaacaggttaaacagacaacatacagaatgggagaagatttttgtaatctatgcatctgacaaagctctaatatccagcatctataagtatcttaaatgtatttgcaagaaaaaaaaaacctcattaaaaagtgggcaaaggacatgaacagacagacacttcccaaaagaagacatttatgcagtcaacaaacatatgaaaaaaagctcaacatcactgatcattagagaaatgcaaatctaaaccacaatgtgataccatctcacaccagtcagaatggcttttattaaaaagtcaaatacaacagatgctaacgaggttgtggagaaaaaggaacacttttacactgctggtagaagtgtaaattagttcaaccgttctggaagacagtgtggcaattcctcaaagacctagaggcagaactaccatttgatccagcaatcccattactgggtatatacccaaaggaatatcattcattctgttataaagacacatgcatgtctatgtttattgcaggactattcacaatagtaaagacatggaatcaacctaaatgttcatcaatgatagactaggtaaagataatgtggtgcatatacaccacgcaatactatgcagcaataaaaaggaactacattcgtgtcctttgtagggacatagacagagttgaaggccattatttaggcaaactaatgcgggaacagaaaaccaaatacgacgtgctctgacttataagtgggagctaaatgatgagaatacatggacacatagggttaacaacacacacgggcctataggagtagggggtgggagaagggagagggtcaggaagtatagctaagggatgctgggcttaatacctaggtgatgggttaatctgtgcggcagaccaccatggcacatgtttacctatgtaacaaacctgcatatcctgcacatgtgccactgaacttaaaataaaagttgaaaataaaaaaataaaataaaatgcctttaagaagaaaaaaatagtagcagcaactaatatttgttagagtatttcctctgtatcaagacagattttaagcacattgcaatgtctttattgaattaatatacccataattgtccttttaattcttactgtgacattttgggaaagagagtgttattatccccgctttatagctaaagaaactgaatcacaacgcgataaaaatagtgcccaagcagaaagttgacagaaaactgaattggggtgtctgtcatcagagtctgaacacttactcatgttatatattcagatggaagatatgtgattattctttgctacaatggagagagaaactaattgtgatgaggtggagagagaatgggaagcaaaaatatgggaggaaaaaaatagaaaaacactgtcttcttggagaaggttagtacctacgtggtggagaaagattataaagcaaataaaccaagaacacaatgaaataaatgttttaattttaagttgggagacaagagtgtttctatgcacagggacaaaaagctcaatacagacaagacatcaaggatactgatgtagtctagggatactgaagagaggataagtaatttaaaaagattcattatgggtggagatgaacctcaaaagaatcctgaatcacaagtgcaaggaaacaacctaagatagtatgcctccatctctgaggttaccataggacagaagatagaagcaaatgactgcgggtaagtttgcaatgatgtagtgaggatgtgtatgggtgcagtggtggcgttcctgtgtattaagtcctattgtttttataaaatggaaaacaacttcatattgacaaaaagtgaaagtggcagtggatggtttgattacacacgtaatctgaagtatgactatcagttgtagaattaaggacggtgcacatatctcaccaccttacatggctacaattaattagaggtctgaaaaacaaaggtaaaattatatatgttaatgtgtgtgcacatatttaattaatttaatattaatggttcattctatttggtgcatatacacacaatgcatattttcaagatcagaatcgtttcaattctgtaaatggtaagtgatgatgtactaaaaatattcttgacatttaataagttcaaattgtctttcacttttttccttgaatttttttttttttggagatagagtcttgctctgtcacccaggctggagtgcagtggtgcgatcttgactcactgccgcctcggtccctagtgcccaagtgatttttccacttcagtctccctggtagctgggaccacaggtgagcaccaccaagcctggctattttttcttttttctttttctttttctttttttcttttttttttttttttttttgtatttttagtagaaacggggcctcaccatgttgccctggctggtctctaactcctgagcccaaacgatctgccagcttccgcctcccaaactgctgggattacaggtgtgagccactgcatctggcctcccttgaacatattttttaatgtagtctagatttcctctgaggtatgtacatgttgcattcacgtaattttttgatacttctgattaggattatcaatctcagagttatttaattgctgtatgctttagggcataaataattgcaatttcaaaaacctgtatacctgagtggattttaaccttcaagagatactcattgagatggcagaaaaaagataaaacagttcttaaaaacctattccttatttaatctctaaggcagttcactttagccagctgggcagaacagctaatctcctcacagatagaaatcagcactgctctataaatccgccagcaggactgtctgcaacgttcctgtctgtatcattccttcatcagaaaattgccaagttgaattcactggtgcatggtgtggtacattgtaaatacactttgataactttcattcattgtttaatgaagcctggctgggtggaaaggggaaaaaagataaggatgaatgcaattggatgtactctctttcctctgacataaacctcttgtagctagagatgtgcttctccttagcagcctttctcaaagtctcttcttatatggctcctatttgcacactttacagaagtggatccaaatattatgttttctttaggtttctgattctatttggccttctgattttcagcaaatactgttgtgttgtcattcccttctaactaattcaactgtaaatacaatgcaaattaacttaagccaaaaaattttaaacttgtccttcgagtcaacaaaggatgcttgaagatataaccttactgtaaaatgaaatataaatcttgatcttgtcatttaggagatctatgacattatctcaactctttgaagtgtcagttttcttgtttaagcactttacagggtgattatggaaaacatgaaacgaggtgaaaattgtgctctaagctatgtctgtctaataattactactacctcaataataactactatctaatactacctcaatacttctttttccttgccttcttttcttcctatttttgcaccagtttttaattatacctccagaccaatccatgtgaagattttgattttgctgccatctttatttcacgttatttgatttaactggaagcaaactaagaatgaaataccgtgtgtatattacaacacaatgtatatactgtcttcatgtttcttggcaatcaacttcctcttcctgcttcttcaagagaagactttttttaagtttacgttaaatatcgtatttgtagtacaacatgttcaggtacatttcagtcataaatatcttttggattatctttttggtttcacttatcaaaatatgcatttctataacttctgaatgtggaaaacctatcagttttattttcctcttaaagttgtagcttctgataggataagaattttcaaaaattaatttactgtgaatgtactgataattttcctgagtgtgtatctatgtgtactacaagtgtatccctgcctataggagacataaaacactttcataaccaagtactgtgtatttttaagatttccataccccaccatgggtaaaatattatcaaacccttttatttaacacatgatttgagatgggtcttaagagtaaacactgaaagttataaatttgttttttaaagtttaagtaaattataagataaaaacatgaaatatgttccgctacaaccatactagatttattctacatactatatttctggtcttttagtggattgtgtttattgaggattacattgtcattcctttgacttgcatttagtaacacaataaggatcgaatgttgtttactaacagattttaacatttttagactttgaaccacaaagagtaataaataagtcatcccaacccattgtgaataatcacacacaggcaaacacatgatcacaaactataaataagaaacagtagatttctaattctaatggactgcttacaaaatatgaacattccttaggaatttcattatcaaaaaaaactcaactaagtttctgttttatattcttataaggttctaaagtctgaaaagttattcttttcagccacagctgatagaggaattccaagtttcaattcagtaatatctattactatattttggatgactttgacacggaaacgctattgggtaaattatttttcatgctgttcatctataggcataatgatgagcctggagtaataaatcgtttgaaacttcattgaaagctaattgattgttttgacacatatattcctaaaatacagtttatgcagtatttggaaactaatgatctgacgaaacatcttgatgaattaagctatatatatgcatgggctgttggtaagtttgtgtatgtattgggtatttttaattattttatttatgtcatatatacacatacacgtgcacacatatgcacaaaacacatagatatacatatacacacatatgagcttgtgtataattatatataaataataataagcatactttctgtataatataatgtatacttaagctatttgaaatgaaagatctttgcacttatttgtccagtgttcaaatgacagaaagcaaacatgtaatatttatttgtatcagtgtccttagaattatacacaatgaataagaattactttcttctgtatagagaaatatatgatgagaaagcttatgcatatactccggtttccacagactgtccatcatccaggccagacctctgacaagggccacaaagcatattataatacaaaagcctagctggagaaacgctgcttaaattcatacaattttcctgtgttttgacaaaataccataatataagttaaatacttttccagaaaacaaaaaattaataatgatgtcagtcactattcctggtctaggccattttatttaatgattaagatgacaattttatgtatgaaaatgttgatatcgaccctatctacccaatcttggaactaaaatctggatgctggtgaagcataggaatcagacaaagaagaggtcatgaagagtctcttctcttattagttaggagaatagaattttagaacctctctaaactctaagaataattgactcatacggcaacttggctaaacagcattttcaatatccttgtatttataatggttatatagttccagagaagaatataatagggtgatttaaggaataatagaagtgattaatgagaaacaattaaaaagtcctgaatatgtaaatctggctgggaaacgattgatgggaaaatgataactaactatagtaatatgaaatggattaatattagaggagaaagtactactttacaagttagaaagagcaatgatatgtaaaagtaattaggagttataggatgaaattaagaaactaaaatttaaaatgaaaatcagtgtcaactcattgacagtaagctgttaaattaggatatagagcagtagctaaagaaaagtaagagaagcccaattgcctggggaagtaaaaaattatgccagaataaacacttctagcaagggctgagaagataaacaattttatcaatagcattttagtttcttagcttatgcatctgagaattaaagaaattacaaaagtactcagagttctagtagttaagcttagtgaatgtatcagctcatttttaacttaataataaatacttgaaaagatgatgatgaaggtatcttttaatggtgaatttattatattccactaaaaaaattgtttatctttatcatcaaaatgaaatattatattacactacttatttgctatttagatttccaccaggataacatagtgcttaaggacacagcttatacacttcctctgcctgagtttaaatcccaagtacatcacttacagactgttgtccataaggagtttcttaactgtcctatgccttagtttcctcatttgtagatgggaacaattatatctcacacaggtgttgtgaaggttaaataaattaatatatgttaattgtttagggcataggtcggtgttaagtattatatttcaaaaataatattaaattttttatccatcaaatctaaaccatgtaatagcacctttctgtactctgaaaacagctgtatttgagatggagaaagagctattaatcaaattccatgtgctaggaattattttagatacatgactatgaaatgaattagataatattttttctcttagggaaaactgggtagacatgatatattgttataatacaagatgtcagcccataccaactgttaatgatataggtttgccttaattgttatgagtttagaaattaaaaagaaccaacttttcaaagatgggaaggggtcagtgaaatatttgcatgggaaattatttttaaacatgtgtggactttggatactcaagaaaataaattcagccaaaggatttatatccacccatattgtccttcaagtatggaaattatgaccaaaaaactttgaacattacaatatgctaattaccttagtttgattattacacgttgtatgcatatgtcaatagtttacattttatcccataccccgtaaatatgtataattattgtgtcattaaaaataaaatgaaactaaaaaaacttctgaccagttggaataatctacctaaatattagttagcacctttaattgggatcaatgtaaaattctgtatttagaaacaataaataattatatttctttggggggggtggattgaaggatattttattgggaagtaatgtatcttaccaagaaatacttgtgggtactaatgggtaatgacaggcaggaacactgactgtgattaacatcaggatcagagtagtttatcagaatgtaaacatgtgccttaaaaactgtagaaacaatacctcttttcctaagaacataggattgtaagtttaaaaaaaatttattagtaataactaagaatgaaaaaatataagtccgagctaataagtcaaatattagatctataagcattactaagagtacaaaagtaaacaaaaattaaaagttacaaatatttaagtgaaatgggagaagatggaaacagtctattttattttaattgctgtttattgtatggtgataacacaatattatctaaacttataagaatggaggtggtcactagaaaaaaaataaacaaaaatagaacttcactcaaggaaaccagatgtatctaaaacaaaaaaaaataagatcataataaaaatccacatacataaaaaggaaagtaagagatatgatttcagcacccacagtgatgggatccaaactgaaatcataaaaagaaggaacagaaaaacactttacaatcctaaagtgagccattcactgtgagtatgtatctctgttgcatgttattgaccaacattcacaaagaagaaatcacaatatatacaaagaaatatgtctataaacagaattgtagagggttatagctcacaaatttcagtctgtgatagataaagtattttaaaatatgaataatcaaataatgtaattaataaggaggttgatagatttaataaatcattctctgcattctggggctatatcatttaattcaagcgcctatagaatatttagtaaaactgactaaatattacgtattagtcttcaagactatctcattaaaggactcaaagttaaaatagtacaaataaaatgctcctttccaaatacaactaaaagttagtgaaaaacatcagaaaacaaataatgaccttaaactgaaaatgtattaactgcaacaaccacaaccttcttcttcaggaattctcaaatcacagaaaaaaaaaggcaaacaaattgcagaatttctaggaaaaaaactataatgagaaagaacatatatggaaattatgggatacaaattaagtgcttctgaaagtatacttgtaattctaaacatatcaaagacatcgactaaaaagaataatattagatgaattaaatatgtaactaataatggagaataaaataagaaaatgaataaagaatagtaaacaaaaatatatattcaaacctgattttttggaaggaaagtttaaaaaaaaaacctaaactaatcttattaagatacatgaaagacatagaaaataagcagcttgaaaacattataacaatattttcttaactctacacaaataaatttaatatgaaggatttcgagggaaggttgctaaaagcaacttcaaagaaacagaaaacacacataaactgatttctgaataagaaaatgagaagcttgtgaattttccctaaatatatcagacccaataattcactaaggaattctgtcaaacctggaagagcacataactgcaatactatttaaagctttcaacacactgaaaagaaagaaaatttctactatgtttctacataaagcagacaaatttacattcgtttcctaggaatgctcttacaaatgaccataaactgaggaactcgagaaaccagtgtgctgtctcacagtcctggaggccagaagtctggaatcaggagttggtgggactgcacttcctctttccttggtaaactctaaggacctgtccattcctcaccaattccagcttctgaaggctccagttgttcctcagctcatggctacatcactcctctctctgcctctgtggtcatatgaccgcatcacattttctctgccaaatctcccttggccactcttataaggacccttgtcattaaatttaacacctacctaaataatcgaggattatcacctcttcttatagtttactacataagttaattgcatgatttgccatattcatatttgttgcagggttgccgtcaggcctctatagcctgtctccacgaaagccatgtccttcccatgtgtacagtagtgtttaccccatcccaacatccctaaaatatcaatctattacaaaatcaattctaagtccaaaatcttatctgtttatcatcaggtcaacatttctaaactcatcatctcaatctaaatctcattatcttaatcaggtgtgggtgaaactctagatagtttgaatcctagcatgaaaatcttcatctgtggacctgtgaaattagaaaacaaattatccttatctaaaatacaatggtaggagaggcataagataacagttataaacactgacattccaacagggggaaaatggaagaaataaaaaagtcacaagttccaaatatgtttaaaacccagcatgggaaaattccattaggtttcttttttcctaagttttatttaatatttaattgacagaaaataattatatatatttatgatgtacaatgtgattggtacatgtctgttacttcaaatatttatcatttacatgtggtgagaacatttaaaattctctcttttagatattttgaatggtacaatgcattattattaagtgtagtcactgtgctgtatatggaacaccagaactgattcctcctacctaactgtaacattgtacccattaaccaatgtctccccttttcctactcacctctctattcccagcctctggtaacaaccattctactttctacttaaatgagtttgactttagattccatatgtaactaagatcatatggtatttgtctgtctgtgcctggcttatttcactaaacataatgttctctacgttcacacatgttgttacaaatgacagaatctttttttaagtaacagactaaatagtattccactgtgtatctacaccacaattttttaaaatccttttattcgtggatgaatactttgtttttttccatatcttgtctaatgtgagtaatgctgcaattaatataagggtgcagccatgtctttgggatactgatgtcagttcctttggctatatacccagtcaggggattgctggatcctatggaaattctactttcagttttttgaggaaccttcatacttttttccaaaatggctgtactaatttacaaaaccacagtcctgtgtttccttttctccacatccttgccaatacttgttatcgttcatgtttttgatgatagccactgtaaaaggcatgagatgatatttcactgtggttttaatttggcacttttctgatatttagagatattgaggaatttttcatatatatgttgctcagttgtatgtcattttttgagaaatatctattaagtgatttgcccattttttgaatagagtgatttgtattttttttttgagtagtttgagttccttcattattttggatattggcccttatccgatgtacaattttcaaatattttcttcaaatcatgtattatctcttcattctattacttgatttctttgctatgaagaagctctttagtttgatcattcccacttgtctatttttgcttactttgcctattttttttagttatagacaagtaatctcagcctagaacaatgtcatgaaggtttcccctcaatttcttcttctagtagatttatcgttttaggtcttacattgtctttaatccattttgagctgattcttgtaaggctcaatactttcctctctgagtctgtagctctgcttgccactgcccctacgggtactttgcataaagtacccaaagtcttctatgtttcccctggaagaaatcttcatcacctataactgcaaaattatgatttctggacattaaacctagagtttcatcctgcaagtggttgaattacaatataaattgagtgtccaatcatgtaggggtatctttcttctggggcaggctagggcagccacaaaaactgaaaaaagtgaggaatggattgtctagagttcccagagagggtgtggttctgccacatttctgacttagtgacttcagaacttcaaggtaatttctgttgttacaacccaacctgtttgtggcaatttgttatgtcatccctaggaaacgaatatagtaggattaacagaaaataataagccaatacaaatattaagcaacattaagcagcttcatttctcagcacccacaggacaattctaagcaccattccagtaaaacaaaacacattgcaaatgggatgattccaggaatgctcagatagttgagggatagacaaataattatgctagactgaaccatatgaaatgatcttttgtatatgtcatcatacatttttgatatcagcaatttcatatgagttaaactaacttttgaaaaaggacaggagttgtgaatacatacccatgttatacttgctggtagtttctctcttccctaccaagtgagtttgataccaaccaccatcatcaccatggtgaatgttggaatatgaatgcatgctaattagcattgtcaaataaagtacaggacatctaattacattctaattttaaataaccaataaatttttctacaactatgtttcttgtgataaatgacaattaatatactaaaaaccctacagtttatcctaaatttaaatgtaactgggcatccagtagtttaaatgattgaatttggcaacactgaaaatagcactcattaagtatgagcatcagtgatatggtttgttttttgttttgttttgttttgttttttgtctgactctgtcacccaggctggagtgcggtggcatgatctcggctcactgcaacctccacctcctgggttcaagcgattctcctgcctcagcctcccgagtagctgggactacaggcgtgcacaaccacacccggctaatttttgtatttttagtaaagacagggtgtcaccgtgttagccacgatggtcgacctcctgacctcgtgatccgcccacctcggcctcccaaagtgctgggattacaagcatgaggcaccgtgcctcacctgggatttttttttttaactaagaaagcgtggaagacaactttaatagtttactcaactatttaaaaggtgtggaagatgggtacttgagtagttttcccagagttacagtaatagaaaaataatcactataatactaatactataaataccattttttttgggtaaaaccaaataatacaataatttctattatatatataactctaaaatatccaggcataaataaatgagtataattttctcacagtttccctgtaccggcaattcagcctcaccagcttttcttcacaaatgaggttgttaaaatatttccagttgcgttaattcaactgcttctaaattcctgtcccaacctaaaataatctactcatttttttcatggctccacatggtttccatccatccgtcagttctggcaaagaagtccctcaaaatgtttacccccaccctggagtagtaaaatatatattagatgatcgtcaacctgaaaccatatgtccacagaaacagcctgcaccgtagcagtaggtaggttagtattgaggcaaatggcatctaacttgccaggggacctgctaagaaatggaacaagagatgtgtgtcatcttggatgcagagcttgataataatatcagataggacgggaggtggcccaaatccctccacaaatttcattgaaaagtccaaaagatgtgaaagccaaaaataataaataagtggaggtgattgttttaaaatccagtgttattgtgagaaagaaatgttaagcattcctagaaaagtatgtaactctgatttttagttctaaggtcttaaatacccatattcagtgagaagaaccttagacatcatcaagccttccacatgcagcaagttaactccaaaaattatagacattgatctaaaactaacagtaaactttccaggtattcgtatttccatgagcaggatgcacgattctgactgtccagctcttataagccaagagggaccatttttgtccacccagttgctgataggcagcaagtatgtaccatttctaggacgagttatttaaattttgatggggcttattgataaattagtcataggcaaattctcacttgttaatgtaaaggaggaaggattcaaggaaagaaaaagtttaatgtgtggatccaattaagagtatgcaactcctcggccgggcatggtggcttacgcctgcaatcccagcactttgggaggcctaggtgggtggatcacgaggtcaggagatcgagaccatcctggctaacacggtgaaaccgcgtctctactaaaaatacaaaaaattagccaggcgtggcggcaggcgcctgtagttccagctactcgggaggctgaggcaggagaatggcttgaacccgggagacggagcttgcagtgagccgagatctcaccactgcactccagcctgggtgacagagagagactccgtctcaaaaaaaaaaaagagtatgcaactcctcaaacaagataggtattagttattttggcaatttatttctagtgtgataggtcataaacttcagaagcaactccttgaaaaatatataatctgaaattcataatgtttgtgtcatatataaatgcatgtgtattgtatatatgatcaacttctgataatttgaattttttaagatataaagatacatatttttttggaaactggtaaaatattgtagtggcttatcctcatcaatgtccctgtgaccctagttttctaggttcttaatatatggtttggaaatgaaatgatattttgccttttgtgtaatctccaacccctgggaaggccaattttccaaggcaattcagaaaaattggggaacttattataagtattatagtactgatcattctgtttacaggatcctgataaggatcctctttctagttagcttttgcttggttgctatgaactgaagggatgtttcttccctcaaaattcatatgttgaaatctaatccccagtgtgatatgatggtatttggaggtgaggtctttggtacataattaggtaattagagcgaaaccttcatgaatgggatttgtgtctttataagaagagacaagggagagatggtttctctgttgtgtgaggatacagcaagtaagaggccgtctgtaaaccagaaagaggatgcctaccagacaccagctctgaaaggaacgttgatgttggcttaagccacccagtgtatggtattctgttatagcaacctgaattgactatgatattgacccttaatgtaaaggacaatgcctcaatttctctgcagggaatgaccattctgttcctgccaaaaaaagacactttgagattgaagcaggcttgtacaaaatcagtggcataaatagaaatgaaaattctctattctgctgtttctcacagatctttaacaggaagaccagcatcagtggatacttcatccagtttaaaatggaagactggtctccgaatcaccttcactcacctcaccatgggagcttttaacttttaaaactacatccgttcatcttagtttcacacagccttttatatcaatcatgctaaacactttccaaatgtttagttcttatctgaaaaagcacttcctcttgaaaacattacctagcagtcctcacacattcctgaatcggagtttgtattcctcctattgatgtccataacaccaaatacatattattgcactaaatacaaaatgctgaggttccatttatgccttagatgttattattaaaataatcttcatagttcgttttagaacaaagctagaatgacttatctctctctcaattattttattctaaaaaggaaaaaataatgcatatttgaaaagtaatgaaagtcataatatgactttttttataaaagtcataatcttattttttttccccacagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaaggtatggcatgcttcaatcgtttagacatagaaagatttttattgcctctcacattaattaaacttgaataaaattacacttaaaatgttttatttctacgttgttttctacgaatataattaaattataatattaattgattttaactgtgtagcttagcagttggatttttgtcacattaagaacatattttgctatctccatgaatgtcttattgaccacatgttaattttttcatttgacttaatggatgtgagcgtaattgattgagaaaattgttgtagagctatttaatcacaaactagagaatctattgctcccttaatgataggaagtatagatatagtacaaagcgtgatgatttggggataacactcatctctaactgactctggttcctttggtcagcctagctgtgtggctttctctttatatgtaaaagtggaaaaataatgtctgtgtctcagagctatcgtgaggatgcatgaagcaatgtgcgtaaagcactcagcaaagtggcctgcacctagtagtcactcaataaatgctaacttgtgaaagacagtatagggtgcaaaaaactctgaatacaggaaaatcagcgtgggaactctattgtgtctgcttactagcagagtgatcttttacagtcattcagtcatgtggaatctcaaattccaaatatgtgaacaaagaataataatgctacataaatatgttgataggatttagttagattaaaggacttaacacattacccagcatataataagtgctcgctaaataatacttgtattagtttagtacatcatgctggagagataatcaaagcttttttgcattatcaaaggagtttttttgtgtccctcatttataacaaaatcagaaaggctgcatacatgtgtaaaacttcttggatatcctgtatttatactcatggaaatcctgtctctagaaaggttaaaatccttaataatctttctaatttttaccatgaaatccttggttttcattcacttaacaaaagctaatatactaaatagtctcctcagtatctgtgggatatttgtaaaagctctgaattttctttttcataagcatgactgtttcagttaaaaataattcccctagcacccatgcatgtagtgaagcaattttctgtgcacaaatgtagatattcaacaatcctactccatctgcaagtatagaaactgtatcctgtcacactaacagcaagagctagataatgcttgaagaaggaggatcggtaaactatgcaaaataatatgcataaaccaagttacagaaatcagtctctaactaaggaatagaaatcaaagttaacatgtttcattgcttaaccaaaggaaagcccgttttgcttcaacattccatagaatgccatgtttttaattatacttttgaccccaaacagtaagtatgatttgttcaggtttaaaaaaaaatgtagcaccataaaagatctgtacaaatgaggctttctttaccaaaagcacccaatatcttttgggaatagagataggtcatgatataagtttgctgtgaaaatattaaataaacattgacaatatttttttaaaggtgatactaatgataatttctgtaattatttaaaaaaacaggaagtgcaaccattagtttaatttattttttattaatacaaaaaagttgtacatttggtgggatacacgtgataatttgacatattcatatgatcaaatcagggtagttgtgaaattcatcaccttaaatatgtatcgtttctttacactgagaacattcaaatcattatcttctagctgttttaaaatgtacaatccagtgggtaccaatatgtacatttaggtggaagaaatagaacctagtgtttgatagatcagtagggtgactatagcaatcactcttagactatgttttaatcacttgtaacgtgcgatattatagtagtcctcatgataaagaattatacatgtgcacacacacacagacacacatacacacagcatcttgaactccagggaagaaatagacttggaaaaaatatgcattgtgtatcatgcataattctccacagaaagagaatgaaatacctgggccctgtggcccagccaagttgacatgtacaattaaccatcacactgtgtttagtgtaataatggtctgagggaggtgtgcatggagaatgtattccaaaactttctggaggcaatgagctgaagaaaattgaattgaggctcataaaccaattagaaattagagaaatgaagaatgaaggaaagaattgtagtttgctgtacatgaggagcttgggttacctgtgggaatagcaagtaatgagattggagagatagattagatacagatcatgaagaggctttctgcaatggtaaggtctttgaaattaatcctggcagcaatgccaatagggagagaaatgagaggaactttgataattataaccaaaacaatgataggaaaatttgcatttcaaaataaacaatatttaaaatcaagtgaaaggtaggccaagggggagaaattgaggtcaaggacaaagatgttttagcattattctatatgttccaacatatatgaaaacaccccttcccacataggactgtgattctcacatgggggcaaaatccacccccctgcaagggacagttgaaaatgtctggagagatatctagttattacatcttgggatagtgtcttagtcactttacgctgctataacaaattaccttcgactgtgtggtataaacaaaaaacatttatttctcacagttctagaggctgggaagtccaagatcaaagggccagcctatctggtatctggtgtgtgtctgattcctggtttgcagagagccctcttctccctatattttcacatagtgaagagcagaaagaaagaaagcaaactcttccatttctttttacgagagcacacatcacacaatgaatgtcccaccaattttctcctttagtcagtttggctgctaagaagaattatcatagtcttggtggcttataaaaaactgcaatttatttatcacagttcttgagtctgagagtctgagattaggttgccagaattgtcgggttgtgctaagtgctctcttctggattgcagactaccaacgtctcgtattctcacatcttggaaaaaggtagctagctccaagctcctcttgtaaaggcactaatccattcatgacagttccattttcatgacctcataatcacctccagaagtttgtacctccacatgccattacatcgtggattactgtttactatacgaatttgggggagggggataaaagcattcagcttgtagcaggtagggtgttactggcatctaggggtggaagtcatggatggtgctaaacattctgaaactcacaggacaactcccacagaaattatctggccccaagtcaatagtgctaatgttgagaaaacctgacatagactaaaacaaactgactggcaaattggtagaactggagtactaattgtattcatgggaagaaattttgaaaagatatttcagagataggtgtctatatatacaaatcatatacatgaatagtcatgtgaatgtttcaatgtgtactttcaatcaattaaaatatgtcactaattgtctcagtaattgtcctatatcattgagagcacttaaatgaacactcatatgaaacatgcactctcctggttgttgggatgcaaagatgattggtacatagtttccaaatgctaagaagggaagcagaaatctattagcatatgaaatattctttctgctttgttttggttagagaactaaaatgaatcctgctaaagctgccttaaaataattagactccatagctgctgtttgggggcataatttacataatatttattcttgattttaataaaaatgtgtcattcacatgggcctctgggtgcaaatagtgaataaaaaaacagaaaacattaacaaaaacaaaagcaagcctatacttccacctttctcagggaccaaatgtttgtactaattaaggaaaagcacattgaaaagatgtactttgcaatgtgccctgaaatgcaatcaactccaagtttgtagaattggtaatgaaagggagtttgagctttgcaagcatttgtgaaaagcttcctgacttcggtcttttgtattttactattgtacttttgtacttcagtctttgtattttaccattgtccttttataaattattagtaagactcttcagatttcatagagaatataatgtctaggttttgtctgtttcaactctaaacaagatgtgtaatttgcagcaatataaagtatatataaaatgtaaaataaattattatctagtgtagtcaccatgtcaggctatcaaatactagctgttgttccttctaactacattttttacccagtaatcatccccaattacctgccccaccaccactacccttcctagcctctgacaaccattattctaccccctatctccttgggttcaattgttctaattttagctcctacatatgagtaacaacatgtgaagtttgtctttctgtgcctggcttatttcacttaacataatgtcctgcagttctatctatgttgcaaatgatagaatcttattctattttatggctgaattactgtattgtgcatatgtaccacattttctttatccattcatctattgatggacacttaggttgctttcaaatcttggctgttgtgattagtgctgcagtgaatatggagtgcagatatctcttcagtgtactggtttcctttctgatatggtttggctgtgtcctcacccaagtctcatcttgaattgtatctcccataattcccacgtgttgtgatagggacctggtgggagataattgaatcgtgggggcggtttcccccatagtgttctcgtggtagtgaataagtctcacaagatatgatggttttataaggggtttcacctttcacttggctctcattctttcttgtctgcccccacgcaagacgtgccttttgccttccaccatgattgtgaggcctccccagccacgtgtgaatccattaaacctctttttctttataaattacccagtttcaagtatgtctttatcagcagcataaaaacggactaatacattttctttttcatataaacatagcagcaggattgctgcatcatagggagctctatgtttagcttttaagaaactgtcaaactgttctccatagtggttgtactaatttacgttcccaccaacaggatatgggggttcccttttctccacatcctttgccatcatttgttattgcctgtaattttgatataagccattttaactggggtgagatgatttctcattgtagttttgataggcatttctatgatgatcagtgatgttaagcacctttttatatgtctgtttgctatttgtatgtcatcttttgagaaatgtctattcagatattttgcccattttttattcagattattagattttttttttctatagatttgtttgagcttcaattatattccggttattaatccctggtcatatggataatctgaaaatattttctttcattttgtgggttgtcgctttccattgttgattgttttctttgatgtgcagaagctttttaactcgatgtgatcccatttatctattttttatttggttgactgtgcttgcagcatattactcaagaaatctttgttcagatgaatgtccagcagagttttcccaacgtactctcttcagtttcacagtgtgagttcatagacttaagttttaatacattttgaattgatttttgcatatagctagagatgggggtctggtttcaattatgtgtatatggatatgcagttttcccagcaccactgaagagtcatttattgtagttattgcagactgggcttatttgtgcctgtcattcttggggactcttccaagtactcaaaggggattaattgggtgttattatctaagtctttggtcattgcagctatatctgcattagggggtaccccaagcccagtaatgctgtgactctgaagacttgtggaggtactgctgtagtggtcttgggtaaaatctaagataattccctggattactaggcaaagactcttgttctcttcccttacattcccctaaacaaatggagtttctctgtccatgttgatctgcctggagctcagcagaggagtgacataagcatcactgtagccaccaataccaagactgcactgggtcataactgaaatgaacatatcactggatctcacccaagaccactgattactaatgcctggctactactgatattcccttaaggcccagggctcttcagttagcaaggagtgaatccagccaggattgtgtccttcccctcgatgttgcctctcatgttccacagcccagggcaggtctagaaatgctgtccaggagccacagcctggattcgagaaccttaggaatctacttggtgctctattctactgtggctgagctgacaccccagccacaagacaaagttcttcccgctcttccctcttcttttctcaagcaggagtttctccccatgtggtatgtactgcctggataccacccatcttcactcaaggcccatgggctcttctgtcagcttgtgctgaacactgcctggactgagtctcttccttcagggcagttagctccactctagcccagggcaggtttagaacttctctcctctgagccaacgcctggaatcagggaccccaggagcctgcttgatgctccacccctctgtggtcaagctggtatccaagctgcaagacaaactcccctttatacttccctttcccgtccttgagcaggaagagtctctccccatagccaccatatctgttaataccctgggttacacctgagtctcattctcatcaaaagcccacgatgagtaatgtctggctacagttgatgcttactcaaggtccaagggatctttagtaaggaggtcatgaattccaccaggactgggttcttcccttcaaggcagcaggttcccttctggcccaggtgtatctaaaaatgttgtctgagagctagggcctcaggattctgtctgctgccctattctactgtggctgaacttgtatccaagttgcaagatgaagtcctttttactccttcctcacttctactcaagtggaaggaagggatctctcccagagctgcaagctgcactgcctgcggttgggggaggagtggcagaagcactcccttgaccacgccagctggcttctcactatgtcacctgcactccagatccactggctccaagcccagcacatcaccaaggcttactcaggaattacagtccttctggcccagactgcctttcaagttcattaaggaccctggagtgctttagcccacagtggtggggctagccagaactcaggttttgaccactgggttgagttatttctctctagcctgtgctggtctaaaggcttactccataggttgcaggatgtgttctgtcactttttgctttctgccataacaaggaagtagtgacttccaatgcaaagtctcataatcattgtgttctccctccccaaagtgcacagattctctctttgtgctctgctgccactaccagggtatgagggaggggttgtgtaagccattcaaggctgtctttcctgtgctcttcagtgccccattcattaatatagtgttaataccaagtactgtgatcagtcacctgatttttagtccttatgaaggtgtttcatggaaagttcttcaattcagtgttcctgcagggttgacaatctttgtagggttctatactgctatcttgctccaccttcttctccaatcatcacctttttgaaaaaataaaattagagcctggctgtttaccagcagtgaagcctttcatttaaacaggctacaccatttgctcacaaattacaaatagaattcaggaatttcacagattagctactgagagatgagcaatcccatgttgaaaacaagaagctagagagcttttgggaatgtagctttatgacacatgactgttaaattgttaccattcattgtcttctgtctgttggccatggaccttatatatcattccataaactgtttcacaacactgaaactgtctgtattattgattccattctatagatgaagaaactaaagttcaaaaaattaactaacttgattctgttttcagtgataacatgacattttaatgcaaatccaattttgctttactctgaaaactttctttttgtagcccaatatgctccctattatactataactaataaaaaataaaaacaaacaaacaaaatgactacatttacaaaagtcaagtatcaaaaattagaaacaaatgtatattataaatgctcagagagccattaagcaaatgccattacctggggccttcccttttatgggtttactccacacattagaaaaggggatgctaactggcaagtctttttttaactttagcatcttagtaataaacttgctcttaattttatagtttctccgtattgtagttaaagatgtacattacttgatttagtataaaaaaagttggagtccctgaatcaacatttcttatatgatgaaaagctttagcagctgaattatgtgaatgagtatatgccccatctttccttcttttgcatcttgatttataacctgaatttatctatgcatttacttcttgttgagaatttgaatgttttctttgaatgataactttaaggaaataaatgattaaatatttcgcataattgtttcaaatgcttatgatggcactacctataaaataaactatagcccaaatgtattgtgaacatattggaaacttagccagattttaaaatatttttgcaacataagggataattttaaagaaatggatgcaaagtattaaaagtattttctcagcctatccagagatttattgtgaccttggtgaggtgaatttattggtaaataatggtacagtgaatacactggaagcattcacttctttttgttttttgtttgctttcttctctacttttgaaattttcacataattgatgatgagttggattagaaataccaaattattttggatgttataacagcaaaaaaaagagagagattttaaaataatgataaggccttttggcaaagttcaagagggaaagtgaaaagaaattattaagagtttgaatgcaggatttaaacttttgaaaacaaagatgaaaaataaccagtaaatatgttttaaactgtgttcatgttaaaggtatctaatatacaagaacctttttcatagaccaaatttagttgtaaaagttttccttattgataacataaaattatttcagtgttctcttcatggcaatcctcagtgtatcatcaaaaacactcagccattgtgttctgatccaaaggaaacagtccattatggacatttaatgcaaatccagtagagacagacagaaagcaaattcttgcttaaaatcaaaagtctttgtctacaacctgtattttgaaattgtatcacattatatattgctgatattagaacactgagattgattaatggtttattgttcaatgtcataaacacatgatacttgagaactcagggggacataaagatgactaagacaactctattctttcatagatgaacatatctttagactttgaaggctgaatggtccaaaagcacatagctaaagatattatctgatataaaatgattttttcccctaggccaaacataattataacacatttagtcatacaactacttgttttctgttttggcctatttaaaaaaaattcaataggtttttggggaacaagtgatgtttggttacatgaatatgttatttagtggtgatttttaatattttggtgcacccatcacctgatcagtatacactgaacccaatgtgtagtgtttattcctcaccctcacaccctttcccccaagtccccaaagtccattgtatcattcttgtgcctttgcatcctcatagcttagctcccacttatgagtgagaaaatacaatgtttggttttccattcccgagttattgaacttagaataatggtttccaattccatccatgctgttgcaaatgccattatttcattcatttttgtggctgactagtattccatggtttatgtataccacattttctttatccctacattgacggatgggcatttgggctggttccctatttttgcaattatgaattgtgctgctataaacataccttcgcaggtatcttttttgtataatgccttcttttcctatgggtagatacccaggagtgggattgctgtttcaaatgatagatgtacttttagttctgtaaggaatctccacactgttttccgtagtggttgtactagtttgcactcccaccaacaatgtaaaagtgctcccttttcaccacatccatgccaacatctattatttattgattttttgattatggccattcttgtagaagtgaggtggtatcacattgtgattttgatttgcagttccctgataattcgtgatgttgaatttttttcatctgtttattggccatttggaatatcttcttttgagaattatctattactgtccttagcccactttttgatgggatttttttttcttgctgatttgtttaagttccttgtagattctggatattagtcctttatcagatgtatagattgtgaagattttcccccactcagtgggttgtctgtttactctactgattatttcttttactgtgcagaacctttttactttaattaagttccatctatttatctttgtttttgttgtgtttgctttttgattcttggtcatgaagtctttgtctaagccattttctagaaggacttttccaatgttatcttctagaaattttatggtttcaggttttagatttaagtctttgatccatcttgaggtgagttttgtataagggtgagaaatgaggatccagtttcattcttctacctgtggcttgccagttatcccagtacaatttgttgaactgggtatctttttcccactttacatttctgtttgctttgtcaaagatcagttggctgtatttggctttatttctgggttatctattttgttcctttggtctatgtgcctattttttataccagtaccatgctgttttggtgactatggccttataatataatttgaagtcaggtaatgtgatgcctccagaatttgttctttttgcttagtcttgctttggctatgcaggctctcttttggttccatatgaattttaggattttttttctagttttgtgaagaatgatggtggtattttgttaagaactgcattgaatttgtagattgcttttggcagtatggccatttttacaatattgattgactccatctatgagcatgggatatgtttccatttgtttatgttgtctatgatgtatttcagcagtgttttgtagttttccttgtagaggtttttcttcttcttggttaaatatattcctgagttttttttttgtttgtttttgcaactattataaaggggttgagttcctgatttgattttcagcttggtcactattagtgtatagcagagctactgatttgtgcacattatttttgtatcctgaaacttttcttaattcatttaccagttctaggagctttttgcatgagtctttaggattttctaggtataggatcatgtcatcaccaaacagcaacaatctgacttcatcattatcaattggatgtcctttatttctttctctcgtttgactgctctggctaggacttctgctacttgaagagaagtgttaagagtaaacatccttgacttgttccaattctcagggggaatgcttttaactttaccctgttggctgtgggtttgtcatagatggcttttattaccttaaggtatgccccttctttggtgtttttgatgagtgttttaaccataaaaggatgctggattttgttcaaaagcttttactgcatctattgagataatcatgtgatttttatttttaattctgtttatgtggtgtaccacatttattgactcgtggatattaaaccatacctgcatccctgctatgaaacctactcgatcatggtggattatctttttgatatgctgtcaaattctgttagacagtattttgttgaagattttttcatatatgttcatcagggtctgtaacacagctgaagaaaagaaataacaaagatctgagcagaactaaattaaattgaaacaaaaaacacacagtacaatagataaatgaaacaaaaagctagttctttaaaaagataaataaaaatgatagaacattagtgagattaaccaagaagagaagcaagaagatccaaacaagctcaattagaaatgcaacaggagatattacaactgataccacagacatacaaaagagaactctaggctactgtgaacaactttgttcatagtaaactagaaaaccaagaggagatggatacattcctggaaatatacaactgtcctagatcgtgttcataagggtctgatgcatatatgttcatccgggtctgtgtattggtctgtagtattctttttttgttatgtccccttttggttttagtattagaatgatactggcttcatggaatcacttagggaagattttctccttctctgtcttgtggaatagtgtcaataggattggtaccaatttttgcttgaatgtctaatataattcagccatgaatctgtctggtcctggacttttttttgttgttggtaactttttaattaccctgtcaatctcactgcttgttatttgtctgttcagagtttatatttttttccttgtttaatctaggagggttgtatatttccaggaatttatccatctactcttggttttctattttatgtgcataaagttgttcataatagcctagaatgctcttttgtatgtctgtggtatcagttctactatctcctgttttatttctaattgagcttttttggatcttgcttctctttttagttaatctcactaatgatctatcatttttatttatctttttaaagaattaactttttgtttcatttatctattgtattgtatgttttttgtttcaatttcacttagttctgctctgatttcgttatttattttcttctcctgtgtttgggtgtggtttgttcttgtttctctacttccttgacatgttaccttagattgtctatttgtaccctttcagactttttgatgtaggcatttaatgctgtgaactttccacttggcaccacttttgctgtatcccagaggttttgataggtcatgtcactattgtcattcagttcaaaaaattttttaatttccattttcatttcattgttgtctcaatgatcattcagaagcaggttgtttaatttccatgtatttgcatggttttgagggttcattttagagttgattttcaattttattccaatatggtttgagagagtacttgatataattttgattttcttaaatttgttgagaattgtactgtggcctatcatattgtctctcttggagaatgttccatgtgctgatgaatagaatgaatattctgcagttgatgggtagaatgttctttaaagatctgttaagtccatttgttctaggatataatttaagtctattgtttctttgttgactttctgtcttcatgacctgtctagtgctgtcagtggaatattgaagtcctccactattgctgtgttgctgtctatctcatttctttggtttagtagtaactgttttatatttaacaaatttgggatctgcagtgttaggtgcatgtatatgtagaattgtgaatttttttttctgttggactagttcttttatcattacataaagtccctctgtcttttttaactgctgttgctttaaagttcatcttctctgatataagaatagctactcctgcttgcctttggtgtccattttcatgaaatatctgtttccacccctttattttaagtatattagtcctgtgtcaggtgagtctcttgaagacagcagatacttggttggtgagtttttatgcactctgccattctgtatcttttaagtgcagcatttcggccatttacattcaatgttagtattgagatgtaaggtactattatattcattatactatcttttgcctgaataccttggtttatttcattgtgttgttgttttataggtcatttgaaatttatgctttaaggagattctattttgttgtattttgagaatttgtttcaatatttagatctccttttagcagttcttgtagtgctggcttggtagtggtaaattctctcagcatttgtttgtctgaaaaagactgtattttcccttcatttatgaaacttagttttgctggataaaaaattcttgactgagaagtgttttgttcaagcaggttaatgataggacctcaatttcttctagcttgtaggatttctcctgagaaatctgttaatctgatacgttttcctttatagattacctggtgtttttgtttgtttgtttttccacacatttcttaagattctttccttcatcttgacattagataacctgatgactatgtgcctaggagattatctttttgtgattaatttcccaggtgttctttgagcttcttgtatttgaatgtctagatctctaagaaagctggggaagttttctgcaattattccctcaaatgtgttttccaaactcctatatttctcttcttccttgggagcaccaattgtttttatgtttgttcatttaatataattccaaacttcttggaagctttgctcgttttttaaattttttttttctttttcttagttggattggattaatttgaaagccttgtcttcaagttctaaagttttttcttctatttgttcaattccattgctgagactttccagtgcattttgcatttccctaagtatgtcattgatttccagaagttgtgattgttttttatttatgccgtctattcactggagatttttccattcatatcctgtatcattattttggatttctttaagttgaacttcacctttctctagtgcttccttgattgccttaataatcaatcttctgaaatctttttctggcaattcagagatttagtcttggtttggatccattgctgataatctagtgtgatctttttgggatgttaaagaaccttattttgccatgttatcagaattatttttctggtctcttctcatttgggtagactatgtcagagggaagatgtgtgactcaggctgttgttcagattcttttctcccacaggatgtttccttgatgtggtgttcttccctttcctctagggatggggctgcctgagagtcaaacttcaattattgttatttctcctctagctctagccacccagtggagctaccaggctctgggctgatactggggagtgtcttcaaaaagtcctgtcatgtaacccatcttcaggtctctcagctgtggataccagcacctactccattataggtagcaggggagtgaagtagactctgtgagggtccttggttgcatttttgttaagtgtgctggttttgtgttggttgacctccagccaggaggtggtgctttcaagagcacatcagttgcgattgtatagggaggatcaggcagtcaacagagccatacggctcccaagagattatgtactttgtcctgggctaccagggtaggtacagaaagaccatcagatgggggcactgttaggcttttctgagctcagactttggcaggtcttgctgtggctgctgtggaggatggggatgtggttcccaggccaatggagttatattcccagggggattatggctttctctgctgcatcacatagctcaccagggaagtgggggaagagccggcagccccaggccttaccttgttcccatgcagcccacagcccaaacagctggtctcactcccctcatgtcccacccaacatcaccaagtttatttccaggaagctggtaacagctaagaacttgccccagactacaagcctcccagctgagaaagcaagccaactcacaattcctcagctatcccatggagcctgcagctgcagtccacctctttcaaagggtctgtggattctcttggctttcctggtatgttcctgtggtagttcttggagcaaaagttcacagtgtgggtctccacatgctgctctgttggtccatgtgggagctgcaagttagtcctgcctcctctccgccattttccctggctctagtcatacaacgtctgaagtaccatttggtataagtacaattttgatgcttatttcacacaggataaagtgaatatacaataagggtgttataatgttgtgtcacagttatattagagtagattttggatctatttgaacatttcctccattatagtaactctttggacacatgtgcttgttgattgttccaaagtgttaacttgacataccacaaagttgctttttttcccccttagattcaacctgaagtctaaaataattaaattattaattaataattgacactggacaagaatgtggtcactttttcatgtttcattaaagatatagaagacctctaaaaatcttccatttctggttaaagtttatctaacagcctaatgtcaccatcttgtgaccaaaccaggcttagccccaggaagggaacctgtgttctgggaaggtgtgcataattagaataagtaccttagccctagcttagtgatactctatagatctactaacaggggaataacatccaaatagcttatgtatttcatgcgaattttacaaaaaaaaaaattgtttttttttttgagatgaagttatgctcttcttgcccagcctggactgcagtggtgtgatcttggctcactgcaaccacctcctccagagttcaagggattctcctgcctcagtcttccaagtatctgggactacaggcatgtgccaccatgcttggctaatttttggatttttagtagagacagagtttggccatgttggtcaggctggttctgaataaaaaaattctaataaggttttgtagcatttctagaactcaagattaatgcaatttctgatatctcacttacttagagtcataaataccaggaagaaacattataattgcatgtgcagaggtttagcttaattttgcttcattggatggaagttttgattcaggaggttaaaaagtatccgcaaatatctatgtgccatgtgtgctgtccatcctattaagcacataagcacaatactcactttatgtgagaaattataccttcttttttttagaaagattattttctcaatgcatggcttgtgtattaaattgcattcccaatgttaacaaagggaatcataattcgtaaagtgaatctaagctatacttcaggtgcgtgactttttgttaagctaaaggtgagtccaaggtcaggcgttttggctcacacctgtaattttagcactttggaaggtcgaggcgagaggatcatttgagctcaggagttcaataccagcctgggcaacatgacaaaacactgtctctacaagcaaatacaaaaattagggtggcatacacctatggtcccagcttcttcagaggctgagttgggaggatcgcttgagcccaggaggcaaaggctgcaatgagtcgtgttcctgctgctgcagtccagactgggtgacagagcaataccctgtgtctcaaaaaaaaaaaaaaaaaaaaaaagtatgagaccaagttgtggtaatatctcacagggtatgtattgattaaactttatcccaactattgattattctcaacaaaacttacaaaacaactgcttgggtgacaaaatcttaaatacatttgctttaccattcatgtcttgtacctgcaaatatttacaaagtgacaactgaaagaggtcttctatactttatttatttatttatttttttaattttattattattatactttaagttttagggtacatgttcacaacgtgcaggtcagatgatatttctctaagtaggtcactgtaaaaatggatttctgttacataagttttaaattaatttcttgtggtgaaatggacagaatataatgaaaataagtgccactgaggactgaagagctgttattgaaatgaaaaataacatttctaatacactttaatatgagtattgattatcacgaatgtatacctaatcaaagggaagctgagttccaaatgatgacctgcatggtttgtttaaagtagtttctgtggaagaaaatatttgagtaaaggtaatcattattgagattgaatttttactatggtcataaattttctgtctgttttttggtccctgaagtactaatttgaataataaattttcatctcacttcaatataatgcattttctttttactttcatcattgctttaaaacatttactagagatatgaaatggtacagaagttgaatgatagaacaaagagcggtgtagaaataaaaaattatagccagtatttataagttatattgggaacttggcaagatctcctgtactgggtgaggcatgaatggatccatttatctgtcagtgtgaaattagttaaggtttgcctatgggacttgtccagttagagggctaataaagaccactgagcaaatttgagctgtcagtaacttaattgtactttctctaatctataactaggagacatcttattgatcattgatcatacaactttcacagtagtgtttagtgaagataccattttgatgcttatttcacacataatatagtgaacatgtagtggtgatagggtttgaattatatgtcacaattataagagtagccgttgagtctatttcaacgttttctccctcatattaacacttttgaccacatatgcttgtagattagtacaggatattaacaagatacaccacaaagtagttgctttgctttttttcttagatttaaactgaagtctaaaagatgagctttcacagtcaataattgtattacatcttaaaattatttccagaactatgattctatgaattttgggtgaggcgcaaatttatttgttctttgtgcaatgtttaaatattactcaatgaaagagggaataagccaactacacaccataaagagaaaacaattatttcccgaataaatctaaccaattttaagcatagtattagaaatccatatgaaggatgacattaagaatctataaatatcttatctagatatgaaaacatactggcctggataggtaagacacgatttcttggcatgattagtgctaccaacatatttacaaaagaagtgaaagactactatcagttgcatgaaatattatcagtctccattataactgttgattgattggttggcttattcattcacttgtgaggccaagcaatacatctgtgttattattggtagaagttaaagagctttagtctcatacaccttccaaataaaaattgctctatgtgaattaagcagtaaattaaaaattaattttctgacaaaattttcagaaacaggctgaagttctggctatttatatagagactcttgtttattcagtagtaaccctattcataacccactgtgtttatagtgcagtcgtaggagaaagaaacaaccagtacttacaatctatgaactgtcttatcaaaatagactgaagcttcccaagaaagaaagggagaaaaacgtcttcctgagaagccttaaaacaagtgatagctgttttctatgaaggcctatcatttaaccctcaagcataagtgattttcacatatcacttcacttaatcatcacaagaaaattattatgtaaatggttctccatttcactcatggagacagctcagagagactaaatctcttaaggtcacaatgctaagtgatacagctgtgattaacaggtttgcttggtttcaaacctggagtgattatcttactatggcttgatataatattcacatatatgctgtgtctattttagaaataattttcctggaattgatctttacattctaaataaacaaggctaagaatctgtgacttattgtacacagagagaaagaatgtaggtgtttttcagtgtcttcaaagaggttactacctctgatatctgaaaactgggaaatttgtccttggtaagtggcccatccctcaccctaattcttcttgcttcttcatttatctttaaaagtctgtgctcttacaatccaaacatccttgacatttttcccaatctatgcattctcatcttcaaaattttacagagattatctttctctacaaagtatctgtactcctttcatctagaaaggtaataattatattctttcatttgctatactaggtcttacagtttagtcaatcctcatctcacaccagttagaatggcaatcattaaaaagtcaggaaacaacaggtgctggagagcatgtggagaaacaggaacacttttacactgttggtgggaatgtaaactagttcaaccattgtggaagtcagtgtggcgattcctcagggatctagaactagaaataccatttgacccagccatcccattactgggtatatacccaaaggattataaatcatgctgctataaagacacatgcacacatatgtttattgtggcactattcacaacagcaaagacttggaaccaacccaaatgtccaagaatgatagactggattaagaaaatgtggcacatatactccatggaatactatgcagccataaaaaatgatgaattcatgtcctttgtagggacatggatgaagctggaaaccatcattctcagcaaactatcgcaaggacaaaaaaccaaacaccgcatgttcttactcataggttggaattgaacaatgagaacacatggacacaggaaggggaacatcacataccggggactgttgtggggtggggggagtggggagggatagcattgggagatatacctaatgctaaatgacgagttaatgggtgcagcacaccaacatggcacatgtatacgtatgtaacaaacctgcacattgtgcacatgtacactaaaacttaaagtataataataataataataaaaagagtttactactaaagtctaacatggtgaataagggcagccatgtttactggaatgctgatgtgtggtttctttcctacctactacatgaagcttttttctttctttttttttctctctttttctagtctagcagccaataccagaaagcactagtctccaaaatgctatgtcacctctgaaggaattccaaaccagatttaagatctttctttctctctgtttttctctaatatgtcatatgaaatcatcaaattccatactctctggatgatctctggtgcacatatctctatttaactgtttttcctctttcaggactgatcaaataccatgtccttcatgaagcttttatgccttggaattttatactctgatctcttcattaaactctctggcatccatcattataatcagttacctgtccctccctccctccctttctttttctttctttttctttcttcctttctttcttcctttctttctttctttttctttctttctttttcttttctctctttctctttcttccttcctttcttcctttctttctttcttctttctttcgcttttcttctttccctccctccctcccttccttccctctctccctccctccatttttcttccttccttctttctttattttcttcttttcccgaagtaaactatttgacatattctctcttttttaatatatatctttcattctttttctgtattctttcaaatgagagtatttttgaatgaatggataaagattgtattagtttgtgcttgtgttgctataaaaatacctgaagctgggtcatttataaagaaaagaggttaattggctcatgattctgcagagtgtgcaggaagcatggtgccagcatctgcttctggcctcagagaacttacagtcatggcagaaggtgaaggggagccagcatgtcacatggtgagagtgggaacaggagtgagaagaagtcccaggcttttaagcaattagattttgcatgaactactgagagtgagaattcacttaacaccaagtggatggggccaaaccattcatgagggatccacccccataatccagtcacctcccacctggcctcacctccaacattgggaattagcttttaatatgagattcagaaaggaaaaacattcaaacagtattatcccccctttaaaattttctccttttaaaaacaaagaagctggccaggcacagtagttcaggcctatcccagcactttgggaggccgaggcaggcggatcacctgagggcaggagttagagaccagcctggccaacatggtgaaaccccgtctctaccaaaactacaaaaattagccaggcatggtggcaaacgcctgtaatccagctactcgggaggctgaggcaagagaattgtttgaacccgggaggcagaggttgcagtcagctgagattgtgccattgcactccagcctgggcaacaagagcgacacttcataaaaaaaaaaaaaaaaaagctgataaatattactcaatagacctagattgtattttaatctgttgcactgtctccttaatgttggacaaattctctattactctgtcccttcgtttcttcatttgcaaaagggagctagtaatagtacttacctcatgcagctgttatgagtgtttaatgaactaatatttataaagcacttagaaccccatctagtatactgcaagtgctccataaatgttagattttcttacctcttactagatagctttgttaaataactcatatacgcatttaagtatttcctctctgcctcacacatatggcaatactcaaaggtttatattaatggccaacttagaatttgaagaaattgtttaaaatgtcttatctggctataaatcttctagcctcaatttattctggttcatttttggtagctgtaacctagaattttttttttttaatttaaaatcccaattccacgggttttatgattagtcctcttttaggacctatgtcacctaggcaaatcgttacttgattttgtattttctaaatatttctgataatgtcaaattaattatttgtaaaaaaatctaaatattgatatatacactcataaagtattgatttttttacttagggcttatgaaacagattttattataaaaattatttgaaaagtaatttactgagaatagcctcatctctttttaattgtttgattaatagttttatggtcccatgtcacttcttaattctaaataattagcattgaatgattctacatttaatcttcaaaatagtcttgaatagtttctcttttctcacatttccactttacttacttctgagtttttatttccatgtctgggcagaaagccaaaagtggttaggcagaactatttagttctacttgagtcaaaattcaattgcaacttcgtgaataagactctttggatccaagcatcgcccacaatctaacccttaggatgttgatttccctagagagctagatagcttaggaaactcggaagcaaataacatgagtctaaagatgcatgcctagcagtatgcttaccatttttctaatatataaacataatttaaaactatataaattaaaatgtttaactctaaaaatattaagccactgatattagcacttatgttagaaagcccagtgtgaagtggctaaaaaagaggagattgctctggcaaaaagactacatattttcagaaaacaaaacaaaacaaaacctattttcttccagactgacagttgtaaggtgatctaatttctaaaatgagacatgctctgccatatttcatagggatctatagcactacaatctgagcttttctgatagttgctgcaggcaactttgaagctgaataataagttccaaatttgaatcctccaaatttcagatacagaagctgattttcttacagtaaccaaaaatggacaatttcttaaagacaggttaacattagataataaaatagccagaaagcctactgactacatgttaaaggatgctgtcctttccacatgataagacatctgtcatttcctaaccagttcaaccctcatcctcagcatttttcctctgggaaagggatgttataagaagggttttgttttttttctagtatagactcaatctgaattaagtacaatggttttactgtagcatggctttatgctttgggaaccccagtgacatacagatttcccactattctgtagcatctggtttttgtgtctcagaataagatttactttagagttgtaccttttcttgtttaaatttcttttttatgttaaacttttttcaattaacatatacttattattagaaaatttaatgtacaatggtcagttccttgttttgatcacaccgttccaagtgatacaatctgtctctttttatgtgttttttactgataagttagatttcttggcatgctccttgctctgtagtttcattctccatgctgctattaatatcttctgccatgtgtgttcatgcctctccacaggaggttagaagatttcacaccttagcaatatgctctgcatacccttctaacaccttatgcctatgagaggcatggggttggttgtattgcaattccacttacactctgttctagaaagtatgatgaattttgtaatatttacatcaccacacctaccctatatttctacccagcttttcatcttttcctcatactaaaatggaagaagcatccctgttactttcaatgggaaatttctatatctgttccccggaatccaattattttcaccttctcatgagttttacaatttttgatagtcccctttttcaaaagcatcatttctttcagcaaagacaatgcttcttatttcccatataaaagaaaataatttgttgaacccacttttctgatgacacaaaatgcttttgtttctgctgttcattcattaaaagatatcaatcaattgtcttaactcatggtctttgtatcttcacattcaatatactgttgaagccactgtaataaatctccagtcctttgatatattttctgatgttattcttgacaagttaactattaataatactgtccatcttgccaaatccaattaaccctcactaacctcaatcaacctcctaacagaattcaccccagttgttagctccttccttcctggtaagccatttcttggctgcatgccactccccttcccagttttccctctctcctttggctgtcaccatctccgaacagatactgacctgctctatactcaataggttgtgtacttcagtgctcaatcttttatttcttttctcttataattctgttccagatgagattataccattcccattaccttagctttatgctgatatatcatctcaaagttatatttcctatttagaaaggacaattgaattccatacccatatttgacttttgctttttattccacatgggtatctaatgggcatttaaggcataatcattaatttttcccaaactacctttccccagctctttttatccacctcagtaaaggggcctatcaattaaatagtaggtcaaacacgtgtggaaatggagtcacctgtgatttaattgctttactaatgccactgcaacaagaagtctatgaatttcatttcatatataacagtatgttgtacacttttttccatcatcttctatctttccatctttgtccaagttgacaaataattttttttataaattgttttcaactttctacagtatatgataaaaagtagccactgttatttttcagagcattaataaatctgtttttattttcttgaatttgaaattcttgccattgctttcacaaaagataccttgtcctaccttgtcctaactcttggagattcatgtcattcagtctccatagccacattgacatagatttgttttctaaccaattgaaactgtttctttaatttcgatctttgcatcttggttttctctgtttcatatattcttccctagcacttttcacataattaatcagtccatttcatctttcaggtctagataaaatattacttaagctgagatttaaaaagagaaaaaagcattagaggctttaggagagaatatttatctccttaaatagttgaagaaatagtctgaagcttttctagaacatatgataattgtttaatagtatatattcagagacatgttaatcagctgttgctaaataacacataactccaaaactcaggggtcttaaaaaaaagctgtgtctaactacactgcatgtgtcggtgggttagctgagggctagctgaattaggctagcttttgatgccagctctgtttatctctggggcactccatcgtgcatctgcacatttactagattgatctacgctaggttgggaaccttaattgggacaactttgccccgtgtgtttcccttcctcctgctaggacaagttaattagcccaatcatgcttttcctgtggcagtggcataggacacaaggaaacatacaaagtctcatgaaacctaggcccagaaagaagacagacaccatcactttcagctcatttgattacaaaagtaagctgaaatctaacgcaatataagagaactctacaaaattacatgaattgaagagggaaaaataatttgtggcctataattcaacctatctttatttatttttttatctcattctttgactaaacaagggtttagttgaactgtgatggaggtacaatgttaataaatataaatgttttgtttttcattttatattatttttaaaccttagctacaatgaaatttcaagataaattcatctctgacttcaaggattctaattttttttgaataataacaacaagaagtcttattataggtttaatattttttttcattaaacatattataggcttccaagaggtgagttcttttggtctctccactattaatcgctgtttctgctatctacttttattcatggaatttggtaagaccttataaaattattctttgaattagtaattgaacttagaattaaagactgatggataagaataattgatataagttctataaaaatataaagttgccatgtaatcaaatatagaatttaaaagtatatttgaatattttaatgtatttagatataatactttccttggttcagttgtattttcttcattataacatcaagtaaaaacttctctttttttctctagatacttcatcaactacaatgttgaagacgacagatttttcaacattgatgccaatactgggaccattaggactacaaaggttctcgacagagaagaaactccatggtacaacatcacagtcactgcttcagaaattggtaaactactttatgtatcacagtaaaagatgtcacttgtacaagaagacatactgaaatttccttaagagcagggctctcataatctttatttttgatatcaggatctaggagagtaagcggagtgtattagatataatttctcattatcagatagcatgaataagtcttatgccttcctccttactgtaattctggcatggtgatggaaaagtggcatcacagaacacttatgcctcatccttgagtcaagggcatttggttctccttctaattgggagacttgctttttcatttgcttttgccttacttacactatcaagtcattggaatgacttgatatgtgtgatagtttaggaaaaaagaaagaaagagaaatgtataattgcacattgattattttgtcaatataatacctctgctcaagtttcaaaaacacttatagaacttacagtaaaagaataattcttggaatttcaacagccaggtttaggctctcttcaagtaacatacgtgatctacagttgaggatgactcttgttctacctccacccagaatattccattgtgataaacacctaagctcaggaaacaacataaaaaaatatatatccgtaatacttctggaatcataaaggtagatatgactgtgttaaatgaaattagaatataactctaagaaaatgaatccatcttcataacaataaagtttttttaacatattcgtaagtagaccaaaagtaccaattatcctcactttaaaagtgtacgaagaggttatacatacatttaggaaatgttttgatgtattcatgaaaaaaaccatgaatatattagagattaagaatacttcacatttgaaaatagtgccatgtaaagtaaaatcacgttctgtttttctttcagagggtctaaaacattaaaaattttaacagcttcattgatatacaattcacacagcataaaatgaacccttttaacgtgtataactcaatggtttctagaatattcacagagttacacatccattaccataaccaatttcaaaacatttttattactacaaaaaaaaaaattctgcattacttagtcataatcccccacactctttcaccttaattcaggaagccattaattgactttctgtctctataaatttgcctgctattgctttgctatataaaataatcatataataggtagtcttttgtgacaggtttgtatcattgagcatgatgtgttcaatgtgtatgcatattatagtatgtgtcattggtacttcatttttttattgccaaaattattctattgtattgatataccacatatttatccattctttacttgacaaacattaatctggtttccatttttttcctaataggaataatattgctgtaggcattggtgtaaaagtagttgtggaaatgtttccatttctcttgagtatatgcctaggagtgaaattgctggtaactcttatgtgtagccacttgatgaactagcagattgttttccaatgtggatgcactgttttacatttctgacagcaatagggtttcctatttcttcatatttccaccaacatttgttactatatgtctttttattatagccattctagtgggtgtgaggtggtattgcactgtagtttatgcatgcttctattgcccttagttatgtagcagtcatgaggctacttcagtgtttttgattctacttggattttggtgtctgcaaaattagctcaagtggcttccatttgaattagtttttcaccataatatctctgtaaaagtaacctttcactaattacttttaaaggggttctctaaagaatccatgagtgagttcaattgtaatcatttctggttattttcatcttcaaaataaccagacgttagcaattgtgaatccttagtaatgtaagaacaaattaaatggcggttaaataataaggactcattaaaacttagttaagaaataaagggatgaatggaaaaatatatccaagaaaaaaattatgagggttaatatggtttggttgtcctcacccatatctcatcttgaattgtagctcgcataattcccacctgtcatcggagggacccaatgggaggtaattgaatcatgaggccgggtctttcccatgctgttctcatgatagtgaataagtctcaggagatctgatggttttataaaggggagttcccctgcacacgctctctcttgcctgccgccatgtaatatgtgactttgcttttcctttgccttctttcatgattgtgaggccttcccagccatgtgaaactaagtccattaaacctttttcctttataaattacccagtctcgggtatgtctttatcagcagtgtgagaacagactaacacagtaaattgataccagtagagcggggtagtgctgtaaagatacttaaaaatgtggaagtgactttggaatcgggtaacagtcagaagttgaaacagtttggagggctcagaagaagataaaaaaaatgtgggaaagtttggaacatcctggagacttggagtgctcggaagacaggaagatgtgggaaagtttggaacctcctagaaacttgttgaatggctttgaccaaaatgcttatagtgatataaacaataaagtccaggctgatgtgatctcagatggagatcaggaactttttgggaactggagcaaaggtgactcttattgtaccttagcagagactagcagctttttgcccctgccctagagatctgtggaactttgaactggagagagatgatttggggtatctggtggaagaaatctctaagcgacaaagagttcaagaggaagcagagcataaaagtttggaaaatttacagcttgttgatgagatagaaaaagaaaaacccattaactgggaagaaattcgagcctgctgcagaaatttggataagtaacaaggagccaaatgttaaacaccaagacaatggggaaaatgtctccagggcatgtcagagaccttcacagctgaccctcccatcacagacccagagacctaggagggaaaaattgttgtgtgggctgggcccagggccccctgctgtgtgcagcctaggtacttggtgccctgcatcccagtcgcaccagctgtggcaaaaaagggccaaggtatagcttgggcagtggcttcctagggtgcaagcactaagccttggcaacttccacatggtgttgagcctgagggtagatagaagtcaagaattgaggtttgggaacctcctcctagatttcagagaatgtatggaaacccctggacacccagacagaagtttgctcctggggtgagtcctcatggaggacctgtaaggcagtacagaagggaaacgtgaggtgcaagcccccacacagagtttccactggggcgctgcctagtggagctgtgagaagagggccaacatcctccagaccccagaatggtagatccattgacaggttgcactgcacaccttaaaaagccacagacactcaatgccagccctgaaagcaactgggaggggtcttgtaccctgcaaagccacaggggtggaccagcccaagcccatgggcttgtatcagcatgacctggacgtgagacatggagtcaagggagatcattttggaactttaagatttgactgccctgctggatttcagacttgcatgggacctgtagcccctttgtttcggccaatttttcccatttggaatggctatatttacttaattcctagacccccattgtgtctaggaagtaactaatttgcttttgattttccaggctcataagcagaagggacttgctttgtctcagataagactttggactgtgaacttttgagttaatgctgaaatgagttaagcctttggaggactgctgggaagacatgattggttttgaaatgtgatgacatgagttgtgggaggggccaggagtggaataatatggtttggctgtgtgtccccacacaaatctcatcttgaattgtagctcccataatttccacatgttgtgggagggagctggtgggaggtaattgaatcatggacctcgtcttttccaggctgttctggtcatagtgaataagtctcatgaaatctgatagttttataaaggggagttctgcacaggctttctcttgcctgctgccacgtaagatgtgactttgcttctcctttgccttctgccatgactgtgaggcctccccagcctcagatatgtcttattagcagtgtgagaacagactaatacaaaggcattgagctaattcttcagaaaagagaatcaactccagaagcatttcaatcagaagccatgctttagattaattttttttcactacctcactccaaataatatttgaattaagtagaatgtagtttatgaatatatatgagttcatgcattcatgaaaattatgttatttgcagtcatcaccaaaataaattcctgtttttactaagtaacatcctaattatatatttacttggtaaaatataggtatatttttattatgtgcagtactttatatggggtttgagttaatctatatctatgaagtaaagcagtacagtaaattgtaattttctgagtttttaggtggtaataaaacaaccttggagaacacctcaatgagcattactaaaatataatttaattctaatcataaacaggtgtatagaaagaaagagcactagtaaagattttatagccatgttgggagactgtatttagaaatgaaatgcatgcaccgattccgtggcttaattgcctgttaatgtcattgggaacattgccatgtacaattgtttgtcaaccttaacctcaacatcaccacgctacccaagtattttctaatatattctgttttggaagggtagctggtactttttcaaatgggatttttaaaaatcttcttaatgtaccgtttctgaagagccagttgttttgtgaagtgatatttagtagtgaatgtttgtaagtacttttataaggctacctagggatttatgccaacaagagaaaggtgcctcctctgggcaggtgaggcattgcagtaggatttaggaatgaatgagggcaagggaaaaacagtgctccttccttcttgtgagtaggccttgtttcagggtcatacaagatatcaatagaaatattccagtccctaaatctgtgcttattctaatatggccctgtagggaagctgatgtttggtgagcccaatcattggtcaggttattttagctcactaacgtttattttgttatttattttttaaatttatattgtgaagtaaattaactcttacaaatgtaaagatgacattatgagtgcgataaagatgacattatgagtatggtcagggacctagaaagtgttgtattctcatcatatatcacagtttttgggaaaaagtactttctaagtaaaggcctacagaacatttctgcagtgggtaacaccatcttccctctgtgcaatctataatacagctgtttggtaattcgaattagttttctgttgttgtgtaacatataataatatgatttctgtaggtcagaagtccaggtgggctcaactgggttctctacttaaggtctcaaaaggctgagatcatgtgccagctgggatgagctcttctccaatggctatgagattcttactggataataaactttccttcaaacttacatgctatcacgcaattttccctttatgtgtccctggtataatgcatattatgcatattttcattccaactctttgttaggaactacaaataaggcatcagtgactgcctaataaccaaaacctatcaatactttttaccttttatctttccgtcatttctttgtgacatttgactatgttcatcattcttttacctcttaaaattttctgtattttagctactattccagtatgttggtattgggtactttataatctttatcttaaagtatctttcaattaactcatgcagaatatattaataaatgatacttgctagtcagtgtggtattttagacaccagggatattgagaatattattttgcctttgaggcatttgagtgttattcataagacaaggtaagtagataattgcattatggaaaattactgcagaaagaggattttttagggataagagagattttttaggggctacaaaactggtagtttaatcactctaagaggatcagtgaaggtttcatagggaggataatgcatggattcagtcttgaggtgagggatgagtaaaggttgccctgcatattctcttctgattccaaatgtgtctgaatttgtgtattaggattctccagagaaacagagcgatagggaggatgcgtgggtgtgtgtgtgtgtgtaatgtgtatgtgcacatacacacacttacatatgtacatatattgagatctggaaatagattgataaatagagaaagagagagagaaagagagagggggaacaggtagatttattataaaaaattggctcacatgattatggaagctatcacatcccaaatctgcagactctgtatcccactttgagtctgaaggcaggcagactgctatagaaccagaaaaactcatgcaaaactgtgaagcaggagaattctctgtcactgggggggaattactttggttctagtcaggccttcaactgattgaatgaggcccactaacaatatgaaagactgtctgctttactcagtctcctgatgcaaatgctaatctcatccaaaaacacctagaataatgtgtaactatacatatctgagcactccatggctcaatcaagtccacacataaaattaaccatcacagtaccatagactgtatcatttgcacggttatctgagtgatctttcacaatatctggatctcaaacctgactacacattatatttttgaatcacctcgagtgccatacccactgctcatctgagattctgagattcattttttcctggagaaggtcttcagcattttacattccaaaccagtagctctcaaagtgtgttccatgggaacaaataatgcagatcctcaggccttggcccagatctagtgaatcagacactctgtggttgaggcccagcgaccctggttgtaccaggccttccatctgtttctcattcatgctaaagtttaaggaccattgccctatatgaatccaatgtaaagttaaggttaagaaacattgtttctaaccacaatttgatttaaatcatagctccatttagttccaatcctatgacaaacatatgcacagagatacgtacacatttcctgattgtctaagaaataaactccacgtgtatcaatttccttaacaagactcagccctctctgttttcagcttaatcctctgaaaaatgtgtattacgcttttcatcatagtctccaaacaggccaggttttttcaataatttcataaccctttcatctttcagtgacctgttttcattttgctctgctttccaaagttatttactggtaagaactgtttcaaatgtcacaactgtaaaagtttttcaacaacttagacaaatgtacagtttcttttcttccacagttaaatgttctgcatgcattaagtataacacttattgcatttcattgtagtattttttcacctctatgggcttgtaaccatgtcaagtttagaaatctggtctaacttatctttgttcatcatagtattgtcaaatacttagtgaatgtcttggtgtatagaacgtggttagtaaattttgttaaatacataaatatattttgctcctagtttctccacccatcataccagctcaacaacttcatgattcactacacaatttattcttcatttaatgcaaatatcctatttaaccttgttctgtgcactaaatgtaaaaatttctttgacctggtcagttcaccaaaaggaaactctaatcattcattgcttgtataatagataaatttccaaaagagccaaagtttgggagatgatactttattgaaactttcaatgtgtctgaaagcttctgctatttccagaatttacaaatgaaacaacaaaaattgcatattgtatacattgcttcagctctctttttcacttgtggacataagagtccacaaaccaatgtttgtgttttctttattcattgagtctttttagttatttttttctcgactctcatgcaaacatatccaaagactagaatccacaaatttcaaatgtaatccaactgttaatgtcagataatagaaatgaaatttagtgtttgtgagtgtattccttgttgccctttaatatgaagttatttttggttagcagctgcatctaacaatataaaaacccgtcacctcggagtgagtatttttaagaccctgtagcttataaacattattttattattatcaatgtgcttattttgatgtatgcaatttgtcttccacaaatgtgtttgtattaccaatttcccttagcacacaaagagatcctaattagcacttttacttagctcgcgaagggaatagcacagaaagaaatcagtattgccttaaccaatgatcaaaagtaatcaaacaaaatgcttttcaggaatattgtgtatacatatatgtatcaatccattgccatataacagattacttcataatgtagtaacagaaaacatcaataaacaatagtgtgttacgcagtttctttggctcagtaataagggaacagcttacgtgggttattcaggttcagaggtattcaagaggttgtcacccagattttgattagggctgtaattatttcaaaatgtgactgggccccagggagatgcttccaacatgtctcacttacataactagcaagttggtgctggtttttggcaaagaactcagtttttcacatcatggactccttcataggactgctgagtgtcttgattgtcatggcagctggccaactcagagtgagttatccaagaatgagtgacctgaaggcaaccatcttctttatgacctagcctcagaaattacacattgttacttctgcaatattgtatttaatattattaaatatggaaaaccttgttaaatatggaaagccattatacaaggatatgaataccaggctggaataattggtgtcgtcttggaggtggctgccagaatttgttcgaatgtttttacttatatgtaaaaaagcacacaagtaaaaataattgaatttgttctcaaatttaaaagagatttattggctcatgtatctgtaaagtgtataggtaaattaagctatgagtttgctttgatcaggtatctgtctccaattctccctgatttttcatcttctgaattttttaacgtcacctttttccttcatgttgctatattatagtaacaagtaacaaattgtatgttaacttgtaacatggtaataagatgagtgacgctaaagttgggttcatgcattctcattcacaacctggggagataaattgtcattttacatagccattaaaaatgttgctgctttcagtttttttttaatgtattaatctcctttcactgccttaaaaatgtatttaatacatgaaatttgtccataagtggatgaattattgtaacaaaatgaaaggcatgtggacactgactcaggaccatcaggcctatatttttattattgctcatggttaactcctttcataccttttaggttctacacaataaggagcaatttgatgagacaatcacaatatccaccacatttacttaatgtgccaatacatttgatgatttattaattgcaatatcccagtgttagtatcatattgtaagacaattagaacaagtttctttattcaaaagaaacttcaaatcactcaaataattttacacagcattgctagatatttattttataggtttcctttcattaaatttctaatacctcttccaatttctttacatgtattgtatcagataacattgcttctccaaaaacttataaaataagagcaatcagaaaggggtttccatattcccgtgccatcctatatatcaacctagctagtggatgttgatatctgtaaatatggcttttttcaggttcctgaaatgcactgtccatgccaagtctctggccactccttcacatgaccttatactgttcttatttgtttgctgtgagacaatgctctttctattttatcctgtttcctgaattcttactttttcactgtctaaagcatgcccctgtcctcaaaaacatgctttattttctatctgaaaataaaattaattcatgcaaagcaaacaaaacctgaaaacatctgttgatctaatattctcctccaaatacatctctgttatctcattcttttgactgaaaagctccttgaaataatttactctgttcacagtttgtactctcttttcttccatgctgttttaaatccattctaacaagactcttgactttgctacttcagcacaatcattctcaacctccatgttgcagaatccaaagcctaatcctattcctctactcaacaaagcatcaacatttgatacgattaacaactctttcaagaaaaagattctttctttggcttacggacataatatccttttgattaactccatccttcattggctcttctttctgcatgctgtttagttcctcctcgcttctctatgtattgaattgtgagacaccaagttttacactttaaatgtatcttgagttgttgccaaggtgatttcattcagtctcatggattggatagctctcaaattttaatctgcagctgcaatgttatttttcccctgaattccatattggccactttaatatctcctcctggaggtctcaaactcgacatgctgcaggtaaatctctgtaaaatctgatttctccctcaatcttcttcagatgtcttatctatctttggaatgatgactatagtccagattgctcatataaaccatgcagtcatttgtctcttctctctcatgttccacatccaatccattggaaacttttgtcagctatacctttaaaaactatttataagtcaactatttcctatcatttatctcacttccaccgcagttcgaacaactttcaccccttacctggggtattttaagagctttctttgggtcctaaccttagcttcctttgggctttgggtcttaatcttagacttcttgttattcacccagctgtcataatgttccttttaaaacataagtgatactacatactactaagtcaaatcaaatacttccaaataaatgaaaatatgacactcataatgaatgaaccaagatacaaacccaggcactcacacatatacacatatcttgtcgaaagttaaagataaggaatgtcttctgttttcaccttagttctgggtaaaggaaatgaaaataaaaaaatgttaatcatcagaaattatgtataaggtacttcttaactattgcttcagatcatcttggtgtcaacaacccagtgacaagcataaatgcggaatattttcaataatttataatatttagtatttcaatagaagcaatacattgataaagtttatgttgttactaaaagttcattggaaagaactttgttagaatgatgcattagaaaaatgttgtcaaatggaagtctaacatttaaaaaaaaagacccaaaaaaatacattggctacaaatttaatgcctcagaatacatcactcttgttaacaagtcagctttcatggagagcaatttacatagtaaaattaccattttaatgtgtaaagtataatgaattttgcagaggcatctagtcactttccacaaccttcgtccacaaaagttaaagggatttctcttctctcacctccaagtcctggtaactacctatagttttgcctttttcaaatgtaatgagaatgacaagtagatactgtggacacctttgagtcattcttttcaggaagcttttgcgttaatgagtcaagtttatgagtcaagcttatgagtcattattttcaggaagccacacctggctaatttttgcatttgtttttaatagagacaggctttcaccatgttggccagactggtctcgaactcctgatctcagctgatccacccacgccagcctccctaagtgctgggattacaggtgtgagctaccgtgcccagcccaattttgtttgtgtgtgtgtgtgtgtgtgtgtgtgtgtgagaacacacattttaacttgtcttgggtaaatagccaggtgtgggattgtcaaacaaaataccatgttcgagtttatggaaacatgccaaattgctttccaaactggctatacaactttgcattaccatcagcagttgcttcacgtcttccgcatgtgttgccagggtatttttccccgtcattctaataagtatgtagtgacatcttattgtggtttttatttgcatttcaccacagagaaatgatgttgaaaatattttcatgtgccatctgcattttcttctttggtggattttctgttcaggattttgcaaaattttataaagttatttagatttttattgtttgaatttgagattttaatatatgcagatatatgagttaatcagatgttcatttttttgaatatattcacatatttttgtcttatcttttcattttcttaatgaacgctgtatttagtgagtttttcaaagaacattttcttgaaaattacaatttattggaggtggagccaagatggccaaataggaacagctccggtctacagctcccagcgtgagcgatgcagaagacaggtgatttctgcatttccatctgaggtaccgggttcatctcactagggagtgccagacagtgggtgcaggacagtgggtgcagcacaccatgcgcgagccgaagcagggcgaggcattgcctcactcgagaagcgcaagggtatgtatattgcggcactattcacaacagcaaagacttggaaccaagccaaatgtccaacaacgatagactggattaagaaaatatggtacatatacaccatggaatactatgcagccataaaaaatgatgagttcgtgtcctttgtagggacatggatgaaaccggaaaccatcattctcagcaaactatcccaaggacaaaaagccaaacaccgcatgttctcactcataggtgggaattgaacaatgagaacacatggacacaggaaggggaacatcacactctggggactgttgtggggtagggggaagggggagggatagcactgggagatatacctaatgctaaatgacgagttaatgggtgcagcacaccaacatggcacatgtatacatatgtaacaaacctgcacattgtgcacatgtacactaaaacttaaagtataataataataaaataaaaaaagaaaattacaatttattggcttttttatgttttttcttttgtgtttttttcgaataattctttgccaaacaaaaggtaacaaaaatttcctttattagttttatatatttaaactttgaggttttatatttatatctatggtttcctttgggccatgttttatatatgatgagtggtaagagtcaagtttaattttctttaatatgaatttacaatggatccaccatttgtcttaatgctatcattttctcaattaattgttatggctagtttgtccataaacccttgagcatttgtgtatttatcaatttctgggctctcattggtaccactgacaatgtatatactaatactacggtgctatgattgctatagttttataatgacacaaaatcagatagtgtgagttctcctacatttttcttcctcctttttgaaattgtttgggttattttagaacagtttttgttgcatataacttttagaatcagcttatcaaattattcaacaatatcggatttttggttggtattacactgaatctaagtttcaatttgggagcatggacacctcaatgaacaacattgagcattttatccatgagtaaacacagtatgttttcagttatctaggtcttttaaacatttctcaaagcaacatatgtagaattcagcatacaaacatttcacgtatttgttttcatgtttattcatgttatataagttagatgttaaaatcttcctttactttcattctgatagaaatatatgtaaataccgaacttgtatcctgtgatactgctagactgttttaataattctatttttttgtatattatatggtattttcttcataatcataataaatcttcatagataataaatcttcatagataataaatttgtttattttgcaatttacatcacttttatttcttttactatttactctaactataaccctaaagatagtgttcaggagaagttctgagagcatatatccttacatttctgtttatttctgatccttgggataaagcattcagtattcactgataagggtgatcatagttacagttttgttcaggttgagaaagttccttctatttgtaacttgctaagtgttctttatttcttgttaaaaatgtcatatttgttaacttttattatgtgtgtattgaatgtgtgcagtgaattatattcactgatttttaaatgttaaacaaccagtcttcttttcctaggatatccctcacttggtcataatgaatgtattatcaaagcctgagatagtcctggggctcagattatgtaagtctcttctcccagagagcattcttagcattatctattttcttttttatatattttattccattttacgatcctttgtgatggcaggccagttttaatcagttgctctttcctgactaaggtggattttttttttaagttctatttccaaaccagtcaaacttcttattgtaattatgtagtttatttaaatattaaacaaaataatgggatatacgcacagaatggattcagaatttgtgtaacgtactttaagttgaaagtttcccaagacttcataaaagagatttgctaaaattatgttccaattaaggagaacagttaggcaattataaaatctcaggtaattttatagaattagaagtgttgccacgcttagtgttttgaaagaatcttcaagttcttccctcacttagaatcaatcaattttgggcttcataaatagcttcataaataactcagtgtgttatctttacaagaatggtggtgttaaccccgaacagcaacaaatctgttctcagagttaggtccatactcctacattgagagattgcagtttgatgaataattatgcatttcaatatatttatacaaacatttaaaatatatatatcattatttttattaattattttacatagtagctgttttgctttaattaacattattatttttgatgttgattctatctgataaggaaatttttattataattagattgcacacccagaaaaagaaagaataaacttataatccattttgttagtaaagttctaagcagcattaaaaatatgattgtaattataaatgcaaaagacggcataaaagttcatcacaaggtaaatcctatatactctataaagataaaagatagaaaagttcacaggcgttatacacaaataggccaagatagaaaaaacatgttaaaactgaattattacaaaaagtagaaaataaatgttatatttggtagattttcttatataattgagtgggccaattgtgacattttcacaagaatagaatacatatttttcgtttactttataatcaatacaatttcttacattctctcaatgtaattactttcaactagaggtaaattactttgactttgtagttctggttaacggaacaaagtgttcattcctaacagcaaaggcacagctttaattttaaagcttctaactcctgttactctcaggtaataatattaatgatatatataaggaattattggaggatttataggcaactggaacaaaataatgtactgaaaagagtcaagattcattttaaataattcacttcaatctagaatttgtatgataactatgtaataaatgagagcacttactgtaaactgacaaaagttgaataactatatgggataagttttatgtgatgtgtttctaaatgctttgtaatttttgaaatatttctacacgtgttatgctccttcctatgaaataacagaccttaaacacagagttggtttaatattctgttgcataaaattcacagaatgctttattttaaaactttttatatggatacagtaaagggatatttgaggagtaatttattatatatgatatacacctttcatataaattatagcaaattattttgaatacaatatttgattttttttactgatatttaaataatatatttaaaaaagagaaaaagaagcatattagtggcaccagcatgtaccagacattgtgagagttttacatataaattattgtttaagtagatttaatagtattataaagtagtttataatatgtattaattgatttaactcacttttttttaactaaaacttaatatgactttcatatacaagattttacaatggaaaaactactctcatttcaaatcaaacaaatacacttaagtggatagtttgttttcatttgagcacctgtttgcaaaacttattgttacatatttattaaagaaaataatggaaacatatttgttaacaaacaaagcattaaccaagcacgttaaaatgtcccagcatcagcccacagtaagtattcaaaagaatgagagtaattttagttctaaattttcctataaggaaatcttttcatagaaatctaaatcagacagaccaaaaatacaatttataaaccatctttattctcatgggcatttatgaaacttagacagctataaatgtgattatttaagttcatattccctgtaaatttttattatagtagtagataagtcttttcattttgagtgaattttcataatgaaagcaataaaagcacattttaggaaaataatctgcaatattatattaacctatttatatatttgacaaatatttttaatactaattttcgaatatgaataatcagattagaaatctaccaaattccctagaaggcatacactcatagacatgatttagattgtttgggtggcacatatttaaataataatggctttgggctaaaagtaaattaaagatttaagtcatgatatttaagaaaaaattagtatttattttttccattcaatgtccataagtgggaaatctggaagaatggcatattttgttgttctgtgttctccagagcccatcatagtgttacgcacatatcagtctttccaaaagtaatcactggataaaatgtattgtttctcaagttataaaagatcttctacatattgtagcatacagcttccacttgcactgcaatagcactttctctgtatcactatctctagagggggcactctgatgacatgagtccctattgtattaatgttgcataaagcacagatgatttttatatagcatagttggtgctggaaaatacatgcatatattttggctttgtttctattttaatattcagaaattattaagatgtacattctgctttttcccaggctcagtattataaagttgacatagttaccgttaattgtttctcaaaaacacaacttggcaagttaaataactcttattataggcttacaaattaaataattaatgcacatcaataaattgcaaataatttattgaagttctgctcctgaagagtgctgagaatatgatttatatttatgtttgcatgatttcaatatattttatttactctgctgtcaaaagaatatgaaaattgttttctagaaatgaagcataaatataaaaattataataacaataatagaaatagtgctttaaggtcttaaggaattatccaattttagccttagcaaaatgcttgtaaatcccatgaataggtttacattttataggtagagtgattgacatttaaagggtaaaatactgacccaaggacacaagaaataatatatagagacccatgggtagttttcagttcacaactacagaaatatctcatatcataaaataccagaatgctgcaagaaggctgtgagtggctataaagtgacagtgagttttcactcgtaattgtctgaaatcacagccacatttttatacatcatcctacttttagtaacagacagcagttattgaatttgcaccagaaattactttaaatttactctaacattttgtttttcgtaattcctgtggttgcccctgacagggcaggcagtatcatgagtcacatgctcaataaggtaagattaaattctgtttcctacaggacactgaatgatagtaggtatatagacgaaactgatattaccctgatcccaaatgctatgcttttaatcattgttacagaatagtgattgtacattagggatgtaaagtaatattgggtcataatggacagagtctatgttgaagcagaaggatttagcttcctgtgcccaagtgtggaatgcatgaaaagacattccagtcccaggggaaagctgcaacaaggcagaggtaggacagtgagaggtgacagctgatagcagtcaactgcttgcttgttcttttattcaaattcctcctcaagatatggtttttccagaatcctttcatagaaaacacagtttcttacttcactggagttgcttttaaccctgccttttcagaaaaagagcagagatttggccaggcgcggtggctcacgcctgtaatcccagcactttgggagaccgaggccggcggatcacgaggtcaggagatggagaccatcttgtctaacatggtgaaaccccgtctctactaaaaacacaataaattagccgggcgtggtggcgggcgcctgtagtcccagctactcgggaggctgaggcaggagaatggcgtgaacccgggaggcggagcttgtagtgagcggagatcgcgccactgcactccagcctgggcgacagagcgagactccatctcagaaaaaaaagagcagagagttacttactcaggaacaagtaaggttgctgatacctatgactagagcttacaaaattattcttaccccagatttttaaaagagattgcttttgtctgcttaaaattgggagatacaggaatacataaaatcttttatgatatgtagaatagaaaatatatatgtatgtagtggtaatagtcaaaagaagtagaatataaccctttgctgagataaatcatttaaactgtgtcaatttcaattttttataatttataaaataagcattttgactaattattatgttagttttgaaataatgtaataacaaaataaagtgatatttaatgttagtttctaaaagaagttttagcattttcatgataagtaaacatatatttaaagcaagtaatttaatttaatgtatatattcatttatcaatataatatataattaatataataatatacaagcatcatattatcttttactataagtagataatcagttattaactatgccaatataaattatatatgaaggtattaatatattactttcaagatgtcataactttttaacatatatataatgtaattcttgatatctacaaagatgttgcaaaatacaataataaacagattttaacacatctctgtacttaagaattagagttacaaaagcattatcctaaacattatcttattagttttacagtataatatttacttttacgtgttgttttctatttttacaaaattttacaatacttgaatgcagtcttctgacacatttctgagaacaacaatttgtttctaagattgcttcacatggtggctgtgttgttatttattttctgtatgatataaatgcatcaaagttttgtatccattcaggagttgttgaatatttttattttcctattgtcgttgttgccattaattgtactgatagtatgtatattcaagagttttcctataggtataaatcagggaaattacatcatctagagcatgagaatatacaagttattccttatgagttaactttataggcctttctttgtctatattcaatccagcatttggagaaatcttgccaaacttcttagtattgtgttagtctggcttatgttaaatgttaacttattttgattaacctactttttttcatactaatgagactgattttttttcatgtttattttttatttatattatctcttctattaactgttggccattaatatttgcctatttttatattgtgttggcttttaaaattgtttcaatatgttaaattatatattacagatacaagtcctttgtcagttacgtgtgccacaaatgtgttcacccaaattgtaatttttttcctcttcatgatatatttggagaaaatgagtaagaaatcatgttttagtgcaatcaaatttatcaattcttccttcttgttttagtgaattttgtgttttgaaattgtgcatgtaacttaagtgcacatattaatgctaaccatttttcccaaaatatgtatgattttgccttatatacttgtctttaataatttaaaacatgtttttgtgtaagtgtaacataagatcaatgtcattattcttattgttactactactattattattatgtgaataacaagttgtactatttattgattaacccgtacgttcaccattgatctgtaatgccgtcatcaccatatattaaatttctatgtatagtgggtctttggctgggttctgttttgtgtttctgttctgtttgtctatccctgtgacatagtcatagggtgttaagtgtagtaagccttgataaatggtacagcaactctccttttttttttttttttttttgagaaggagtctcactctgtcactcaggctgcagtgcagtggcgtgagctcagctcgctgcagcctccgcctcccaggttcaagtgattctcctgcctcagcctccccagtagttgggagtacaggcatgcacaaacacacctggctaatttttgtatttttactagagacgaggttgctccatgttggccaggctggtctcgatctcctgacctcaggtgttcctcctacctcagcctcccaaaatactgggattacaggcgtgagccaccatgcccggcgtgcaattctgctttattcctcttcttcatacaagtctgaattatcttagtgtttataaatattagaagcagttttcaattgctatgaacaactttcattggatttgtattagattacattgaaaataccatcaatctggatggtatgtccttatttgtgatattttgtctctttaaccgcagacgtaatacagctcttaatatctttatatcttttttaatgaaattcagtaaagtattctgcatatgggtctttcatatactttgttagatttattcataggttcctttaattcttagatttttcaccattaagaatgatgtatgatgcaatttttcttgtcatttgttgttttattggatggtttttagaatatatgaatattgcattttattttttgtatttcttaatatgttcttgagtgattatgtatatgctttatcatctttcatttaattcactaacttgtgaataacttttattgtatctttatgaaaatttacttcttttctgtacctcttccgtctttttttgttgagctaaacaaacattcctgggacaaaactgatcaagaattatcaagaacaactcagtggagtgtgtttactattattttgtttaggcagttgacacttaatatgtgtcgtgagtggtagtgtctagtattggttccaaagtttcacaagcaaaataaataaataaataaataaaaattttgaaatatttcctctttcttatattttctaggggaaaaatgtgtagactgtaattacctgttactttaagtaaaaaatctgggacaaatttttttctctctttgcaaaaattaactttttactgaaaaatttattttctctagttactttaatacagcactacttagattttctatttattttagagctacttaagacactttttaacccatctattttcttactatcatgaataacttctctataagtatttattccctttttcccaatattgttgtatcttttttactagtcttattattaatgtattgtatgttgttacaatttaaatttgaattgcttcagagaatgacagatacattagcaaagagaaagccagacagagagatttaatttgttcattatgtattctgaatctctagcttggacttgtaaaatataccagacatttatgtttttgttacatctcagaattaataaacccactgaaaagataaaaagtcttagtttaagatgtttttgaaactattgaatatattttgatatctacgagagttacatgtaaattgcatgtatgaatctcatgctaaattttgatttcaattattctttatttttccccgagcgtgacttaacatcacactctgcatatattctgccataagaaaatgattctttgtgtaaagaaatttattttttgttttctttgagtttagttagatttgaacattaaacttttttaaagattaggtaattattttttaccaactgctgtgtttttcttagattaatgatgaaaccaattgttcatcctgtagactctgacagcatacaatgaattctgacaactttctcccactcaagttcctgataacatgtaatttccttgatatgacaaaatatcattttggcattcatgtcatgccatggtgttcatttttcattttcctgtaagttaatgagttctagcaaagagcgccttcataaagttgtcgtttgccaaaagtccagctatggcatatggaaccagtgacaagctacagtattaaagagatttgttttaaaccgagcctctaaagtgtgcatggaaatactaaatacattcctgtgtattttgcagataatcctgatttgctgagccatgtcacagtgggtattagagttctggatgtcaatgacaatccacccgaacttgccagggaatatgatattattgtatgtgaaaattctaagcctggccaggtaagttaattgtttccttcctcctcatttgaatggaataaatgcaagcgcctttatttttattattcttaggtataatcccccaaagcccacagtgtaattttgtactcagtggaaataatttcataaagctttattttaagtaccaaataatttttggagaatcaaagcaattgaattttctttggatccgaaatgtaactcagaaaaatgaattcattcatgaatgctgcacaaattataccaataaaatgatattgaatgctttatgtccaaccctactttaagtgaggaggaaatagcaaacgtttctctcttaatgaggttgatggacttgattgtgtcagagggactagctctattttggaggatctgcaggagtgacacaggaatgatgattgagtgatgctgatgctaaacgatgattcaattttagaaacatgaagagtatatatgtattaatagggtggtgagagtgaagatggatctggatcatggggcaagaggctggatgtcatgtgcatctagtcaaagaagcatggcaatttggaaggctggttgcctatagcaaatagagcaagtaggagactgaaaggggttgtgcatttgtttttctgctgtataagaaattatacaaaatccgcaacttaaaacaacatgtatttattatctcacagtttctataggtcagaaatttgtgcatggcttagctgggtctttgcaagagtctcgcaagactataatcaaggtgtctgctagggctgttttctcgcccgaggctcagggatctcttccaagttcatagggctgttgggaacattcagtttctttctgatacagacccgagaaagtcaagactttcctttactcctcaaggctgcccatatctctgagataccacaagcagttgcttgccatttggacctccccaatatgtccagttatttcatcaagcaaataagaggagcaagcctgcaggcaaaacagcctcatataatgtaatgtaatcaagtgagtcatgcatcaacacatttgccatattctgttttcagaaccaagacacaggtcatacccacactgaaggcagagggattacaggaaggcgtgcattccaggagcagcaccttaaaatctatctgctgtggatgaatccagaagtggaaagggtataggtcaaaatatgccctttctgagtcaaaagtactctattattgtctttagtgaacccaaatgagtataccttcccaaatcatgccaagtcattttgaaacttgtgctgaaattatactcctgagaagcatccttttttgtgtttatgtatgagggacaattgtgaggcttgctaaagtaatcattacctatttgtttttagtcccgtcagggaaaaatatatgtctatctcaatgtctggctttgtaacataaagcttttttcatgttcactgttgttaaaataaaaaactctagacataatacatttaaaagggcttatttaagcaaaaaatgagtaacaaattgggctacactcacaatcagaagaagtttaaagagctccatccagcagtgtgagcaacaggctttcaaaggctgaacacagaagccaagtagagaaattacctgaccgggtacagctaggcgtttgctttatttgggcattagtgaccagttggctgtcttgtaattgcctgaaacccagctatttgttactaaaattatattcctaaattaggtttcttttagttggcataatgtattagtcagagttctctagagagacagaactaataggatagaagtatatatgaaagggagtttattaaggagtattgactcacacaccatcacaaggtgaagtcccacagtaggccctgtgcaagctgaggagcaaggaagccagtctgagtccctaaacctcaatattagggaagccaacagtgcagctttcagcctgtggccaaaggactgagatcccctggtaaaccactggtgtaagtccaagaatccaaatctgaagagcatggagtctgatgttcaaggtcaggaaggatccagcacaggaaaaagacgagggccggaagactcagcaagtctgctcttccatcttctgcctgttttattctagcctgtctggcagctgattagatggtgcccacccagattgagggtgggtctgcctctcctagtccactgactcaaatgttaatctcctttggtaacaccctcacagacacaccaggaacaatactttgcatccttcagtccaatcaagttgacactcaatattaaccatcaaacatatttaggtagcattttgttacacagaaactaaaaatgcaatgatagcctcaggctgatatggcctcctacttaattaatttaacatttcccatgagaaaattagaaatatgaatgaggacacagtaaagttatacttgaaagcattgtacagtttatataatttattcacttaaaatattaagattattattttatatgcttaaatatttttctatgcactgatttcaaaaccagtaaatacttttatagtataaatatattattaaatattcagcaaattttatttcaattctattaaaaatggatgcatacatcctaacataatgttcttgaaatacattataaaagcacagttgatgaaaaaatattaaacattctaatggaaaatttaaatttaagaaaatacagtatctcaattactggtaataacagcagcttagacatagtgcaagaaaaataagggaactggaaagtaagtcagaataaaaaaatccatgttgaagcatggaaagaaaaagaaaatataaataagagtatgagagacatatgggacatgcaagtgtaatataaaagtttttcaattctgagaggcatatgagagagaatgggactgaaataatatttaagatgattatagctgaaagttattccaaattgatggaaatatcaagccaaacactcaagaaacaagagaaacaaaaccaccaagcatactgcctacaaaggtaaatttgcctcagtgcactaaagtaaaatattagcaaaagtaaaagcagcaagagaaaaaagataggtgataccacaatcaaaatcacaggacctaagataaagcaaagcattctttgacttgaccccaaaaagcatgatccataaaaggaaacagtgataaattgaatttcatcaaactttaacagttttgctctttgaaaaagatgctctttgaaaaagtctgttaagatgataaaaaaagacaaactacagactttctacttatagtactatagtttcaaaactcaacaataaaaacagaagataaaatccaatttgaaaatgggcaaaatacaagagcagacatttactgacaaggacatagaaagagccaaccagcatataaaaagatattccacatattttttaaaaattatttctattcacattaggtaaatagaaattaaaactacaatgtgatatcgctacaggcctagcataagagctaaactttttggtaaattgtggagaaattaggtcatttctacatcattggtgaaagtgtaaaatggtactgctactgggaaacatattttgacagtttcataaaaaattaaatatgcagctaccataaaattcagaactgcatttttgggcatttcccacagagatatgaaattttatgtttatacaacaaaatgtgcacaattatttatagcagttttatttataaaaaacccagactggaaccaacaaagacatccttcaataggtgaatggttaagcaaattgtggtgaattcatagatagagacacaaaaaaccttcaaaaaatcaatgaatccaggagcttgttttttttgaaaagatcaacaaaattgagagaccactagcaagactaataaggaagaaaagagagaagaatcaaatagacacaataaaaaatgataaaggggatatcactaccgatcccacagaaatacaaactaccatcagagaatactataaacacctctttgcaaataaactagaaaatctagaagaaatggatacagtcctggacaatataccctaccaagactaaaccaggaagatgttgaatcgctgaatagaccaataacagcctctgaaattgaggcaataattaatagcctaccaaccaaaaaaagtctaggaccagacttattcacagccaaattctaccagaggtacaaagaggagctggtaccattccttctgaaactattccaatcaatagaaaaagagggaatcctcccaaactcattttatgaggccagcatcatcctgataccaaagcctggcagagacacaacaaaaatagagaattttagaccaatatccctgatgaatatcaatgtgaaaatcctcaataaaatactggcaaaccaaatccagcagcatatcaaaaagcttatccaccaagatcaagttagcttcatccctgggatgcaaggctggttcaacctacgcaaatcaataaatgtaatccatcacataaacatatccaaagacaaaaaccacataattatctcgatagatgcagaaaggcctttgacaaaattcaacagcccttcatgctaaaaaactctcaataaactaggtattgatggaatgtatctcaaaataataagagctttgtatgacaaacccacagccaatatcatactgaatgggcaaaaactagaagtattccctttgaaaactggcacaagacagggatgccctctctcaccactcctattcaacatagtgttggaagttctggccagggcaatcaggcaagagaaagaaatagagtatttaattaggaagagaggaagtgaaattgtccctgtttgcagatgacatgattgtatatttagaaaaccccattgtctcagcccaaaatcttcttaagctgataagaaacttcagccaagtctcaggatacaaaatcaatgtgcaaaaatgacaagcattcctatacaccagtaacagacaaacaaaaggccaaatcatgagtgaactcccattcacaattgctacaaagagaataaaatacctaggaatacaacttaaaagggatgtgaaggacctcttcaaggagaactgcaaaccaaccactgcttaatgaaacaaagaggatacaaacaaatagaagaacattccatgctcatggataggaagaatcaatatcatgaaaatggccatactgcccaaggtaatttatagattcaatgccatccccatcaagctaccaatgactttcttcacagaattggaaaaaaactactttaaatttcatatggaaccaaaaaagaacccacattgccaagacaatcctaagcaaaaagaacaaagctggaggcatcacgctacctgacttcaaactatactacaaggctacagtaaccaaaacagcatggtactggtaccaaaacagagatatagaccaatggaacagaacagagccctcagaaataacaccaaacatctacaaccaactgatttttgacaaacttgacaaaacaataaatggggaaatgattccctgtttaataaatggtgctgggaaaactggctagccatatgtagaaagctgaaactggatcccttccttacaccttatacagatattaattcgagatggattaaagacttaaatgttagacctaaaaccataaaaaccctagaagaaaacctaggcaattccattcaggacataggcatgggcaaggacttcatgactaaaacaccaaaagcaatggcaacaaaagccaaaatagacaaatgagatctaattaaactaaaaaccttcagcacagcaaaagaaactaccatcagagtgaacaggcaacctacagaatgggtgaaaatttttgcaatctactcatctgacaaagggctaatatccagaatctacaaataacttaaacaaatgtacaagaaaaaatcaaacaaccccatcaaaaagtgggcaaaggataagaacaaacacttttcaaaagaagacatttatgcagccaacagacgcatgaaaaaatgctcatcatcactggtcatcagagaaatgcaaatcaaaacagcaatgagataccatctcacaccagttagaatggcgatcactaaaaagtcaggaaacaacaggtgctggagaggatgtggagaaataggaacacttttacactgttgatgggaatgtaaactagttcaaccattgtggaagacggtgtggagattcctcaaggatctagaaatagaaataccatttgacccagtggtcccattactgggtatatacccaaaggattatacaccatgctactataaagacacatgcaaatgtatgttcattgcagcactattcacaatagcaaagacttggaaccaacccaaatgtccatcaatgatagactggattaagaaaatgtggcacatatacaccatggaatactatgcagccataaaaacgatgagttcccgtcctttgtagggacgtggataaagctggaaaccatcattctgagcaaactatcacaaggacagaaaaccaaatactgcatgttctcactcataggtgggaattggacaatgaaaacacttggacacagggtggggaacatcacacgctggggcctgtcatggggtgggagaatgggggagggatagcattaagagaaatatctaatgtaaatgacgaattaatgggtgcagcaagccaacatggcacaggtatacatatgtaacaaacctgcatgttgtgcacatgtaccctagaacttaaagtataaaaaaaaaatcatattgcaaataaaggaatgcacttctaagtaacttaatattccatgaagaagaacaaacttaaatgaaaaaacaagttccatgaaatgataatgtaaataagtccatataaaaatttctaggaaacagttcagccataactaacaggaaatttataattttaaatgcatataataaagaagataaaataatgcaaattaaaagcctaagcattattcttaagaagttagaaaaataaatcaatttaatccaaataaaatagaataacaatttatgagatgaatttaatgacatggaaatgaaccaaaagaaaacattgaagagttcacagcttagttatttgaaaagacagataagtccctggtaaattgttaaaaacaaaagagagaaatagaacaaatgaagaatattaggaaaaaatcaagaggcttaccgcctcttgtaactatagactttacagatatcagaagccaattgtatattacaatgtcgtcttttactaaaatttgaaagtttagacataatgcatatatttttagaaaagtaaagtttgtcaaagctgacacaagaatagatttagctgggcttggtggctcatgcctataatcccagctacttgggagtcttaagtgggaggatcccttgagccctggaggtcaagtctgtagtgagctgtgatcctgccactgcactccagcctgggtaacaaagtgagaccttgtctcagaaaataaataaatataaataaataaataaggactgattaaagttgtatttattaaattcattaaatatataaataaaaacctttccacaaataaattctcttctcatggctttaatggtgaattctactaaaaatttaagaaaaatcatgacagtaattgtaaaaggtattcaagagttcagaaaaagggtggcaggatcatttttgtacacattttatgatgccagcataactttaacatcaaaaggtataagtggaattatagctattctctgcacgatcatagatataataaatgtcataattaaaatatttgtaaaccatataaagcaaaaaaggatagtattttaaaaagagacgatgaaaaataaaaacctacctaatcaggagaatccaaagcatttgtgaaaattcaacacccattaataatagcaacaaccgtgacaatgctgctatacgcaggtagaatttttgaatgacattaacaaatttgctaaatatcaggtcaatataaacatgttatttagagttctcataccacaaacaattagaaaattaagttgaaacactagaccatttgccattacattgaaaataagacacctaagagtaaatgttacccttgttagcactcaactactgtctctctagagggcaactcttaaaacttaggtcctttgcctcagtggatctttatttccatgatttttagattactcagagatctaaaaattggtaaattaaaaatatcatttgaaatatgatttaaagaaccaagcatgggcttatgtttgcatcagacattgttttcggactaattataattttaaaaattcatttaaataagcatatagattgtatttttaaatttcaagatcatttcaaagctttaaggttaaagtatattctcataatatggcacaacaatggttgctagtcccatgctacctatgtagtctgctgcaaatctaggccaataacacccagcccttgctcttggcttaattgatacttattttctctgaagcaatgggctgagctgtgtattggccccttttagctatgacttggatgcagggcaccaagtcctgcacaaagcagcatggtcctgggctggcccacaaaaacagtttttcctcctaggcctctaggttggtgatgggaggggctgccgaggacacctctgacataccctggagacattttctccattgtcttggtgattaacatttggctcctcgatacttacacaacttgaatttctcctcagaaaatggttttgtcttttttatttcattgtcaggcttcaaattttccaaacttttatgctctgcttccctttaaaacctaagttccaaattcaaaccatccctttgaaatgcataaaactgaatgattttaagagcaccagggtgctctttgctattaaaaatttcttccactagataccctaaatcatctctctcaagttcaaagtttcacagatccctagagcaggggcaaaatgccaccagtctctttgctaaagcatagcaagagtcacttttattctggtttgcaacaggttcctcatctccgtcctcagcctggacttcattttagatatcactatctgcattttcgtcaaagccattcaacgagtctctagaaagttccaaaccttcccacgtcttcctgtcttctaagccctccaaactgttccaacctctgcctcttacccagttccaaagtcaatttcacattttttggtatctttgtatcagtgtcccactctccgtggtaccaatttactgtattagtctgttttcatactattaagaactgcttgagacatggtaatgtataaaggaaagaggtttaattgactcacagttcagcatggctagggaagcctcaggaaacttacaatcacgggggaaagccaaggggaagcaaggcaccttcttcagaagcctgcatgaaagagaagtgctgagagatgggggatgagctgcttataaaaccatcagatcggctgggtgcattggctcatgcctgtaatcccagtactttgggaggctaaggcaggcagatcatctgaggtcaggagttcaagaccagcctgcccaacatggcaaaaccccatctctttcaaaatacaaaaaattagctaggcatggtggcaggtgcttgtaatcccagctactcgggaggctgaggcaggagaatcgcttgaacccaggaggcgtaagttgtagtgagctgaaattgcaccactgcactccagcctaggcaacaagagcaaaacttggtctcagaaaaaaaaaaaaaaatcagatctcctgagaactcactaacaggagaacagcataggggaaagccaccctcatgatccaattacctccacctggtctctccaggtaggggttatgtgggattataatgtggggattatggggattataattcaatatgattttagtggggacacaaaacctaaccatatcaaaaaggtaattactacacttagcatttgacattactacccttctaatattttgattaagttttgtaagttgattatgtggttactcctttttgcactttaaaacactatacatttagctaccattgttgcctttaacattgaatagttttagatgtgattataagataattgaacttattatgctgttgcttgtgtatttgttttcacctcttccaccaaaataactttaagctttaattgatgggagaaaagattgtttgtaagtgtagcttgtggcatccacatttagacaaatcattaccagtgtatgtgctctgcttgtgagattaacccattacagagtgaaatggcccgaatctgtattctttagtttcatagtgtttgactcttttaaccatatcttgaaaacacttttgaagaaatccgatgcatcctgatgcagagttggaataagaaactctatttaaacaacaattggcgaaatcagttttctgaagtgtatttgtattgccaggctgtgtgactgttcctctttcaatgacaattgcttttcaaattacggatatttctattatgaatgctgcacatctaaacgtatcagcatgtagctatgtcaaagagattggctttttatgaaagtttaagccccgtataacagcagagttcaggtaaatagagatactaatgtaaactgcaacaatatagttctctaagttaatatattttcctgttctgaaaaaaaaaatcttttagtatgttgcctgagaaaaatattaaaaagaaaggcatgcatgcatgaaatttgaagacagttcccaaagtagaatgatttaagaaaaatttagatatgcctaaagtggaaacattgaaaaaataaagagagtctattctattttatgcatattaaacttcctctgtattctttctttcattagaaataaatgtacaaaaataacacataaaagaaattttattacataacattctctgcttccaccacatacaattattaaccatatagctttgcatgaaaaaattaactaggtcaatagagattctttactgtcaaaaatcaagctcatttaaataacaaaagttgatgttatcaaataaatgtatgcagatactattaacgattatattatgaagcagatgcattgactaaacaggacactatgtattttagaaaaaattattttagatcgagaggttacatgggcatttttttacatgggtatgttgtatactggtggggattgggcctgtagtgtatgcattactcaaatagtgaacattgtgcccaacaggttatttttcaacccttgccccttcccactctctgcccttttggagtccctgttgtctattattttcatctttatgttcctttgtccccattgtttagcttccatttataagtgagaacgcgtggtatttggttttctatttctgagttaagaacattcttggccaggcgcagtgattcacacctgtaatcccagtattttgggaggccaaggagggcagatcacttgaggccaggggttctagaccagcctggccaacatagcaaaaacccatttctaccaaaaatacaaaaattaggcatggtggcttacacctgtaatcccaactactcggtggctgagacacgagaatcacttgaacccaggaggtgaaggttacagtgagctgagattgagagatcgtgcctctggcactccagccttggttacagagtgagtctctgccacaaaaaaaaaaaaaaaaagaaaagaaagaaagaacttcctttttaaaatgcttaagccaagcaagttcatttgccaaaactaacattatggtattagattagacaaattttatatatttgtgatactgacttttccctaataaagtactctaattaacagtaacagtaacagtaactctaattaacagtaacagtctgtctcaattaacagacaattgaaagtatatttttaaaagtggatacatctatttgtagatatcaaaaatactccctggtaattatttataaatagcaactgtctattttttttcaccctttgcttttgtaatgtagactaaatttgtaatatcatttatttgatatctttaaaaataaataaccattctatgtattaattagatcatgtatatgtgataaataacatttgggttcaattagaagacacatgaatcaaaaaagatattcttagggattttatattactaaagcaattggacaaagaaatagcaaggtaacacagtggatataaatcagaattctgacaaagggatagaaaatttgatgatggaaacctggcaattatctagatatctgccagaagtttataacttctaaaaaccataaacatgttaagttcccaggtatattttctaaagaaagtctaaggtaacaatgaatgcaaattctattacatgatgaaagagacaaggtgatttgtaaaacagaaatattgaatatgccaatacagagcagagaccaagcaaatattacagcattttggacaaagtcagactgacattctcgtttttggaagcttttttttttttcagaaatacgattaataaaaattgaagcttacatacattatcaacaactctgtaagagttcaagatgatgggacattgttaaacaagacatgataatcaaatcctcattttttatgtagagactaggagtttctctcttcttttttttaaattatactttaagttctagggtacatgtgcacaacgtgcaggttggttacatatgtatacatgtgccatgttggtgggctgcacctattaactcgtcatttaacattagatatatctcctaatgttatccctcgcccctcctcccaacccacaacaggccccagtgtgtgaagttccccttcctgtgtccatgtgttctcattgttcaattccaacctatgagtgagaacatgtggtgtttggttttttgtccttgcgatagtttgctcagaatgacggtttccagcttcatccatgtccctacaaaggacatgaactcatcattttttatggctgcatagtatttcatggtgtatacatgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggcatttctagttctggatccctgaggaattgccacactgacttccacaagggttgaactagtttacattcccatcaacagtgtaaaagtgttcctatttctccacatcctctccagcacctgttgtttcctgactttttaatgatcaccattctaactggggtgagatggtatctcattgtggttttgatttgcatttctctgatggccaatgatgataagcattttttcatgtgtcttttggctgcataaatgtcttcttttgagaagtgtctgttcatatcctttgcccactttttgatggggttgtttgcttttttcttgtaaatttgtttgagttcattgtagattctggatattagccctttgacagatgaggagattgcaaaaattttctcccattctgtaggttgcctgttcactctgatggtagtttctttcactgtgcagaagctctttagtttaattagatcccatttgtcaattttggcttttgttgccattgcttttggtgttttagacaggaagtccttgcccatgcctatgtcctgaatggtaatgcctaggttttcttctagggtttttatggttttaggtcaaacatttaagtctttaatccatcttgaattaatttttgtataaggtgtaaggaagggatccagtttcagctttctacatatagctagccagtttcccagcagcatttattaaacagggattcctttccccatttcttgtttttgccaggcttgttaaagatcagatgtagatatgcagcattatttctgagggctctgttctgttctattggtctatatctctgttttggtaccagtaccatgctgttttggttactgtagccttgtagtatagtttgaagtcaggtagcatgatgcctccagctttgttcttttggcttaggattgacttggaaacgtggactcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctattttatttcattgagcagtggtttgtagttctcctttaagacgtctttcatgtcccttgtaagttggattcctaggtattttattctctttgaagcaattgtgaatgggagttcactcatgatttggctctctgttatgtgtgtataagaatacttgtgatttttccacattgatttgaaatggataaattccttgacacatacaccctcccaagactaaaccaggaagaagttgaatctctgaatagaccaataacaggctctggaattgaggcaataattaatagcctacaaaccaaaaaaagtccaggactagatggattcacagccaaattctaccagaggtacaaagaggagctggtaccattccttctgaaactattccaatcaatagaaaaatagggaatcctccctaactcattttatgaggccagcatcatcctgataccaaagcctggcagagacacaacaaaaaaagagaattttagaccaatatccctgatgaacatcgatacaaaaatcctcaataaaatactggcaaaccgaatccagcagcacatcaaaaagcttatccaccatgatcaagtgagcttcatccctgggatgcaaggctggttcaacatatgcaaatcaataaagctaatccagcatataaacagaaccaacaacaaaaaccacatgattatatcaatagatgctgaaaaggacttttacaaaattcaacaatgcttcatgctaaaaactctcaataaattaggtattgatgggatgtatctcaaaataataagagctatctatgacaaacccacagccaatctcatactgaatgggcaaaaactggaagcattccctttgaaaactggcacaagacagggatgccctttctcaccactcctattcaacatagtgttggaagttctggccagggcaatcaggcaggagaaggaaataaagggtattcaattaggaaaagaggaagtcaaattgtccctgttttcagatgacataattgtatatctagaaaaccccatcgtctcagcccaaaatctccttaagctgataggcaacttcagcaaagtctcaggatacaaaatcaatgtgcaaaaatcacaaggagtttctctcttaaaaaaacacgattgtcatatgtgagctttctgtttaattcgcatttgaaattatctgtaaaaaagtgaaaaagatgccttacaaacacaatagaataggaattatatcagagtttaacaggtataataagctcatatttgtaaaaatattaagaaataattaaaataatttgtatactaactgaaatgtatagtaaagaaaataataatcccacagcagtgataacagaaaccataaactggctcagttaactcaaatgaaatattcttcaccaatcactccgaaattcgattcttggataaaaagtaaacttgcaaatgtatcactatgttatgaggtatgatggagaaaatagggtcacacactggagaatcactaaaattcaagagcaaggtgagagaacatttgttttataaagaaggggaaaaaagaggtaacattatatatttgtatgtgttggaggaagtgagggactatgcaatgcctgcttaaatatttatttaacccttaaaaaacttaaaatattgacattttatttcaattttgtattaagtaactaatgtctagctaatgtatatatgttcctcagatgaggcagcactggaatttttacaatatatctgattatccatcaatgtattcccctactctaagtgaaaacaaggggaaaaacaatctacccagagactagttgtattcaaataaaaaaaaaagattttcagcttataaataaatatggagggaaatcaagaaggatagagacttatttggagatggaggcaggggtaaggagcacataggatcttgctaaacatgtatcttttgagcagtgatggaaaggcggtgaaagagtgagcccagtaaacataatgaggaagttgatctcttctgtatcctgaagtactttcttcactgtcacttcatgaaaacacatgcttttctggtgttactgtcactcacccccacttctcagtacttttattttcctcctcatctttctgacaaactaatgggctcagaacacgcagagaaatttaagttttaactgtgatatcctttggtgaattaccttctttggaaaatattgaactggttgaaattagttataatgttctaagaaatgatattagttcaatgtatttcagaaacaggaaatattattttcacagctctatcttctctctctttgtttctcgtttttctaaggaaagggttgaatgaagacacctaagcattatgataattttcaaaagaggaaaatatctttttgtctgtttattttgatatttattttttaagagcagactggccatacctattgaaatgcacgttcttctcttgggccaccataaattctaacttactctgctttttagtgtacattaagtccagattctaaagaattgctttctcctgagcactagagaggagaagttattcataaatcacggaaggtcttgtttagcctctgccattattttagacatttggggcacctcaccatccttccaggattcaggctcctcgtctgtaacatacagggactagatcatgatcttgaaggcctcctgaaaaaaataataaaaccaagactccactgttcttgcatttactacttagaccaacatacagtgataagctattctgaatcaacactgggatatttatatttatgcaaacaatactttatgtctcctccaacaggtattcatgtgaaaacattgcatctaattgaccccacagtaccatggctgattaagaaaaaaaaaatcaatgcgtttgcaatgctagaaaataaagtgtgatgaatgtttagaaattatatactgtgtttttcctaaaatctaatgcaggatacagcaatttagttgattgttttatgacctgaatttgaaaaataactcaagttggaagaaaagatcctttaaaaatatttttaaacagaaataatacagtgtaattaaaatcaagagaacaagcaaaattaaatttacgatttagagtttgtcttttctttaggttattcataccatcagtgccactgataaagatgattttgccaatggaccaaggtttaacttctttcttgatgaacgcctgcctgtaaatccaaacttcactctgaaggacaatgaaggtgaacatatatacacatatttgtttatctatgtggtatctgctttgaccttatatgtaataggctttattcttatatacacacaaacatcttgcaaatcagcattcaaagtcagtttgatgctactgtgttatgatctgtgaatagcttgtgtttaaaattgagccatatgtacaaataactttcattgaatttattcagaagcatctctttaaacaagaaatgtacatgtaatatgctcttgggcaaattttaagagaaatcttagctgacaaacttgtttatgagagctgctgccactgcttggaggtagaaaatattcaaattaggaaaaaatgaaaaatatatcctagagacagttactaaaggaaatgcaatgcttgcaatcatcttgtatgagcaaggctatcaagatgtgctttacaaattatatttcctcttgttattataagcattgtccaaaatatgggtagaaggatacacagaagtatgcagcatattttggaaatttttgaatcattttcatttagccttctgtatagtgtggttaaaaataatcccataatttagtaactacggaagtttcttcattatttagatgtcctctttggtacatttctcaaggttccatataagtcattcttcatacattagggaaacattaagccatatggtatgtgcagttttctgattaggatcaactttttctttgtccaaactatatatttgattatgtttatctgaatatgctgctatttggaatttaacacttgcctcagaatcacatgcagaaaacagtggcacatacattttgaagtaaacattgaattccctttctcttcacttccgggagaagattttcaaatgcaagtcactaaatgacaacctgccaaaagcatttttcccattttccctgaacatctttaaatataacaaagtatcaaaatgcgcacaaagccaaaagatctatatgaacatttaaagcttaattgtctctcacattttaagtggccctatgtcagctctgcttatgggaatcaatatttgtgcatgtttgtgtatgacaaattgcatttaactgactattgtacatttacttacattagaacaggctgtcttataattcaaatatacttagtatgattaactatgtgaaacttgtgaaaaaatcatatttttccatatttcaaagaattgtaaaatttggcagaggttatttaacttgcttccttaggagattggaatcatatgttgatccatgtacttatgtttcagttgcatttttttctattccaataaaaatttatattttaaaataatttaaatttgataacattacaatgaaaatttgacttcgatttgaagatgtgttcaattcaagcagtttaacctacataggtataactctgaatgtattttagaaaaaacagaataattttgctattattgaatcccacattctttttttttttttttcttttttaagagggaggtttgctctcgtaccatgcctggctagttttttgtttgcttgtttgtttgtttttttcagtagagacagggtttcaccatgttggccaggctgatctcgaactcctgacctcaggtgatctacccgcctcggcctcccaaagtgctgggaatacaggaataagcctctgcccctggccaaatcccacattcttaatgagaagttcttcataaaagattgttatagctggaatttgtgaattaaattaaaattatatatatataattgtaattatatatgtaattatatatatgtttatatatgtaattgtaattatatatatttttatatatatgtaaatgtaattatatatatttgtatatattgagatagagtttccctcttgttgcccaggctgaattgtaatggcgtgatctctgctcactgcaacctccagctcctgggtccaagcgattctccttccttggcttcccaagcagctgggattacaggcgcccaccaccacgcctggcaatttttttgtattttttagtagagacagggtttcatcatgttggccaggttggtctcaaactcctgacctcaggtgatctgcctgcctcagcctcccaaagctctgggattacaggtgtgagctaccgtgactggccgctaattacccattatatttgaaatgtcttaattaaatgatttgacaacattactagtgtcagaactcatatataggttttcccctaaaaaatatgtacatgcttttaaaagagtttgtgtgtacattttttaacatttaactatgcaaatgaagtttacatcagctacagtagcttgagtgtgagaagtctgtggatggttgcatagtgctaaagatgtttaaaatttttgttagaatatttttacaatttttgagtattgaaattataaataacacagaaataatttatcttggatagaaaaaagcagcaattcttttggatggaaatattgacacatagctgaaaacatgtacttgagttaacagtcttggttgtcctccataaattcagcccctaaacctcctgagcctcagttcttaaatccattttccatgattacaatcactggcttagtacccttggtagatttaataataccatatataaatatattagaatcaaatggtcttgcctccatagacaaagcaattatagataatactgtataaagatgaaattaaaaataaaatagccctaccaaactgtatacatacatgcatatgcacatgcttacatacatatatttattcatgtactctggagatcaattaaaatgaaaatacagtggaataagggtcagaaaatgctggactgcagggtcttgtgtgcttgggctttgtattatgtaagttaagtgacatttacatgcccacagaacattaaaaaaaaaaagctagaagaaaatttatcattttctgtgcctatgtaagttaactgacatttacaagcccccagaatataaagaaataaatctagaaaaaaattattactttctgtgcctacttctcacatgaaagtctgtattgagagaaacaacagaaatcagacatagccccgaaaccaggatgagtgatcagaaagctattggtttagtgacatctcccaaattgctatatgacaaaaagcaagggcacagaaacagatttttcaaaaaaagagagagagaaagagatgcatgttgttgttcatgataagcctgagaaccaaaaatttaaaagatagtgaatgaattgagaaagaaatcagaaaaatgaatttgctctgactaatgaaaaatgcataaattatgacaaaaatgcttttgttacttcaaaatacagaaataaattaataacatatttacaaaaaagataaaaaaattggttagacaaaatgaggcaacagtaaaagaaatatgtataaaaaattagaaaattcatgtcaaaataaaattatagttttgacatatatagagaactatatagatccacatagagatatgtagaaatttaatgatatatatgtagctatatatatgttcagaaattttaattttaattatatgtatgcacacatatgtatatatagcacatatatgcaattatagctattgaacaactaggaactacataaaattgtataaatatttagtacaattgaaatctatagttgggaaagaatctgtagttaggtagaaaagaagtgggatcagatagaaagcaaagactgtaactgtaatgtcttatatcttaaaaagagatcagaaacaaatgtggcataataatgtgtttcaaatctaagtggtaatgttttcttttaatttctacatgagggacagagttcactaaaacaagtttagcatgtttccaggcacaaaattggagctcatgtattcattcaaccaacgtgcatgtaaacactattcctgtaggtttctgtggcaagtgatgatctcatcacaggtgtggtcaggctatttcttgttctcaaagacatcttgcacacactgaaatggagcaaagaataaacatgctgctcaaccagcatataagagatgtgtctgtcctggaatggggaattaggactagttcctaaagatggagatacgtaacttgacaactgaatgatgaatgaagcttaacaagaaaagagggaatggctaaaatttataggcaagaagtttagcaagcctaaaggccctaagatatgaggaagagtagcagagtgagcttaaggaactggctaaagttccatataaagtcaacataggtattgaaagtggaaattaaagttagagttgtctggagaggcaatctatagccagcttgatttcttaggctgtgagaagtcaatctcagtttttgtttctttaaaaaatcaatcataatttcaatggaagatagcgaaactaactttttaacatgagtgatgtagtacgatttctaaaggaatattttggctgatatgtagataatggattgtgagcaaggaagtgcagtggtatcaatcatctttaattgtaactattgtaaaataccttaagactacggaacagtttccctttgtgagcaataataccaggacttcttcagatcttcaattcttctcctcaggatgttcatgctagggcacaatttctcatgaaactcttgcatttcttcatgtcttgcgagcagaggcattaattttttattttcttccagactgtctcttctgcagtgtttgtataccaatcagccttggaagatacagtgtcttccttaggttgaaaagacgtatttatttgatgtatagtattaataaggataatgatactctctgatacagagattgggcatgttttcttacaatttattatcaaagatccaggctccctaaatttaagattccttagttgaggtacaaacccactgtgtgctgcacaccacctggggcctccacatcactcctcttcaccttaaggtataaggaaacaaatctgaagaagaacttatgctccttgctgtgatgtaagtaaaaaatcctttgtctttgactcaggaggcttgtgttttcttccagcatctataacactgtgtcaggctaactgactagcatgtaagtaggtacaatctcagctcacaccctttacatttcttgacactttatggaagtaactcctacgagcaactattgtaaaaacacctatgttcttattataacttcttaatgcatgcattctgagttcataccagagaatactttagcagtgtttatgcctagaattacataaggtagctaatttcctcacaccaagaagatcttcgcccatctatactctgatgaaattctcctatttaatatctaaatctgctttgctaaataactaaatgtaacacaatgttccatggttttgtcggatctttcccattcccatgggatctttcctgacatatgttctaaccctcttgaatttggaatctgatgattcacctgaacgttgcagaacaaatgtcttctttaatgttccatcatgtttatttttaaagtttctttattttggacctaggttttattactgtgacatgtgctgggaatatattggtggaaatactagcatggagctaatgaactgcttaaggaagcaacagtcctataagaacaaatacatccattcaaagaaaatgtggtctatacacatacagctttggttgatatccatttgattattttatagacatgtaaatcactagtgaaattctttatttttaacattttctttagcattttattcttaatgattttacaatcattgtcagccttttctaatatctagaacaaatgccagttttttgtttgtttgcctttttttttgtcctggtgggggtaggggaaagtggagacaggactggaacacatggtcttatttcttgatatatagagaattttttattgaatgtcacatgttttgtgctgctatagtggaatacctgagactgagaatttgtatagaagaaaaatttatttctcacagttgtggaagctgggaactctaagatcatttgttgtctgtaagggcctgggctctgcttccaagatgacacctttggacagaaggaacacttttctttatgtggcaggacagtggaagagaaaaaaatctcactcctgaaagcctttttttttttttttttttttgagatggagtctcactctgttgcctaagctggaatgcagtggtgcaatctcagctcactgaaacctccgcctctcaggttcaagcgattctcctaactcagcctcccgagtatctgggactacaggcactttccaccacacctggctaatttttgtatttttagtggagacagggtttaccatgttggccagactggtcttgaactcttgacctcaagtgatccacccgccttggcctcccaaaatcctggaattacaggtgtgagtcaatgtgcccggcctgaaagccctttttactgtggcattaattccttcatgggactggagctctcaagacctaaacaccacccattaggccccacctcccaacattattgtgtcggtgactaagattccaacacatgaatttgggacgggacaaaaacattcaagctatagcactaacagaagatcaaatgataatatatttcccaagagagtattcaccatttctctggtaagcaattagagaggattgtagtcactttaatccactcagagtctgaactgagtcacagctgatttgcagttttgtttagtttcagtttgtctctgatttgtctgtttttagaagatgaccctctagggctctagactgagagcctccttgtgcactcacagtggcctttagctttaatcactgttcaacaccaagatataacaaaaaagcttttcttttgtcttccagggcttttcagcttagaggtttagcattctgttaaacttccaatttaactttcaatctaaattttgaatgtaacaaatgtctttagggaaaatcagccatgtccctcaatttccaatttaattgtagatccaggaaacttccaaaaactcccctcatttctctgtccccagcttagaatcccagcctcttcttagttcctaatataagtaaatacctatagaagaaaggctgttttgcaaccaacggtttgcttcttctctagaatattaactcctctatttatctcacttcagcagttttctgctgcccataagtggagatattcttttctttctttctttctttttttttttttttttttttttttgagacagtttcactctttttgcccaggctgtagtgcaatggcgggatctcggctttcggcaacctcagcctcctgggttcaagccgagtagctgggattacaggcatgtgccaccacgcccggctaattttgtatttttagtagagacggggtttctccatgttgatcaggctggtctcaatctcccgacctcaggtgatctgcccatctcggcctcccaaagtgctgggattacaggtgtgaaccacagctcccggctgagattttattgatattttaagcttctctctttgtttttagtgggagaatttgtcgatcaaaaactgcgtattttacctagacctacattttataaatgaagaaccatttgtttgagaaaagtttcattaagtaattgggacataaatggagtttcagagaaaggatgccgttcaatgatagtctaattatcatgaagatgattgctgcctggatattcctttgaatgctacagatatttgctctttcaaatttaattaaattgggttagaaccccatctcatgtacctagcaaatccaagtttctctccaaaatctctgaggattagtcaccatttcaaccaatattccctgtttctcaggcacttgttgcctctattacttttacatgcctgctacatatccttcccaaagaattcttcccaaagaattatgttctcacagtacgaactgttaatgaaagtttgagtgtacagactgcagggaaaggaaaggccagcttagtagccatctgaaaagggatatcaggtgacagaaattatagcctaagaatcgatttccaactcattctcttttccaaatcttaactgggataacatggacagctaaataaacttgacctatggatggatcccaaaagtcacctccaaggcagagagactttgagatttacaggaagatatttagatgctgactcaattctacctacgatcccttactatgttggaggaatctctgggaatcagagctcaaaacacctttcttagagaaagatcagaggacatggcaggggtcaagttagttcaaggacagaggcagttattatgaattaggacatattgaacgtgattatatatctaagtgagactttttgagctaacatgaaaatttaaaaaatctggtaagatgatacaattcaaatggaaactattaaaaactgcatcagtgagcagaaagttcaaaaggggaaacaaatagaatgtttcggagttagactctagaaacagcttgctgctgtttgaagcctggcttctctagtaattataggtgaaactatggccacttccttatgtttacgggatctctgttttctcttttgtaaaatggagacatataggcaattattattttatcagtgtacatagagatgaaacaataaagaatttgaaaacacacatgcaatgtaatgagtcataataggcacattgaagataactaaaacataaataaatcgatggaaaaacaataatggaataactaaagaaattatcctgagtgaagaaaaatatagatttaagagtggaaatcttctaacttgacagatgatgaaataatgttacaaatttccacacagtgaatttaaattgtaaaagtagtagatagtgtcaaaatactcatttgtaaaattagaagtgaacagccagttgatcttcttttagtgatatttgaaagaaagaactacaataaaagaatccttttctaagataacactcatgagacaagtaagcaatggtatttcaaaatactgaatgttacagaaaacaacaactgtattatttataataaaattcatttggcaaaaagttacaataagggatttttcaatattgactatgtaactgttggagctattattgccaaatgaaaataagatgaaataagaataaacatttttcaaaggtgaagtgtaaaataaactttctctaaactaatgtgattaaacatttaccagaaacaatgaagtgttgaatataatcacatataaaaacaatgataaattgattgaaaatataggatttcttatgaaatgtctattaaatacactttgcatattgtcaatatgaatatattcacttattggacctaattcaaaatgaagacaaacgctttacacacacacacacacacacacacacacacaccccaattccctcgggctgacattttaagctatctgtccagcatgtaccactctagcctcacatcaaattattatttatcatcacccttccttatgttccttggaaagaacgcctttcttcttaagagaaattctgtagacagttcttaacattgtttttcttctgctagttaatttttccagtgttatgtactgtctgctgggtatacagcagttatttaaactgttctgattcaaggaattcaaagacacaggtcctgctttcaaggggcttgctgtctagttggggaaatgaggatgatatgaaatgtaattatgtaatttgcagttgatggaggtgaaatgtgagctactttagagagatcactacaaattgtattgttaaaagtggtagaacatggtttgactttaaggatagaggctgttccaccagggagagtgactcagagattacttttcagtaagtagtagattaaaacaacatagagatgacagaatgcagcgtcaattacttggttggaaaaatctagagagggaaatgtagcaaagaagagactcaatggcattttaattcactcatgagaacatactaatgactaagcactgtgccttattctgtactccagtataagatactctgacattcattctttagttgctttagtaccaaattgtggtggctagaaaaaattgtgccaagaaatcctccgtatttatctggaaagttatttctcccaatttattaaatatttaacattgattcagagaataaccaagtgaagggtttttcttttataatatatattgtaaaatacataattttgcttaatattgaccttatttttatcgttaattaatatgttggtaataacataactttatttaaaatttaaaaaccagagttcaaagatgatttttaagttagagcatttaaagttgtattttctaaaacaacaaaaaagtatgaaatgttttctgattaaaatgtagtttttttcttactttaagttgtgatgtcaacttttaattttaacatcaaataatttcattgtataattttaactgcttaacttcacatctatagtgaataaactatggccatattattactaaatttatgaatataggcttgagccagacttccaggaatataataaccatgttcattcatttgtaatatgcaagtgcaacctaatcccccaatatgaaatcattagtctacaaagataaatccattctgtttcaagatcttcctgctgtttcttgagggaatgtgctttatttgatgtaaagagatttgccaacctaattctccggcttaattctaactgtaaggtacatttgtaaatcttacagattttattagggcaaaagattattagtaattgtgtgtgcatttctatctctgtttacagggttctaaatcacatttaatttgtcttttacatttgaaaatgcttatttttttttgatgatttgctatcaggaatatctactactcacatcggtttttattatgttctctttttttgtatgtgttttccattctcatagatacttgaattctttaaaaataaatgagtcaacataacacattatttctaagacaagaaaaaatgcactggaaattaatttttttaatcctatgaaacaagatttcttggagtgtcattattactttgttggtggcattctgaagatttactgttttctttggctttattacttgtttttttttgcagcattcattctcctaaaaatgatcataacatttataagttgctttataatttttaacaaaacacttaaaaggaaacaggaaaactttttttcttgtggctatttggggttggcgaaagaagatataactttaagctgatattgcatagaagttacaataagggatattttcagtgttgactatgtaactgttagaaagaagtcttttggagtcttttcaaatttcacactccattggtagggaaatgcaggtatgtagtttgatacacattggaaatcaagggaatttttaaatgtttatcttgtatttctttggcattgccagatttgtagcagtcaacattcccgtagtttatttttgtccttcaaacaagaactcacagctggtgttgtaatatgcttaatttctctacagagtataaccatttaaaattttgtttttatccacagggtttcaagagaccatttagtgattcctcacattcctaaacaaaataacacacatataatccaccctaagttgcaaatcaagcctcatatatcctctaatggatgtggctgtaactgtgtcctgctgagtcagttatctaaggtcagggacgaggttggaacacatggattttattctacagtggctctcctttctcctatcagtcaaatactaacatttatccagatgcaccttgagagaattacaccatcctttacctgaatgcagacactcaagcttgactagtgagaaattaaagagcatgtatacaatcttgaccctaaaatgtaaaagattgtggattaactgtagtgatccattttagtggctctattgctttaggtagaaagatatgcttttgttctctctctggttatttcaaactctattaattgttgttttatatatatatgtaaaacatagaaacattgattgttgttttacctatatataaaattatttttccccttatggatttgccagcccacaccacctctcacctttttactcctactcacaaatgaaagaaaactgactcatattcactaagcaaaaaaatagaagtagaaaaacaaaacaaaaacattgctaattttggctgggcgcagtggcccacacctgtaatcccagcactttgggaggctgaggtgtgcagatcatgaggtccagagattgagatcatcctggccaacatggtgaaaccctgtctctactaaaaatataaaaattagctgggtgtggtggtgcacgcctgtagtcccagctacttgggaggctgaggcaggagaatcacttgaacccgcgaggtgaaggttgcagtaagccaagatcgcaccactgcactccagtgccccagcctggtgacagagcaagactctgtctcaaaaaaaaaaaaaaaaaaaaaaaaaaaaaacagatttttatatatgtgatatatcatatataaaaaaaactaattttatcattgcatgtcacttgctttccttttgtgaaaaagtaggttccattcttctgctttaattctttccttactaagaaccacatggtgctacaggagtcacctgctccaccatgtacattaatgcaggtgaagaaaaactattttaaaaatagaattatacattcacttgttaaaactctctaaggatttatgcttacaatttttttttagtgtttataaatctagtgactccaaacatagtttttttttctgttttaactcattcattctctactaaaaaaatactgtttataaaaggtttgtgataaataacgggtagaagttttctcttggagttcagactcctatatttgttttaaaaaaacagctgttcttatctctacttctgcagttattatattatagttgtatgtttatgaattattttacattttggcttggactttattttaaaagctcactttttcttcatttccctcctctttaaattaacacttcaacaaatttgtgtgttattcataagcacatttcctgatattcttcaagaatcacatagttgtttcatgtgtatttgtgcttattttgtaaagcccgaaatacagtcttgaatatacagatgtaatggcaaagaaagattgaacaatttaaaatacttttttttaaaaatcttggtaatagatggcagcttctttgcagaaaaagatgttttcgtgacgagagtggaaaaacagctcagaagaaaaaggacaaaagaaacttagaagagctactgtgtagcatctgataaaagaacaaatattggccaggcgcggtggctcacacctgtaatcccagcactatgggaggccaaggggggcagatcacaaggtcaggagtttgagaccagcctggccaacatggtgaaaccctgtctctactaaaaatacaaaacattagccaggtgtggtggcgggcgcctgtagtcccagctactttggaggctgaggcaggagaatcgcttgaacccgggaggtggaggttgcagtgagccaagattgcaccactgcactccagcctgggcgacagagagagactcagtctcaaaaaaaaaaaaaaagaaaaaaaaaagaacaaacactaacagattgattactaatctcctcggagattataaaataagtacatttattttaaatttttctatatactaggtggaatcagttaagatggttataatttgtatcagcattatttgtgaatccaaagcagaaatagacaatggacactgtatttatccaggattttaagattatcaagtaggaaggagtgtggcagatggtcaaagggatgacattccagggtgcagatcagaacataatgacatattggatcatgcatttgtagtttggcagaaagacaagtaaggccacaaggatgtttgcaaactgagatgaacaagcagaatccagagtccgaaaatggagattaagccactgtaagattcaaagaaagggaagtcagagaatacgaagaaataaaccttcgttaaagagcataaagagaacatgctgctgaagtgttacaagatatattagttcattttgctttcaatttcttcctccatgtcaatataataaaattgtaacagaagacaagttcctgctgagtgtagttcaaatcattattaatcaagtaccgattatggaaagggagctttgagggaatgcaaaacaccattgtttgatgcatgcactctgataatggttaaattatgaatagattctatttctgccgcaagactgaaaaaaactcagagacaatatgaaaccatgcctattgatttgtctggtggaagttgagccgtatttcctagctttctcttcatacacattaaaaaattttttggtctaattagagatccacatctgaggatttcaaatgtttctgctgttctgatagatttggaaatattactttaatggtctggcaggctatgcttgaaataaaatatatctttgcctgcattatcagaaaagaaatttgctgatataactgagagtaggtgtctgataatttcagtttcaaaaaacacatactttttaatattttctaagctataaggtaattttggactaaaaaataggatttatttttgccccaaaacctattttaaagacatgccttattttaaattgaactgtattatagtttgctacagtggcacataaattaaagtctatcctgcaaggtctttcaaactattgaacaaaaaaatgagacatataatagtagctcaagaaaactacatctgatctccagaagcatgtgacttgtattctactaatgtattctgtggcctgtagaaatacagaagttgaatgcataactacctaacaatatattttatgacaaatatttttgtgaaatagccccacaacatttttaccaattgtaaacatctttggaatatttattgctagaaagatggataaattatatttattattatgattgcttttcaaataaatgaaatttcaattatttcacagttatcacagggtattattagagtgtaggcataagcctgatattatatatgcatgtgaaaacctccctgcttcatcctatttgtgtccatattctttttgaacaagaaatgggatcacataacaaaataaataatgcattgtcatctatttttaaatattaaaatacatgcaacactatttctgcattaaactaagggtatggtttatggaaatactaggaacatattggttataatgaaaaagataaaaagttttccaaaattttctggacattttcaggggcccttttgtcaacaaaattcatatatgacatgtaaacattctgttaattcttcatgtgaaatattttccaaactattttttaaggtctcaaagtcttctaaacacatattattggtttaaaattttacttttaatgcagtgaacccaaaactatgcccagtactccagtgcagccatcctttcaataaagagaagcagaaatttcttatctttattgaatgctctcagattgtttagcttgtttgacagctctgtagacttatggctatatgtctatatttgtctatctaatctatctatcatttacctatgtacctatttacctacctttcaatcatctatctatattttaaaataaagctgctattcaagatcctccctatgtgatactttccaaagtctagcctctaatatgcatctttatttcctgtcttattgttaaatttctttgttctggctatacaaaatctcctcgaatcttaatctaatacattagctttactagcttggcttccaagtgttctataatctgctgtcttcatccaagctatagagagttagaattaagaacccagctatggtgcacattattagagattgacattgacaattagtacttctcatccacagatgttctatcatgctatgttttctctttattcagcctatattaatttttcttattcatttggatgccatttgagactttctataatatcttatttatttatttatttatttagagacagagtctcactgctgacagcctaggctggcatgcaatggcgtgatctcggctctctgcaacctctgcctcccgagttccagcaattctcctgcctcagcctcccaagtagctgagattataggcgcccgccaccacacccagctaatttttgtatattttagtagagacggggtttcaccatgttggccaggctggtcttgaactcctgacctcagttgatccacccgccttggcctcccaaagcgttgggattacaggtgtgatccactgcgcctggccctcatttattttttaaccattgtatatcgcattagagatttgttatgggtcttgtcgcctaattttgcaatttcagcaagacgtattttattgtgtctgatatatacacatatatatgtacatgtgggaattggtgtgtatggtgtgttgtgtttgtgtgtatgtgtatatatgtatgtgtgtatatatatatttctatataatacatatctatataatatatatatatttcttcttcctttcatattcttcctcagtgttcaaaattttatttttcaagttcagtgagccttctgccaagtacattttgtactgttccggtgaggtacagaatatgccttgtcaagagttcattattctgctgtgctaagcctttctaggtgggaagctcttgcctcctgaatcatcctttcttttcaaaagtcaaaactttaacgggaaaaacaggaatgaacatctttatgtccttatgtcttagagatttctatttcaggacttaaaatgcactagaaacatattctggtatttgtcttatttctgattgcatttccaatagttttcctgaaaatagcatgcttcaagattattaatatgagacgtatgctaggcctgagccatgaaagagccgccatctacactgcatgttctgtcatttcacatgttattattcgtgtttcctgagattcagggaccagtgtctcacatctctttttcagaggagcagctgtaagattgtcaaacatgtttgtgcccgtgaatacttatttcacacatttcccatagactaaagacttctgttcattgtgatgcaacatcctacagctgatagatctgcttccacaaaagtcaggttttctgggagagtaaacatgactgataaattattatataatacacgtgatgtcatttctccacttctttctctatcctataacatgtttaaaaatagacagctggccaggcgcagtggctcacgcctgtaatcccagcactttgggaggccgaggcgggtggatcgtgaggtcaggagatcgagaccatcctggctaacacggtgaaaccccgtctctactaaaaatacaaaaaattagccaggcatgttggcaggcgcctgtagtcccagctactctggaggctgaggcaggagaatggcatgaactcgggaggctgagcttgcagtgagccgaggtggcgccactgcactccagcctgggcaacagagcgagacgccatctaaaaaaaaaaaaaaaagaatagacagctgatgtagtttttaaaaattcttctttcactaggtaagaaaattttcttcaatttctcattagattatttatttctgattttcagtaactcaatcatatatgtatgtatgtgcatattttcttgtgttttattatatgtagtacattgaatattttaaaaattagcttttttattatgttaatttagcaatgtacaataaataatatcattttaggatattgcactgtgactgttataaacatacctacataaaatacaatttctattttcagaataaaagacattgttaagagaaaaagaggccctaattgtaattgtctaatgacccacttactttttagtgcaaaataattaactcatagatgtagctgcctattgagttccctggagttgaattggcatttggagcgcaggtgttagtggagtatgccattgggatcaacatctgtagatcacaggagaaggaagaacgacagcgtagagtgacagatggagctgacattcactcttaatgtctcttaatggctgaccctatggaaaagctctggagctaaagttgtccatcagtattgtcagtagtgcaggaagggggatggcccaacgtttgtaacctttcagcagtgagtcgttagttatatgctattccagaagtgtgacctgggggcaggtggcaatctatagctacggcaacaggaaattttatgaagggatctgaacagtacatccaagtatggaccatgtgggttttcagctatgcattcagggacgaggaataacagtacaatgaaacatatattatgcgcactgcggacatcaataccatttggcagtgaattgtagatgaggcaatgtgacattgtggtgttgagcagggttctagaatagaggttttatccttatcatttactagctttgtgattttgggcaactaacactctgggactagggttatttacttttaaattagtatttataacaaaaattattttcagctatgaattaaagaatttagcatcctgtccctcataaagttttatagattgaacacaatatatcatgcaggcatttattatagtacattgcatttaataaacacatttttaaaaatatgattagctattttattcatcattaacttccccatggtcaaacaatacagcttcaaatcacagccaagtctaaaaagtttgttgcttgatctactgtctccatagaaatattatctaaaccagttattcttatacctgttttatgcatcaacttcacctcagtagtttgctaaaaatacagatttgtgctcctattacctatattcagagcctctaggtttggagaaaatctcattggctcacttcaaagtataggaccctaagtgtatgacttcaggccgtccgcatccctttaaatcttatagctattaggtccatgtccaaaatgttcattgcttcctcctgctttgtcttcccactattttctttcatctttagtgtggctgtattaatttttctaaataggtttctcagttggagaaccaatattagcttctctttaataattgccccttcgtgttcccttgtccatttcataaactgaaacaagaaagatacacatccccattttatccattaaaggaaatgtgaatcttgaatggcggcttgactaagtgtattttgttttgcttatgtctatcatagataacacagccagcattctgacaaggcggaggagatttagtcgaactgttcaggatgtgtattatctgcccattatgatctctgatggtggaatcccctctctcagcagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctgggtaagtcattctaaaccctaagtttgcatgatggcaattctgaatgagagggaatcattttgacaaatcttaaggattaggcatccataatgtgggtaaggaaacagctgctccaatttcctatgaattaattttctcaatactgtcattaatctcaaaatagttagattcaaatatgttggaagaactgaaataacagaagaaggataaaatcggaaagaaatagcttttgaaagtgtatattttggaaagaattaatattaaaatattcagaatcccaccgtgaaagagcttttaaaaatttttggcaagaatctaagcggcatcattctaaatgaatctgaccaagaccccagcccgcttagcttctgagatcagaggaggtcacccattcattcagcatgagggtgagggtcatatggccttagggtgagtaaatgtacaaaaaatgagagatcaaatatacaacaaaaggactttaattaataacaatattgtgttgtattggaaatttgcaaagacagtaaacttcaggtgctttttccccttcacgtgaaaaaagagtgtaactacgtgagatgacagaaacattaatttgcttgactacactaggcatttcactgtgtaataatagtgaaaactattattgggaaaacatcatcatgttgcacaccttaaatatataaatgaataaaccataaaacaaaacgaatctgaaaaccaaataaaaaatagataacttgtagaaacttctactagttcacaataattagttaatcattaatgttagctagttattaacatactgactaaatattttttggtcttagagggatattaaattttattgaatttaattatattcccttaaaaacaataatttttggccaggtgcggtggctcacgcctgtaatcccagcactttgggaggccgaggcgggcggatcacgaagtcaggagatcgagactatcctggctaacacagtgaaaccccgtttctactgaaaatacaaaaaaattagccaggggtggtggcaggcacctgtagtcccagctactcgggaggctgaggcaggagaatggcatgaacctgggaggcggagctggcagtgagctgagatcgcgccactgcactccagcctgggcaacaaagtgagactcagtctcaaaaaaaaaataataataaaataaaataaattttttatttgaaattttcattacagtttattaaaaaacacactttctctaattttacattatctgttgtaataatctaaatcttttcacagccgcatgaagagcttctataactataaactctttagaatgctctttgaaacaagatagcaaatctgtattgtaataacaagaaagatggatgtaaggaatctttctgcttcatcaagtggggacctgtgtccaaagtcttttttctttctcttagcagcctgttttttattccttttatggtactgacatacatgaaaagataattgactgtttttctgagaaagaggtattcttgaaaaaatatgttccttgttttgttcctggggttgaagacaaataacttgtatagatggagtggatattaaagtgtaatgagcttggaaaggagaagggatttgtaggaaagggtgagagcatccagagacttgtgggagatggcaaagctggtgagttttgttttaggagtgtaaagaaaggtttaaagctagagagtcccattataaaatcttcaatttgcaaaagatgactgtgaatgaaatggagaatagaactcctggtgacaagagggcatgtagggaaaccagttaggaaaagtctgcccttgtctcccttcgacacagtacgtgttagagtagcatacttataacagacctgaggaaaagtgaataatatctaggtactttcaatggactcagaaaaatgatctttgataatgtagatacctgcatgagttagaatggcctcaaatataacttcttatatgttgctgaatgtagatcctgaactaccctgagctagaggacactggaagtccacttcattcaagttgcccagcaagagaatatatgtagagagataatggactgggattacacagtgagaaactacaatgtgatcactaaataaggatgagatagcagaggacagtgaagaagtgagagtaggaagaaagtaaagtataatgtcacaaacgttgagggaaaagagggtatcaaggagcattatgctgtgtagtaaatcttgtcaacaaagtcaaaagatgcttacaagttcaataaattgagcaccaaaatgctcagttgtacttagcaacatgaaggatggaagtttggtgcaccagagcaagaactatttcactgcattccagtcatttctagctcgtcatggtggcatgcacctgtagttgaagctacttgagaggctgagatgagaggatcccttgagcctgggagttggaggctgcagtgagccatgatcacaccaccgcacttcagcctgggtgacagagtgagactctgtctcaaaaataaataaataaataaaaacaaataaatatgtacagtaaatgtatggtggagaggaaagtcaggaaaagagcctttagaaactttatatggccgggcgcggtggctcatgccataatcccagcactttgggaggctgaggtgggcgcatcacgaggtcaggggatcgagaccatcctggctaacacggtgaaaccctgtctctactaaaaacacaaaaaattagtcgggcttggtggcgggcgcctgtagtcccagctactcgggaggctgaggcaggagaatggcgtgagcccgggaggcggagcttgcagtggagctgagatggcgccactgcactccagcctggatgacagagtgagactccatctcaaataaataaataaataaataaataaataaataaataaataaaataaactttatatatttattggtcagaactgctgttttctttagatattaacatacttcttttttgtgtatatttgaaaagaagaagagcacaaacactccagaaagagaaaacaaggctgcacaacaattaccctggatctctctagagtcctaactgaagtcatagagaatagaacgcagggattttaatgagagttcttccagcgttcttactcttaaaagtcgatctcttaggtgaagcatgttatcttcaaattttgagcttgtttatcatcataaaactatttttgtttactaagataaatatcaaaaatgtaattaatgtgttaaatgtctaggtacatgttgaggtgcattattgaaagaacattttatgttttcatggaatgatacttcattttaattggtttttatgaaaatgttttctcatttggggtaagtaatagaacatttgtaaattttattatatccctcaagactaataaagttactatatgatatgtttactttttcatttttattagttgaaactcaaatatgctgtaaaagcatatttgagccgtgatctgactgggacctctgccagctcccctttcagtccatacctcacatataagcaggtgacctaggtgaggccaccgtaagtgaggcatggactgctccttatcctagatataaatttccggataaatggggatcgaagtgggtttggtgtgaacacgtggtggacaaagagaagaagatggaattggtgagaagatgctctaaaagcatatttaagtttcaactaataaaattagtgaaaatatataactacaattatatattataatgcaatatttgcttttcatggcattgattcgtttttattgttattcagaaagtatctagccaagggatacaggatatagccatctgtaattttaaaataatgttgaagttaatttatgagattatgattttcggcataaatatcgacaaaaccaaatgtagcaaaactttatttttgaactcgtaattctgaaataacgttcaaccctcgcagctaaacaaattgtaaaattaatattttaatattaaaaaattttccctctcagcttcttgtttgtgaaaatggctatgattgtacaaacccagctctagttttgccaataactgtgtgatctaaagccacacattcagtttttcttgtttctatttctaaacctgtgagaatgacatttcagttgaaaggaccttagagtcattctgtagaattttgaaatgcttattcttgttttattaaagattgcatatggttcaacattttacaacatggtcggaatccatctatgtatacgttgaatggtgcttgtcaaccaaagaggctaactttaaatgatagatataaacattatgagctgagttactgtctgttgaggttacctttttcaggtctattgcatatgatggatggaagagaatttagagtgagcctttatgatgcaatcagaatttaccatgacagtagaggtagctgaaatcctctctccctcccagaggcctgacttttatttcccaactttaccccatctcttgccagagggactagagtagttggcaaggcaaatcttgatcacactaggcataagtcattgagtcgggatctgactgggacctcttccagctaccctttcagtccacagcttacatataagcaggtaacctaggtgaggccaccataagtgagacatggattgctccctaatattggatataaatttcctgataaatgaggatcagaatggagttggtgtgaacacgtggtgaactaagagaagaagatggaattggtgaggagataaaggtcagcctgcttttcatttgagctatttcaaatggttttgtgtgctacccttggtttaaaaatctaaggtttcagagagagatgccactcccaagtgtggcaagtcacactccgtaagtcaataaaaataacctccctgactcaggccacctcaattctaccaaattcagtgccaacatatgatggtatgacaaagaatcaagtggtatttgaggtttaaaaaattctgctatgcaagctacttagggaggagtatgttgagattcagtatggaatgggttcaaattcaagttgtatgatagtttatattatgggaactgaaagccacttagtatgccaagcactggaatgatacataatatataggaaaaaatacatattatgagaaaacaaatacaaaaaatgtttccccatctttgaattacttgatgataaaattaattcataaaactccacaaatttattctaatttataatataaaatgataatctcacgggcatttaaaattctgcccaaacttgaacagaagaaaaagaaattcactaaccaaggataaaatatttattttagactaaagacatgtaaaaaattctacagcttattcaagtttcaatccagttggcttcaaattatatcataaattatttattattttgtacaaagaaaaacaagttctatatcttttcttttttttgtaacaccaccttggttctctcatattgtattttaccagatgactcactgtaagaagaggtaccttgccaatgtgtatgctttgataggttatcagggtcatttgaatacattcttttgactgtcagtttttaaataaggatttgactctatttatatgtataattattatctgcactcattcttttaaaatatactttggtcttaggattttttttggaaacatttcatttgtttttcaaacattaagaaatattctccagtacaattaggagtttgatgttattagtaaccataagctaatttttaaaaaatatcttaaaattattttcctagtgaggctattactgttcagggtaattcacttaacacaatgtcacattaccattttcacagagattttttttttgtttgtccacatgataattgtttatggagtatctacctggtgccatctgctccagaaatatctgtggaaccaacaggaatgaaaataagttcatcaggaacacaatgtacaacatttttctgagttgatttgaatttatctttaactagagggatcctatgtctgcatttgccctgatgtcctgacataattatgaacaacatcccctttcactcaaaaatgtctcagattttgattttatacatatatatatataaatatatatatatatctccttttattaaataagtatgtaacaagcctaggaatcactgaatactagcaaataatatccagaaaggtagcaaatactaccttttctggggaaaaggtagatgtaaaccttcaacgttcaaatgtaaatggtctctatattttgaatcataatatatctgaattattttcttaacttttgagaaatagaaactatatgccatgataattaaaaagccaggattatccctgtatttcattaagtgaatatgatacatatgcaaagattgaaaaattgcacaaatattgaaggatgcaaattacctccatacctctatggcagtattgattacatattccctgttgtgtctgcacataaattcccttgacatcaaccaccaaccaattcaatataaaagaaaataacttgatttattggtgaaggtaagaaattgtattataataaattaggcagtctttataaataggtctttcgatctagaacagcctcctcatttaattataaagatgaacagagatatatatcgtgcatgataaatctaaacttctgaatacagtggagtgaattacttgaggatgttgtttggagctttgaattagaaaactgtaaggtggatttatgctaaaatacacaggcagttattaaatgcatatttcctatgttcagcaaaagccttttttaccccaaaataaaggcatatattaagcaatgtctttgacatataggcaacgtatatgggaaaatctgtaattctgtgcataatatttgtagatcagggcatgtgtagcaccaacatttcattttcagctttctgtaaccacttcattttaaacagtagtaattcaatgcttcccatgtctgctgtagtgaccctcattgaattttctcattaccttcccaatgctaatatcttttcatttcacacgtttctggatggttctatgactttctctacagatgtttttttcctgtctttttggttccttcatagtctcccatttgcctttcctctgcaaaactgggtacctcccagtgcacagtgaccatccctttctctcactttcctttccatctctggctttaaaatctactcctcttccacaagttttctctagttttaaaacagataaaactagtccatatagattagagttatacattaaaatggttaagctataaagaagaacaaagtaaccataatgataaaagtgaagataaaagttactttgcagaggtaagcagtaaaagggcagtttctggggggaaagtatgttctttatcagagttagataacctggtgtttgattcacaaccattcattcaagttcacttataatcaaggttgccagacacaatgcagtatacccagataaatgtgaatttcagataaataagaaatatatctatatctgtatataggtatgtatgtgtatatataacataaatatgtcacaaggaataatataataatatttggaacatatgcatgtatgcttagcacaatatttgcctgtgtgtatctcaaatattatatgggacacacttaataccttatgtgtatgtgtgtgtgtatgtgtgtgtgtgtgtgtgtgttgcagatggtctccaaccaacaatagtttgacttaagattttttgacttaacaaggatgtgaaagcaatatgcattcagtagaaaccatattttgaattctgattcaaaattctttatatctttattataaaatacgttttgtgttagataagtttggcaaactgtaggctaatgtgttctgagcacatttaaggtaggctaggctaagctataatgtttactaaattatgtgtatcaaatgcatttttgatttaagatattttcaacttcaaatgggtttataagaatgtaagcttactgtaggttgagaagcatgtgtgtgtgtgtgtgtgtgtgtgtgctgttattgatctcaaattcacgtttaattgagaatcctgccatttatttttgtttgctaaatataacaaccttaaatgtcaatcgaatgtacctccctgattattatgaagtaaagaatgttaaaaatattaatgggcatcattatcaccatcataaagcctagaatatcagctgagcaggaaaagagcagtctatagagctgaagtaaataatactcagcctagtaacacagcctataacaaatttgatgtgagggaactatttctatttagtaacagtttaatttcatcaaatagaaacagttgaaaatattgataaatggccaaagcaaagttcccaagacacatttctatcacatcttctaatgtttgcagcattattggaaataaagacaaatccaccatatttagcaagagctatcctaaggcacatgtccagttggacactcagtttattatttcatgtctttgaaatactgaagtagagtatttttatagtagaaatatcattacctgtgatgcgagaaatcacattatggtacaagctcttccacttgccatctgtgtgatcttatcttttgatcttggttatttagatactctttcctgagtctcagattcctcattctcatttatgcctagtgttccattattggaacattaagcttgtggaagttatttatgtcctactgctcaaggttatcgccaaagtctgatttttcacacacaaaaaattgcaacctcaggcataaatgggttaaaaatagagtaaagccacagctctgctgtgagaattaaataaataagttatataaagaacattcataaatcaaaaaattcctatgaaacaagttgtgtacaaataatgaaacattattttgtccctgaatgggaaaatgcaattattaatgcatgataatataattttaaaggataattgacaaaagagatcaacattaaaatatttctgctttgattttctacaaagcatcaaaatttaaagggtttaacgttaaggctccttcttccaatattccagaaacttaaaacatctttagtgtatctacctagaaggattaaatatctatagagagaccagctcactacattattttttgagttaaaatttcatattattttttcatcatgtgtttatctcactttaatcactaaatggttttactgaaatatgagccaagaaacctacatcttagcaaactgagagtattgtggttttctatagaagatcagcaattcgcaatgtctcctggggtaatcatcttttacattatttgaggcattacagtaccttgcggtgttattcagagagcacagagtgagttgtgctgcaatgccagcctaactctggaatgtggttaatgacgaatgggaaaatgggaaattgctgttgtaaaatctctaagaatttccttcctgttttcttaattcttcatcctttttccattcttcctcagcaattgtggtactttttatcaccctgaggcgcagcaaaaaagagcccttgatcatttcagaagaggatgtacgggagaacgtggtcacctatgatgatgaaggaggcggagaggaagacacagaggcctttgacatcacagccttgaggaatccttctgctgctgaggagctcaagtaccggagggatatcagacctgaagtgaagctcactcccagacaccagacatcatccaccctggaaagcatagatgttcaggaatttattaagcaaagactggcagaagcagacctagaccctagcgttcccccttatgactctcttcagacttatgcctatgagggtcagagatcagaagctgggtctatcagctcgctggattcagcaacgacacaatcagaccaggattatcactaccttggagactggggacccgagtttaaaaagttagctgaactctatggagaaatagaatctgaaagaacaacttagggggtcagttcttgcaaccttgtggaatttgcttcctgagtaagtggatatacaacctcagcaatgacaaggaagaagtgtggaaacagtacttggaactgaggaagctggacacagctcctgtagaaacaagtgcccttttcatgatcgaaactgggttatttaattggaagaaagtaaaaaaaaaaaaaaaaagacaatacaaagaaaaagttattgttccttgtgtatattttcaattgctcaataaagtctgtggtactgtttattaagaatacctgaattaagccaaacaatgatatttgtttcaatatattgtgatttatttttttcaaaagcaaaactaaacagaaaggctcaagatcactggtggttatgacttataggggtggtaacactaatacaggaaacttgtgaaggtaatcacaacctcttttatcacttttctgggtgaaaccttgagaaccacactctgttattataacagatctcattagccttgtcttgtgtttatattacatgaggtatttccactctatcatggacttgtatgtaccatttccctttgccctccccagttcttttctccatacaaaactgatggagcatggggatttgctgcctgcactataatgtatgcaacttcagtgcaccagttgtgtgctgtactgagcacgagactattgtctctatcccgtacacccccttttattttaatgggatactcctatttttaaatggacagaaagaatagtttaaggtatgttatgaaaatctgatatgtcagggaataatttaattttaaaaatagccacacaccttatcttctaccaaatgttggggaactttttttttccttttttccacttgttttattatatttaaatcagcaattttggtcatttctctatttaaaattaattgtcaaatattttgctggctggtttgtacttcagtctaattcacttattttcaacacgagcagtaattaaaaataagtacctcacacaataacaatgtagtctgaaagactatcctccaatgaacgtaaatgtcatagaatcatagttgacttacatttattccttacacagtttcagattttttccatctcactgataattagtttggtatcaacaggaaaatgtgtaggactaggagcaaaaaaggagattcacagttattatcctcagatatgtttccgaaagtctctgtgttcagggtccaaaccacaaagtagagatggcaatgacttccctgcccacctcacagggttgttgtgaggattaaatgagcatctgtaaaatgctttgccaactgcaaagtattcaattgcataaaagcttgcagacgcttatctaattttctagtttcattagcttataaatatatatttacatgcatctggcataaaatattatcacaggagaatttcatgaaatcttcaacagtgaagctactgtttaaatatatgtacacaattccaattattttaatattttcataagctaatttctgagaatttgggtggggctttttttttcaaattgttttagataatgttttgttgttgttgctattggccttgaagtaagaattcataccataatggtcctattttctaaaactggccacatctatatatttcagaaatattgaaattcttaaatacatgaaataggaattagttgacaccggagtttttcctttgctctttaaatttatcattatcagtgtccccaaaagttatatgacattttctgtctgtttctacccatgtgcaaaattttggattttacctctgtttgcaattgccctgtgctatcatattataatttgaggtatgggaagtaagtaagcttaatttgaataattctcaatttgtgttttaagcctgaggaataaaatgtaatttaagctttttacgacattttagttttccagatgctgctttatcctttttaatctcataatggtgtgtgttccagtgtgaggctgaatctgaagaggcactgaggggtgtggggagtaacctctggatatacatgctctgatgatgctacttctggattacattcaccctaaaagaagggtaaaatgtgggcaactattgtgggtacaggtgttttgacttttctctgcaaagagtatcaggaatgtcaggttttgaa

SEQ ID NO: 14144 - DNA, 61083 bp, Human
taaactcagtctaggcttacttgatagtacactaacattaaatgtctaggagtaaatatctaaaacaaactgtaagtcttctctatttaccatacaaattattcaagtgaactgccatttttgcctggcttgaaagatacttttcagaagaatgggctcatatacacatgcacgcgcgcacacacacacacacaatggaatactatttagccttaaaaacgcatatatatctaaaatatatgtgtgtacatattttatatatatatgtgtttatatatataatatatattatatttgtatacacacacacatatatgccacattttctttatccatttatcccttgatggacacttaggttgattccatatcttggcaattgtgaatagtgctgcaataaacatgaaagtacagacgtctcttcaacacactgatttcaaatcttcccagtaaatacccagaaatgagattgctggatcatatgataattctactttcagttttttgagaaacctccatacaattttccatcatgtttgtactaatttacattccaccaacagcatacaagcattcccttttctccattcttgccaacacttgttatcataaagggaggtttgagagaccataaaacaaaccccacctcacaattttgttagtgcaagttctatttggcctattcccaacactaagcacacagtaggtggcaaatatttgttgaatggatgaattctcatttttctccatttgtggaagcagacacctcctcaaaaaaaaaaaaaaatccgaaagaaaaggtaaaggaaacagttctatgaatgggggttaatttactctcctagcattcacttattgggaaaaaaagtaacagcagtttctagaaccctctggtctctgagggagatgctgtgttcccctcctcagagaagaagaaaacgcactagagagtgggagcatccccaaggctgaagcgcatccaggacatcacatgtcaacgtgtcctctctggcgtggggtccccgcgagtctgggaaacgaggagctggcaagggagggcaagcgggggcggcaaagagggcccctggagcagggggcgcggacctcgctgcgctgcgcgctctaccgccgggctcgcaacgctgggctcagcgctcgcgcctccctcagctctctcctccgccccccttcgccctccccctttccctccctttctcctcctcctcctgccgccgcggccgctgccggacttcgccagatcagacccacggggctgccctcccctgcgcactcccctcgctgcccgggcccggagcgcagcgcggccgcacaggtaggagcccccaacggggggtcgccccgagcgagcccagtactcactgggccgcgcgcgggagagtgaggtggggtgagctgaggggtgttgagtacccgagaactgccctggactgtgcagggtgtctcgggcagagagggaggtggaggtgtgcagcctcggaatgcgatctgtcagcaagtgcgagtactcgggtgacatctgttgggatgggcatgtgtgtgcgcgccgacaaccagccggcagggctttgcccataaacgtggttttgaaagtttaggggaccagtgtgcgagatttaagccgcacctggattccataggagctggttagaagctgggacgctgagcagctccaggggaccgccgcgttagcttgctgttaagaaaggggacctcatctccctgccgggccaggccgcccgcccgaaactggtaccttgggctgcggtgcgatccctggttccggtcctaggcagcctgaaaccgaaggtagcgtgtcggggacccagactgataagacaaaagagaatcagtcgctttgggctgcccctccacacaacctgggacttttaaacaaagctgtgcgcagagaaaggcgtggaaatgccactttgagagtttgtgctgggggatgtgagaagctctgagacatgtgagaaggtctagtattctactagaactggaagattgctctccgagttttgttttgttattttgtttaaaaaataaaaagcttgaggccaaggcaattcatattggctcacaggtatttttgctgtgctgtgcaaggaactctgctagctcaaggtgagtatactgggaaagccttaacgttctagagaacagagttttgcagccccacctccatcccccggggtgtgggactggggggcaggaaatgcaccgtcccctttgaaatggattactgttttttcctttcgaccccctctttctgcagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaaggttcaggagggggaggggagatgagaaagcagattggaagttgagtatggtggagcctcagcctctcccaccctcctttcctcgcttgtgctcactgctaaagttttgttactttccccgcagcagatactaaacattagtttgtcctgtattttctttgagattcacaatgttgaaagcccttttcctaactatgctgactctggcgctggtcaagtcacaggacaccgaagaaaccatcacgtacacggtaaggggtgatggaatttgaaataagtacggttcagcgggattctgtgacaaaaaaagactttacacacccctgccagtgtatttgggctatactctgctgagggtgataaattaaacaacacttcattcatgcttcatatctaagattcgttgtaaattgcccccttgatcctttcaaaagttcattgggctcaccacctaagataggaaccaacatgtaatcatttgtgcagggctaaaaatgggatccgttcaaaaactaaaaccaaagaaagttacatgtttccaaaacattcaacaaattaatgggtgtaaggaactggaaaacctggactcctaccacatgcagataaaaccaatacgtgcagaataagactcaagtcaagtaagaacgttaaacaccataaagacacatggccttctttgtgtacatgacatgcattctcaagtaagtggcctttattgaatttataaaggctatatattcattctttttgtataacttgataattctaataaataaaggcagacaacagtttatgtgttaccaggatgcatattggctaaagtggttttaaaacgtaatgtgtgcaactccgttttgcattttctaattagcgtctctgatatttccaagtaatatttgattagttagttgcataggtgtaaccaatgtttaataaaatattaaaaagatcacctgacccctcccactgctacaaatagttgtggtgagaacagagaaggacagtactgacttcacttctggtgagtttgtttgcacctctgttctgtgttttcttgtctttaatcagtgttaggcaaatgacatttgtcctggattggaatatgaaaagcacatttttctactgctcccagtttaaaattaagtaatcctactcgaaagaatgtgaaaaatttttgaaaagaaaactcttaaaaatgaactaatgtcaattactgataataaacattatctcactttttggtaccacattatccctagaatgttagtattcatctggcaaatgttcctttctgttgttcagatccactataaataaaatagcttaatacaaatattttgttaacttcatgttaaatgcagttgcttcctctgctgaagataaattaagcaagaaaaatgaaggcatgtgctgtttatcttaaaatgaaaatgttttgttattcagactaaacttactgccttctcagggagctaaaattaaattcactacccacttttataatcatctcataaaagattttacttcttttccagttgcttatcttctatgcccttccctttgctaatcacctaaatcttcctcatttttaccagagaaggttccctgtggcttaaacatgatagttttaagaccactaactagggttcattattattgtaacaaattttccagatatgttacccttttgtgctaagattgggcctattctcctttaaattttgtatgcctaataattcatggttaaaggacaagataataactatttctgagtatcccgctgtggagacacgatctcctttgatccttgcggcaatgtgtaaggtaagtggcatcatcttccttctactaatggtagaactgaagatcagagagagtgtctaacttgcttagggctacatagccaagtggtgaagctaaactcagtctaggcttacttaatagtacactgacattaaatgtctagaagtaaatacctaaaacaaattgcaagtcttctctatttaccatacaaattattcaagtgaactgccatttttgcctggcttgaaagatacttttcagaagaatgggctcgtatccacataatagcctcatagtcctcttccatattaaagatggtgtccattcagctgtttactcaacaactatctgcataagcaattctcatcactattaaaagaatttgtttgtttactaagaaaattcagtctcctcttggagaatttagcctgggaagacagtgttgaaaactacaaagttcctaagcaaggacaaatgatactattatacagattatacaaattgccaaggaaatagaaaagcaaggaggtgattaatgttggtgccagcatattagaggagacagaactctgtgctggttcttgaaggaagtgatgaccttggttggattgatctagaaaggctgaagaggcacctgagtcagagagtggcataatcaaaagctagagctgaaagcacctgagaccaatccaggtggtgataaggtcagatcagctggaactgggtagtgggaagaacccagagatggtgatgatgagagatctgcaggtcactgtgaggtctcagagagaggagcaacataaccaagagcacaagaaagatcatggggtctgtatgcagcatgtagagatgcggggccttgcctactcatgggccagcaaaagcctttcttagtagacatggtagaaatggacacaaagtcagcagagatggaaggaaaataagtggagcattcagcactgatgttaaagttggaatcctgggtttcgaaaaaggtagtggtacctttaacactgtttgggaaacaagaaaaaaattagtctgagagacaaagtgaatttagttctcgctccagtaagtttcagacatcagtaaaatatctaaatggatctctgggcttccattcagctatttccttgtcaagcatccattgtgtacataagcagctctcagttatattaaaagaatttaagtttatttgtttgtttactccacttttgctcaatccttccttgggcttcttccttacagtgactttctcaaatgagcgtctgatcagattgtttcctgagcttaaaaattcttcagaggcctcttatcgcctgtagcaacatttctcaagaagtagttcctagacaacctgtatgggaatcgcctgggatacttgctaagaatttagattccaggccccctacccagacctacagaatcaaatcctttgggtgggcccaggaatcttcattttaacaagaaccctgaatgatccttagacacaataaagcttgagattcactgaccttcagggtagaattcaggcttccattcctaaagaaaggctttcttgttttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaaggtgatccataggctgtttgttcagtgggtgaactagagaggagattgaagctgggaactgctaggaggaacacctctgttccttaggagctgaagctagggagcaggtcagggtgtgagatggaggtgcttgaatgctgtaagaggatttagagagagagagaagagtccagggctggttgggggtgggggcgggggagagggcgaggaaagagagagaatttggtcttttttttttttaacatttccaatgtgggaaaaaaggcaaattaataaagagcagtcagagaagttggagaagattagtctcaaaacagaaaagaagatggtactgggcaactgtaccaaaaagaacagaagagtttaggcagctgatggttgagaatggacccccgaagctgtccaatgcacagacttgtcttttgaaaaaaaagcgatagaatgttaaaccacccatctcatcatatatctaggactttagcacaaggattgttgccataagaatgaagcttttagagtgatttcttagggaatggacacaccaattaactgtctcctggccccacctttgatgttttcttcacagcaatgcactgacggatatgagtgggatcctgtgagacagcaatgcaaaggtgagccagcttcaaagacttccatgtgatcattgccttctgtctccatctcttgtgtcactcttcctgtcctgtctgtgttataccaaaaaggcatgagcattatatttacatgtttgatttttccctcttagaagattcctgacttattttattactgaccacagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaaggtaggaataacttattttcctaaccattgaaagcttttgcccaagtgcacctcgtggtgaggatgatgataatttattaaggacttctcgcgtgccagacatcatgctaagtgctttgtctgcattatatttaatcatcacaatattcctaaagggtagttgctgtagttgtcatcattgctttacaaatgggaaactgtggcttagaaagttcatcagtggttcccaaccctagctgcccatatttagagtcacttgggaacctttaaaacttctcgatggcgaagctacaccccagcccagttaaatcacagtctctgaggtgggttccaggcatcggcttttttttcagttcctcatgtgcggccaagtttgagaaccagaggtcacacaggtgctaagtgcagagctgaccttccaacccaggaaggcgggtgccaaagtcacagctggcaaaagtcaccatcaggttattcactgggaatttgaaattatgctgtcaagctactctacagatgtacccctttggtttctcaagtttcttttcatcgaacttgccacagacttattttcctcattcaggagtaaagaaatggggctcctgcttctcattaccttggagggattctcccccactcacgtttatatctcttttaagctctcatttgacgacgtttcacttatatcacttgcaccatggcatcatctgcctagggttttctgtttattttcacagagcatacacatcactgtgtattctagaaacagctgtaggctcgtattagcaaagtgataagaatctggggctttgaagacatgtaggatattagctaactgaactgtgctatgagattgtttccctttcttcttggcaaaccatttcagagcagcctggtgtggagactgtgttactgaaatggggccataggagcctccagactcctttctccctgccagaggctgattaggtagatcccatagtgcagaactccatgtcaccaccacatacgtgtatggcacacgtgggccaatggaaagggtccaggagttcttactttctaactggtcatgtgtaaggaagagagcaccttcctcccttaacaccaagggtttcaatagagaccactgagctgctacattaaatgaaagatgcattttcttgtgccctgggatgctgccccttattcacccgtgtttagttttatcttctgtgtaaaagatactcgagtttaaatggcttaaaaatgaagcaaggggctgggcacggtggctcacgcctgtaatcccagcactttgggaagatgaggcgggtggatcacctgaggtcgggagttcaagaccagcctggccaacatggcgaaaccccatctctactaaaaatacaaaaattctctatgaatggtggcacatgcctgtagtctcaaatactagagaggctgaagcaggagaattgcttgaacctgggaggtgaaggttgcagtgagccgagatcatgctactgcactccagcctgggcaacagagtgagactctgtctcaaaaaaaaaaaaaaaaaaaatgaaggaaacttgtcatgctctgactcttatttatttcatattttgtttgtaagctttaagtaccccacatcaagacctaacccatgttgtgatggtgtcacttttcagagggtgcatcgtattagcatctgtttcgtgttactgtcatgagtcagaattccagtattgatgatgaatgcttcagcatctgcttgatattctgatattgaatttaaggattatgtcaaggagataaaatgatgaggttattcttatacatgtatttgggttaatactgataaaaaaaatcttgagtttatttaagatagaccaacttttaattgtgttatttagttatataactagactggaaagtttggtagtatttttcccaaaatcaaaaaattttgctgaaaaattcttaagtatcaacttttatatactgaattattttgaatactttagatgtgtactttaatggtacttgggagaaaaaaaaaccagataaatgaatgagtcatttcccaaagtagtttgtagaccgtcattgacatttatggttgaattcaagaacaatgcccagaactaaatgaagaggtcctagaataaaatatattcaagacttacaacatgtattggttacggtagaaactgtactgtgattaatgaaaataaaatcctatttaacttttctagaaaatatttagactacctaacaaagtaagttacgtttcacatagtaaaacatttatagttctttcttctttgggaattttttttagttataagcagactattaagtgccttgcttatggaatatgctaaatacatacctgttgactgtgtgcacacaggttatttccaacccaaattgatctgtgtaattcagccagtttctaaaatttgggattggtgtctataccattgaaagcagggttaaaagttttttggaaggcttagggcttaagttggatttcttcccacctcacaattttgcaaagtgcccataaatgtggatttacttaattgttgataaaagggggttatttcatatgataacaacaggataatctgtctagggaatttgactaacataagtcgagtcacacttgtgcccatttcttattgagctaatcaaacatgcagtccagcttcttctaattgcctgcagatgtatgacattctcattccaggccagcagcacaaaataatattttataaccaatgtggaagtatggggacctctgtttagaacaataatgtgctctaaggacctatattattgacatcatcatggagtttgaagagtcttctgttttaataaagatctccactcccttttaaatgttgcatatttatgcccagtaatccagacacatttcctatggtctactggatagaataaatgaatcttacagatgagtcttatttgcataaaaattatttcttttttctatgtatattttttagcaggtatagtttatcattatataacctaaaactcaggacattttaaatgtaagaactgaaatctgtactgtgtttcagtcttcaaatcaattgtgcctttgaatgcactataccagtcacagatggcttctaaataatttaaataataccactagatattttaaatgtacactattttataaatatatcctttaaatagctgtccatttaactgtttaatgaaaacatgatatgtttattccccttcatgtatttttgggggtgttttcagttttgtacaaaaacaaggagtttgaaatacaacataacattcaaagatcaggtcacagtgagcaggtttttttcaggtaattttttgctaaatgaggatcatgctgtgggagccagtaacgctgggagtttcccatgactgacattattcttggcatctataaaatgaagatcatttcagtgttacatacctggggccatgtatagatagagttttcgaaattaattgtttccattagatatcatctgcctcaaagacaacagatactcatctacaccaaaaagaagttgaatgaatggggaatatattataatctgttgatggctcactttagttttctacacctttattgcatagtctctttctcctttttttttgagacagagtctcacgctgtcacccaggctggagtgcagaggtgctatcttggctcactgcaacttccaccttctgggtttaagcaattcttgtgcctcagcctcccgagtagctgtgactacaggcgtgcaccaccacaccctgctaatttttgtatttttagtagagatggggtttcaccatgttggccaggctggtctcgagctcctgacctcagatgatgtgcccacctcagcctcccaaagtgctggtgttacaggcctgagccactgtacctggcaatagtctctatataatctttctaaaggagatggagttagaaatcactagatgaagttgagaaaggattttttaaaatcatatataactttctaagacttccattcctgtattaaaaaaaaaaagtcatttgggaactgacaagaaagagaaagcattgattgccctaattgaagaaacttgtttgtttaattgaactttaaaaaaattaaaacacatggcattttgcatacctggtaattaagccactaataaaccctgtcaggacttacaggcatgactactaacttggtaaagaaactgtgccatcgagaaatgaactcagtacgaatgtccaataaagttgattgtaaaaccaaatcgagtacagtacctggcttatgttgtataaagtatcattgagaaatatgaaaaaaacataccctagggtttccaccatctctgtctaccaggactgtccagtttcaaaaccaaaagctccatgttcctggaaatgcctttgtcccaggcaaataggatggttgagcccctagcatacccacacagccaaatcgcctgcacctcacagacaagagtgaagaagtcctaacgttagagccattttttcaggttgaggcattgcttgtccagtgagactatttttacaatttgttttgtactttcaaaagacaaactgcattgatttttaagtagttggacagagtctttctttgcagttgtcgggatcccatttgccagtgtgccaatgagcaagtttctacattgttttagatgttttatgtgtaggatgcctggacattagaacctgcacacttagttatgtgtcatatgtgtcataccatgggaaagttagcaatcttttcacattcccacctagaaaaaatttcaccacacagccaaattaaatactatgtttcacctataaatttttcagtttgctaaaatttttattttttccaactttcagctatattttcaatcattttattttgtcattattacatgtgatacaggagtgattagaacactaaaaaatacatatttgcctcctgtaaagtctaaaggaacaaattacagtgtacatagggttcaaatttaaaaacctctatagtcttaggcatcatccatttatattctacatatttctttataaacataagggtaactaaactactcttttgaaaaaggaagaagttattatctgtacatctacctttgcaaagaggaacttgaagtaacatatacagcttctcagatgctagggatatctttctttgacttctttcattttaaacttaagtgatcttatatccagaagagaattagaaaatcatagtgtaaccaagtggcttagatacctggcattgtcattaccaaacagctttcaaacactgcccttttgttgattctcattaatgtcattagggtcgctggctgcatgggttagttttgtgaggaaatgcctaatttttcttccatataattatacagcccagtgaagacctgtgatctcagaaaatagatattttgcaaaaggaagactataattgagtaaattatgatgttaaccttaaaaaaaagtactttaagcagtaagaaaaatgggcatttagcctccttacagttcttcattgtttttagttgttaattatctcaagtacctgaaaattctcttaagttatataaatggataagagttgagtttacaggggagaaaattatttttcaaataagccgatgcagtgtatggaagtaattgatttactcctaaaaaaaatctagcattgtttcataatttacttttcaatatgctgcagccattaaatttctagtcaatttatgtcattttcaatacacatttgtgagcagtatttataggtatctgattcatacacagtcagaaagtgttcttaaaattgcttcataaaaattgaatgacaaccgttagaggtggaaggatagaagaggtcagtatgatcactctcctgcagcaggactgtgctacacacctccctaattcagtgggtctcaaagtgtagtccctagaccagatgcatcaagcatcatcaggtaacttattagaaatgcaaatttcccaggtcccaccccagactgactgaatcagaaactctggggccagcaccagcaatctggttctgggattatactgttttaacaatatattatataacatatattgttataataagacaattaaatatattgttataacaatataactacatatagttatataacatataactatatattgttttaacaatcccataatatggacgcctactcaagtctgagaaccaatgccttaacttaatcttaacttctgctatataaatcagagggcagggtcagaatacttcacatgggatatgggaagcagtgaaaagaaaacatcaaaaatatacattctgcctctagggtaagttagtatttctattttacttttctcactcttcttactgtcatcaccaatactccgattcctaaacatgggtggccatgagtcctgattaagactgtatccctgaaccaaggacatgatgtatgcaatctaaaggaaaaaaggacatattaacaagaaaacaggatacacatctctatgaaacctacaaatatgcaatcatataactattcttaaattgtcagtaggtgagactctaatttttattctggctatggcaatgactgatgctaagtgatacctatatcttctatagggctcctccttaagttcatggcacaaacttgtgagatgaggcaatgctgtagcggttcggtttgtgtagaaccacaaaagagaaggagattgactctgactttgactgtaaagtatccttcagtcaccaaagtgatatgagatcctttcaatatcagatgcacagctaaccatctctttccatttagactctgtaaatatcagatatttgaagaatattcacataagcatcttctttcaatttaaactttataagaaatttacttcccatcaaagacgaggagattctttttaagactagttaacacttaatctgtggaatgaatttcctcctccccattgaagcaagaaggagattagagtagaattgcaagcccgggtaacttcaggaaagtgcactggtactggctcattatttatttatccagcaggaagtctcaagctatattccctgaaatcaacaagttgccccttttgtaaggattgcctttgcacgtgttgaattgctggcacaattttattctttgaaaccaaagagtaaacaaaaattttcccaatgtgtttgattttacatgaatgtacaaataagtaattcacaccgcatctgaaattcattagcatgttgctttttccaggaggtaattgcaaatcgcacactcaaaataaaactgatcaagaaaactgcatttcaaatattggcaaaagaaaatgctgtcattgcaaaaatttaaaaagaattgcaggtttgtagtttaaactgaaatgatttgtaaacatttaataaaaatgaagtgaataaatgacatgaaaggaaggctgaatgctgagctgttagcataactacagattaaaagaagaaacagctaatcaatgtatataaatgtgtactaaatagactaaaaagcttgagatttgcactaagtcaaattctaaaagttcaactacctttcaaatgattgtacatctatcccatccagggtaactaggcagtattgcaagtgaaattgatcaaatggaacataaaaccattccattagagttcagtgaattcagtcaaatttgagaaccactttctgctgtagcttaatagagtcaaggtagaaggaaggaatgctcatagtctttagggaatttgtaataattgtcccatgagttatcaaataataaaagaaacaaacaacagttcaataaagtaacatgagacatcactggaagtacataatgaattgccaaaagtagatgtaaaactagtatgtgacacaggtagcaccacaattaactaaaatacatatttggacagaaaaagaaaacgtgttctcagaaatgtggttaaggacaaaagtctgtttcctcgctggaatggggcatttgggagagaatgatgaggggacattgggaaatctgacaaggaaattagcatccaaatatcagaggaaataatcatactgtaactgcacagaacaagtgagaagcattgtatcatgtccacattccatctgtcctagaatgatttcccaggagaggtccccagaaacagtgtgtttctgattggaatgctagcaagataaggtggggaagaaaaccaaatcagaaagaacaattgatgaaccactttgcagagcaaacatctatgactggttccatcctccgtaactccaccaaaatgctaatgaattcatttagctctgtctaaacatattccagaactgcattctgttttacttattattgaataggcaattagtatatgttgtttgtataaatgaatagattttaatcataggagaactcagacttaaaccatccttgaaaataagctaccaagtaccatgtgtatataaggtatatttcccaactataaatgttatacaatattagtgtggtccatcagtaattattaaaagagactgtcctgtcccttttaacatggaggtctcagataccttgtccccgttttaagcttatgctacttgaaagaaggattcataaaacctattctttatatcctggattactaggttttccataaatattagtgactaaacaggttggtgttattcctagaggaagactagtaattgggaacactagaattcttttttattttccaataagccatttaaccagggaatgcatttctgtatcaaatacatcctttttcagaaatctcatggtgaataatgaaaatacactttggttgggaaagtgttaatatttatgatacttgaggtcagataatcataagcctgaaaaatatttttgtttttataattttatttttaattgaaaaatatacatatttatggggtgcaatgtgatgttttgatatatgtatacactatgggatgattaaatcaagctaattaacataaccattacttcacttgtttttttgcagtgtgaatatttaaaatctacttgcttagcagttttgaaatatacaccatattattattaactatagtcactatgctatgcaacagatttcaaaatcttcctgtttaactgaaactttgtaccctttgattaacgtctccccatctccccccattctcaccctcagcctctggtaaccacatttttccctctacttctatgagtttgactttttcagattgtacatttaagtgagatcatgctgtaattgtctttctgtaagggtagaaaacattgatgtgagctctctgatactgcgaagaaactcaaggcttttgatgaacttctgtaaaataagatcaagggagaaggactctgagcagtccatcttaccttggacatttccctggctagaaattatccttctcaaatttgtttttagaatccaagaaagtcacttagttgtgtacaggtgatttaaaagaagagttttctgatcttgtcccaaagtagagaagctcgggggagctagataagtgagaagaaaaagtcatagctctcaggaacccaggaagaaagaacagagcttactgagagcccattgagaactgttaactagctgagacttgaactgtaggtgaaataagagtgacgtagggaagggaatccaagacagccataaaaactgcatgtgcttttatgtgtgcctagttaaaatgagaatcatgacaggagctggaactgcatgtagttaaatcgttgtggggaaggtggtgaaataagttttcactctaaacagccttgtgtgttgcaaggaatccaatcctactcccttgagtgaagccacagaacacaatccaaagtgggaaacaactcatggggtccaactcactgcccaccttgcagaccaagtctgtcacaacccgggttagggaagaatttttattcaatgatgatgttagatttcccttgtgaaatattttgcagcaaagccctcctcttgtacatacattcacaccagcatgccattaaattaacatttttactattttctgaaaacttatatatcccaatattttctaatataccagaatgacaaagggcagtgtaagtctgtttttcagagtttgctgtttaatcctcagaatcgtatttttacaatttgtaaatgtgtgatatcaaaagattccacttctaaaaaagaaaagtatatcccaagagaaataactaaaagacactttagaaacctgcctacgtaggctaaataccccttttcttgcctagtttattctaactatttatgcccacacatgtgcacacatacagatacctattcaagtacatgcctatacacatgcatatgtacaaacatgtgcacacattattttcagtaggaaggtaccatgtaccaaaatgaaactgatcatagttgatgatgcttctgaaatgactgaatgcagagagaggtttcctctcattattcctgtaacattaacactggaaactgctttctgaatacatgtgtttacctatcacaagagaacaggacaccctggacagttaactacactttttgctgaacaaagaattgtgttagatggattaaatagaaagtgttgacaaaaaagaagtgaaggtgctgaggtataacctctgaggctttgtcatcatatacttctgcagcaagatgatcatttcattactaatctttctcagagatttgcctggatttcatcctgacccactattttatattgaacaacttaatttttggcaaaattgacatttttgatgaactatcgtttaaggtggattcaaaaatgacttatctgggactgaactgaatctccaagctttttcattcttcagactttggtaaattatatagtcaggaagtagtctgaaatagaactccactcaacaagcaaggcagaaaattccagtcattcattatgaattaaactttgcagtaaaagctgtgggcaccttttgttaaaacagttcatgtcctggaatatcagaagaatcttaatccagggagggagccagaaaaaaaagtcctcccatacaagctggtaaagatgaagggttttggctgggcatggtgactcaagcttgtaatcccagcactttgggaggccgaggcaggcagatcacttgaggtcaggagttcgagactagcctggccaacatggtgaaaccccgtccctactaaaaatacaaaaattagctgggcgtgatggcacatgcctgtaatcccagctacttgggaggctgaggcaggagaattgtttgaacctgggaagcagaggttgcagtgagccaagatcacacactgcactctagtctgggtgacagaacgagactccgtctaaaaaaaaaaaaaaaaaaaaagatgcagggctttgttctgaacttcaatcatatgacctccctccttcagtgattgtcgtgggtcagggtggggggtaagctaatggtaaaaagaaactaaatggaagaaggaaatttaattgtcgtgcaatttaagcagataataatagttctgtagaacaggaaagattagtgaacagctcattcaaaaaaatgttaaatagcaaaactattgtaaattagagctcaactctaagtaaactgaaaaatattttcattgatttttcagtttaagcagaaaaatggattgtgtaagcatgccagagcattagtttccagtaaaccaacctatcacagaaggttaatacaccaaatggactattagaatgtcagtctgttagaaaaagagcttatactatctaatttcattgtaaaaacttggctacaaacagtattaggattctaatagagctttaaagaattattggaaaatcaggctgggcgcggtggctcacacctgtaatcccagcactttgggaggctgaggcagacagatcacctgaggtcgggagttccagaccagcctgaccaacacgatgaaaccctgtctctactaaaaatacaaaaattagccaggggtggtggcatgcggctgtagtccccagctactcaggaggctgagacaggagaatcgcttgaagccgggaggtggaggttgcagtgagccgagattgcaccattgtactccagcctgggcaacaagagcgaaactctgtcacacacacacaaaaaagaattattggaaaatctgtttacagtatcaaagtcaggaacaggcagactttacacattaccaaaagtattatgaacttactatgaaattttcttagtaaaatacatagtttctggtttcagattaaaggaaaagtttatagtgacaagagaaaatcaggaagaccttaataaagaagattacactaattatttaaaaatgtgaatggtatttttcattttctccatagcttcaaaaaattgagtaaaagtcctgagaagtggataaaactaactgcaagcaacagacctgtttatttttcagtgtaaatcttgataggctgagaagataggaaaagaagaatcagtgcaggttcaaattcataccaagcctttgcagttggagatcctaagttttgtaattattctaataggtaatatattattgttatgccaaagctgttgctcagcaaaaaaaaaaaaaaaagaaaaagaaaaaaaaaaaagccactatcccttagaagagaagaaataatttctctgtcacagttaggtgaacctctgtatttagtcaaggttctccaggaaaacagacccaataggatacatgcagagaaaaagagggagagagatttactgtgagaatttctcatgtgattatggaagccaagaagtctcatcatctgctgtctacaagctggaaaacaaggaaagccagtggtgtaatttggtctaagtctaaagggctaaaaagggtgtgggagatgggaactgctagtgtaagtcccagagtccaaaaaatctgagaaccaggagtagctccaatgctcctttcttaagggcaggagaagatggatgtcccctctcaagaagagaaaaagaaaattaatccttcctctgactctttgttctatttgggctttcaatggactagattacatccacctgctttggtgagggccatctgctttactcagtcaattcaaatgctgtctattctggaaacaccatcacagacacactcagaaataatattttaacagctatctaggcatcccttagcccagtcaagttgacacataaaattaaccatcacaaactcttaaccacaaagatcacaactgggtaacagcaattgctgaaaattcatgacttggtgttgcttgcctattggtcaatttaaaaaatatatactgcatgctattatcatgaaaaactcaagctattgatggtacttcctggatcttctgcaaatctcaagtttcagtgacactcaccctctagcaccacctaccaccaccacacagcactcaagtatgaaaatcagtcttctaaggaaaaagcaaaaattcagggagtacctgctagggtaggggccaggactatattcaaacatacatttgtggagaaaaagcaaaaacggagcaaacaactgagccatacctttatcttccaggcgctgcttcttaccctgaaagacaggaccccctgtaagagaaatgacaggcagaaaaaaagttgtggaatgtaactgggagggagaaagagagcaagacaagggagttgaggacaatgagcaatcacaagactataccaatcaaaagtagattctcctaaagtatctcataagatattgtaattaccaactgtccactcatatatgtatgtatacatatatatgtatacatgcatatatatttgtataaatgcatatgtccctcaaaagactgatgaaggaaaatagaaaaggtgacacctaataaattggttttgctgtttttataaaattggctaaagaagtctttagatttgggattcaattgtttaatatgttttttagaatctcctgtgtgttatgcattatagattagtgcttctcaaatattaatgaacatatcagttccctggggatcctgttaaaatgaaaattctgattctgggtaggtctgggttaaggcatgacattatacatttctaacaagctccctggttttgttgatgtatgcagaacctgtcttccagtagctgacagtatccttcctaccaagaaactgatatgtctaatggattcttcatcttctactttctgcagcagcaaatggggtataatctggatagagtcaaatttgcatgtggttacttttcaaaaatacatttttctcctttggttagatactgtttctccaatacaaattacattgtaacagctatagctataaatcacagatatttccctctcttactaattaatagaattttctcctgtagtggaatgtttttatgcttgaatgctcaagaggattccagaaagtagtctttggcagcaaagggtggtggaaaccccatgaaactaagcaagagacaaaagttcccatttgggtcttcccctaaatgacttgctgactttattaaatcagtttatcttgctggatagttttctcagctattaaaattaagagttgtcctttcagctcttacttgaaattatttacaaagaacaggaaagagaaagagacagagagaaaatgagtgcactttgtctaggctgtaagccttgtggatgtatggtgatgatatggttcttgattgatatatgcctggcatttaagctgtttccattgatagttcatttttgccttttggatggcatttttatcaggaaaacataccgaggcaagtcaaaatccaccttgggaagaatgcaggtgcattctgtgattataatagaattaatgactcagaagcaaaaaaccagctggttctaatcacctgaatctttattgacaaaacagttcacacctactactagttgtttgctaaaagtctgcaccaaatcactgaagctttaaaagctagatcactgcagtcttttccccaggcactgacatgggtaattacggtattgtggttcatgccacagccccagacttcatttcaatcctagcttggaaaggagttatttttattttggtgcgcaggaaataaactttttgcatatattaatataaccccatgtaaaatgtaaaggtgccagcactaaatgtgaccagccctttgttatgttcttgattcttgaattaaggtttcccatcttcactggagacgagtgcctttcggcaaagaactatctgtttaaagtctgaattagttcatttcaccttttggaatttctttcagcctccaactcaaaccatgcttacaaccaaagccatgagtcttgcctgagtttacgtattattttccatcacatatgaaccataaggaagtctatgtgctagttaatctgttactgcataacaaattactccaatgcttagtgacttaaaacaacaaacatttattacctcaccttttctctgggtcaggaatcaagttgtggcttagctgggtcctctgactttgggtctctgacaaggctgcagctcattcaaagctcgactggaaaagatccactccctagctcaaatactagtggttgctggcaggattgacttcctgcctctgtttctcataaattcttccaccttcaattccttgccacatacacttctccatagagcatctcacaacatggcagctttcttagcaagtgagggggcaagagaaggttccagcaagagagaggatgctaataagaccaaagttaagagtctttagtaacctaatcatagaagtggcaacccatcaattttgccatatactgttcgttggaaacaagcccctggtgtgaatgccaagatgttggcatcattgagagccatgtcagaagctgcctaccacaatctagaattaaaattctccctgagttgactccaaccatttagagttaaacctagaattttaaatgatttcaaaaagcaaaataggaattcagagcaaaatataccccctccccagcagtgcaagaggctgtatgactcatgcagataggcagcctaatgggtgtggtcagtagcacaggcaaagaagaacctggctgtttctagaagctccttttgagtaaacgtagccttttcttcactgacctgagtcttctaaaatgctatcaatcctcctcaaaaacactcataaatgattccatctccttcaattttaaaactagtttaaagtcttttactccactcaacaagtaattttcataaaacaaaaactttaaggacaagcataaaaactctttattgctgattaacatgtactcacatgcttgttacataaaagacatttaataaacactgctcttgctttatgttaccttttgtcctagacattccaatatttgtgtttgttagggaatcatggatatcacattctccatctctctcctagaaatccctgttctgttctgttcacatttttcttcccacagtctattcaaaaacctgctcctagaatcatcacctttatgtttaaatatgtttacatcgtttcttttgccccaaaagtctactagaagacatgcactgaacatatcctaagattacaataaataggttgtttaagagttaaaacttcagaagcaacaaaatctaacatgaattttcttggggtcccaaggaataggtatctcaataagaggcaggatagtggcttatttttcaacaaagcggcactaatgaagtaggatagcactctgaggaaaagaggaaagatatatgactaaaaatcgataaaggtagaaaccaatttaacaataatagcaggacctataatatgagatggtggcatgaagggacagctgccagccacatccagtttccccatgaagaatactctagtagccagattgtcaattaaccagagagaaaaatagagaaaaggctaattcagctattagaaagtataactaaaatccaaagcaaagttttgggtttttttggtaaagaagatagaaatagaccaaacattcttaaattgcttttaaaagtgcataatacagctctgtatggagcacagtacattttctccttagtttactctcccccagattattttccagatttctccaggtgtttctcatgccaataataaaaacctctgtgagccagttgagtgggttgtgggataaatgggtgcctcacagccaggtagaggccaacccggagcatcccgggaaggctggtctagtccacgaagaaggcagtgagagttggtgggggggatcgtgggggcagtcagatctgattccctttacagtgaagcccagaggggaaaaaagcattctgctcataagatttcctcatattcagccatccatttgctaatatattctcttgacataagtagccccactaaattcctctttcctcatcaccaactctaaaatgacagtttaaggattatcctttctgccacttaccacgaaactcagctccaagccagtttgttgtaggtttctgaacttaaccgcatagctcacaactgagtgtctaatcaatcattctatgactgaatccatctggaacaaatttgaagaagtggccatgtaggtttctttaggggaaaaaaaaattaaactgaaaccagagttgattttttcaaaagttcagaagaaaaaaaattataaaacttagcaatgacttcccccccagaaattgttcatgctctctgaataagacttattctgtcctaccccattctgcattgcatttaatccttcagagaggtgacctgtgaatgtgttgcagcagagtccactttcctgataatgagctcatggtcactacttgggtagaagggaagagggatatggtgtggccaggtggtcaccataacctcatgttgctcttaaattcccaaacacacagggctcaactgagagattatgtaaccaaaagagcctgtttctggtcaattcttgctagaccactggtttttgccccatacgcattaaaggataatttaaataatgcagccaggtagatttaagtactagatggtttttagaactccatctttcctttccttgctaggcccaaattgttaatgtaagtttaggatatacttctccatatatacccttaagtctgcaccatccatgcatttgttcaatctttaatgatttattcatcagttcatgcatcaatgcattcaattaacacgtgttcaaactgtactagaagcctaggcacaccacctttcttacaaggacttcctagtctgtctgaagatgtaacataaggtcagacttttaaaaattaaatgatacaaataattcagctcaataattcaagtcaacagaccctagttgagagcctcagtccccacatcatcagtggtaagtggcgattactgaaaaattctggagaagtcagaggaggaattggtgctgccaccaggtagccagttaggacttttctgagagaatggatgtgatgcagttaatgaaggatgaaccagaggggaacaaacctgagaagaacaggacaggctttggtgggtggacaccctaggtgcagcataatggtgacagtattgtccttgtgtatcaaactctcctttcatgtctcttgctagcatagttaccatacgtacagtacttgaaagtaatgcaattcttttttgagaaactcactcccttttccataaatcatactgacgtcagccctcaccaccactgttccccaccccagtcccagtgtcactgtttgggttgaggcaaggcaggtactgtgggtgcagcaggaaacaagatcggaaaattccattggaagacagttgaggtaggacccagaattcttggttaagccatttagatttattactgtcacaattagtgacagattttgagcgaagagtgacataatgaaaaccctatctccagacaggtgtaggatgaggaggaaaaaaatacatttacacatatggttaaatgtgttaaatcatcttaatgggactgaggtggggagcattagtggtaagggcctatgtcagtctgatttatggaaaagggagtgagtttttaaagaaagaattgcattaactttcaagtactgtacataaagtatgctagtaagaggcataaaaagagagtgtgctacgtaaggactattttctggatcataataattagtttaaaattatttataatagataattcattattttgccacagagcagcttctgctgtgtgaaacagtgattctaaacaagtttgactctaagtagggtgaacagtttgtttctaatattattgagcaatatatttattcgtaggtattacaaagataagcatcaattacaaattaacaagatggtgtaatttcaccccccacacttcatgaaataaccaatttggagttaaataggcccttcaatggtctactgaacaatcagcctctctgcctcatgctcacattcattaaactgtaaaatgttcgttaatcgtagtgtatgactgaaggaatatggagcaagtctctaaatataaactatgtctaaacagtctgttaacaacaattactcttattttagcatgtttaaggcagtcaccctgcaaaatacgatgaattcaacctaagcagagtcattgtaacaaggtttttgcaatattggaaattatagcaggaggcaattatccataggcccattctaccccacaacccccctaccatccattctgcaaataagcatgaactaaaaagtaatctggttgtagatagaggaaagcaacaagttttcctgatacatctaggggaaacattttccagttaaaggttatttttatataaaaataagaatttaaaagcggtacagaaagaggtttgggagtaggggtgaggctggactgccgagctaataaaacaagaatttaagaacataagaatagatggtttagtttatggattaatccaaaagaattttaactggatttcgatctcacttcactaagtcttgactttttttcttgggagaccccacagctagtttggaaaggtaaaacacctggtttatccatttattgacctatttaagtttccattctgaaacacttcattaataatagtcatacctgtacttttccttctcaatggtgggggtctgctggagatgatgtgttcattatctggaatttactttttattttctatcagatttaggaagaataagatcggggaaaaattgatattgctttgttagttacagctggggagatagcacaaaaccccagactaggtatcctgtagctggatccctaaacatcatttcaaagtgtgagactattcaacaagcctgaattaagtaactagtaaatgcaaagcatagtgggtgctgagaatacaaagataaaagcttatggggcctaccctcaaagagttctcagtctctgaggaagcagacagtaattacagtgtgacattttaagtcccattttagtgacttcctagagaaggtgacaccaggcctccgtcttggcaagttgtggcatttagactttagagaagtagggaaaggagaaagaatgttccaggcagagggagcagcatttgctaaggtcatgagaagatgggaaaagggaagagcaagttgttctgcataacttcagtgtgcagtacatgaagatagacaagagtcaaatcatgaagggccttgccagtcatgttttaaagtttgggtttcatcctgaaggtggtaaggagtgatgtaatcagcttccatttatacaaaatgaaagatgccctgtatcagtctgaaacttgtgtatgcaaatccacatgaaatgtgccctctttgctcacaaaggaattaaatgcatcatttacttttaaaatttatttctgagttctcatttgttaacctgtctggataattttattgtaactaattacaactggttttattctctatttataatagttctacaggggcaaattaaatatagatttcattcaagaaataacacaggtctgtctgtatgcttaaatttttatcaaacataaggagtagggaaaatattttagctcaaggaaaagctacagaagtcaaactagccttaaaaattgaatcaacaggtaatgcatcgtttcaggccatttctagtttttctccacatagaatataactgcaactcttaaaggatttttactgtttgaggtttgctccattttagagtctgtgctaccacttactggaacactggattgaaaacaaaattgtaattcagcctttgcagaagttgcaaggaaattttacacattcacgttttttgtcacaacatctcctaatcttgtaagacaaagtgttgtaatgatgatataattgtgtaaatactatggaagcgtcaaatgttatttatctgaactgttttgccagtttatagtataaacatgctagaatttatacatccagcctaatggatatctcaattgctaccttcaacaagttgaggctataaaattatataggccactgatacgtgcctggggttatccagctgttagtttcccagtggagaatgccagactttggtggtcagagcaaaactcgtttaggaccctgagccagccagacaaggtgcttcatccttaagggggctttaattaaggatgaggtgaggagcagccattgccccaagtcagtagagtttccagagatagtgagtttgctgcaattctctttcttaaaaaagataatttggccgggcgcggtggttcacgcctgtaatcccggcactttgggaggccaaggcgggcggatcacgaggtcaggagatagagacaatcctggctaacacagtgaaaccccgtctctactaaaaatacaaaaaattagccgggcgaggtggcgggcgcctgtagtcccagctactccggaggctgaggcaggagaatggcgtgaaccccgggggcggagcctgcagtgagccgagatcgcgccactgcactccagcctgggcgacagcgagactccgtctcaaaaaaaaaaaaaaaaagataatttgtggacacagctgtcctaaaggtcacctgaacaagctactttctgtggtgacctggagttgagctggacccccaaggggagtctttactggtaagatagggaatttagagggaggcttacggacaaaggcagacaagtggcaagaatgtgttgcacgtggcagtaggtggccaggctgatgcagagggccatgtaagatggcactgatgagatggagcccaaggaaaagacaattttatgtatggaaccatctgttatgtggcagtgaagattcagaccaatcatacaggaccatctgcattttgttaacacctgtgtgcacagtcacaggcaggtcttggagccctgggagcctggcagcagcccagcatcactagaaaggtgaagatggcagggacagccctgccaatcctgcaaggagtgcactagagagcctcagcactgggccagggaagctgcccaagaagcagtgtccagggcccacagaccaatagaaggcagtcctcacaccatttcagaggtggcagcagtcagagttctcaagttggaagaatggtctcaggggcaaatgcaaaattcagtatttaagtaggaaggggtcagaaatgtaggatgatgattgataggctaggatgacaacagagaaggagtcagcctagccacgtgattcatcaccctattaccataagcatggtgcttttccttgggccttaagttctttcatttttcctatttgttaatactctctcttacaagagtaacaagaaacagtcacgtatgtacatatcatttaccttcagctataatgaaggcatttgaagaaggtcattttgtattcaaagaaactataattaactttccaaaagaatacttttctaatatgccatggttttactatattactagcacaacatttaaaaaaacaaatattggcccaaaattaaactctcctatctgatatgactgaatgaatgtttcattaaatacaagtggtgtagatcaccatgctgcttagtgaagactctgccaacctgcttatttgaaaagtcaggcatacaacattttcatcttaaagtctaactctaagctttgttattaagaacaaatgaccagaaatccttgtcctggctttatatgcatttaactctatgacatttgaaaatattccctgttttttcatagttctgatcgataattttattactgtcttgaaagatggtgaccacaatgtccttaacattctcaaaaaaataaataaataaaagttgctgctgaaatttacatttttcatatctttttcatagctagaacttgttcacacaatagttctctctcagaattacatgtaggttctaattagagctctagttaatgttatgtgtgctaggtagtctttataaatattaatacttcattgccatgaagcgattctgtagccatcaacagtcctttcctctgataggactgattttatggaatcaaatattatgaaatgcagaagatactagatttgttttgttttgacagattttgttttgtttgaatgttttcaattttcctaatgagaaataacttttagcaagaaaggctgtgtttgcctgttcttgtatccattcatctggaatatgccaaaggaggggaaggtcataccatagatgctcctgttgattgggtgttagtcataaagaccatattgaaaacatgacactaagcaacaaaacaaaggtaggatatttaataatgtgaaagtatatagaaaattacattaaaaaccccaacttcctgcagtgttcttgcttccttccatctgtatatagctgaagtaccaccctgatcccactaccaatttaagtcttcacactgttaagtataatttattgagcacttactgtggaccaggtacctccattttgagtgtgtattgttttaattgtcctcacagtatcattttgaactgaacattccccgacttcatagatgtggcagtgagatttggaagagtagaaaagtcaaataactttcccaggacacataactaaaacgtgatgttgcttggatttgaactgagacctatttgactctaaaacctgtgatcttacccacccttctgtctcaagcatatttctgtcagtgagttgtttaagagaaagagttattctgtgattctcagactttctaaaaagatcaacaagtcctcccctgaactcctaattcttggtataataaattatatataaacattaattcttggtataataaggctagtaaaaaaaagctagcataagcaactacagaaagatacaatctcaaataaaataacttagaacttaaaaatactagctgttagagaatagtatgattcctctaattctgaaactcatgaaaagagattcgtaattgaaggtcactgacagggtacccccttacacctatctggcagcctcacagtcatccacattaaccacatatgtgcctgaagccaaaggttttcacttaaaagtttctataaacaaattattacatttctaggggaaaaaataatcctaggctaattttaaaattaacaatctgaattgctcaatttttccattttctttcaaaatgaaaacttggaatatgatagactccgtggatgtgctccatacagtaaccattttaagtatatataacagatctaagaacgtagagtttggtttttttcatccgtttattcatgccaagaaattctctttaagattgacttagtttggcatcaacctttaacacatcaactgcataactggcttgggtctacctgcctttgtactctgcagacacacaaaccatgtatagggcatgtttctccaccagattttctttttcagaatttgcactgccaaacagacattaagctactctaaattcttgacaagtatgtaactttataggaacacagtagtgtatttaaacattgaagagaactttctattcatcccactcttctaacagagccatttaatcctatccagaaagatgagtccattttcagactctcctttgatcctacagattagagggacagagaagtcaccactgaaaattgaaaaaggacgcaagaagaaatggagatccatgaccatggccccaagaaagcaaaagcatgttactcaggtttcccaagatccaagttagagaggggagaagagattagagctagaaaacaaatacttttaaaaacagcattttggaatttatcaaagtaggctttaatgtcagattcataaaaatgaaacagatctcagagaatgtattttctgagaaacttatttctgtccccaatggaaatgtaaagtaaaatgccccagactcattttaaagtccaaagactattttatatgctagctttgagaagcctttagaattgcaacactcacagggtcagaagtttttttgaacagattttcttttgtcccttatggcctttaggcactccttgagctaatattcaggagttatttgaatgctgttgcttcacaacactgaaagtgttttaacatagagggaggaaaatcccacagcctatgtcatcataatttatcaacaaattaagtccaagaatgcatgataatttatggataacttggaggaaatggtaactatggtatcaatttggaacaaaaccaggaagtcagatctcacttgatttaatgttatctgaaggatttgggcacaagtttaacattttgatcacggaataatcttatgccttaacatgatgaagactgagtcttccttcctgaaaaatccttaatacaggacaagaaataatgagtctaaaatttcgtaactgttttcctgctcaaggaagagagaaggaataaataaccacttacaatgaaaccttttcttgctacacttcatcatgaggcaagtatttcagatgttgggagatagattgtaaaggtataaaagttaacttcacagctatacaaagctatacgtatgtgcaccatgtgtcaaatgagagaaagtatagatattcaatgttgttgaatcctcacaattttctatattagagtggatgcagcatctgtttttcaatttttaatcatcaacattgtcaagcttagagaaaagttgactgtacagtacaattaacaaggaacacccaccgttcagattcaaaaattattaaaactctgtcatatttgcatgtagcatgttaacactgtttttaaacacagatgactagtcaaatcccccacctcctgctgggatccacattgaatcgtttgtgtatttccagtgataggaaactcattatctcctaatacatcaaaacaaataataaccacattttctcttacactgagcgaaaatctgcctttcttgcatttctagccatttattctatttctgctttttggaaatacatggtcaagatcttttcctcttcccagggagaagagcagaaaaaataactattgagtactagggttagcacctgactgacaaaataatctgtacaacaacccccagtgacacaaatttacctatataacaaacctgcacatgtacccccaaacctaaaataaaagttaaaataaaaagatcttttcctccttccctaagctccctttcataaccctgaagatgatctcagatatagatctcatctatgttttcttctcttgtaaattgagtacaaagaaaaagataaggatgatatgaggaggtagggtagggctatgggccttcttatgggctggcatttttttccataaattttgatctgtaatattttcattttcattcagtttgagatttctcaaatttcaatttagctatctttaaaccatgggttgttgtgaagtatgtctaattttccaaaagaagggctttttctagttttgttgttgttgttgtttctatcttatttgcattgtagttggagaacataatctgtatattgcaaatttttgaaatttatttagacttactttaatgccagcatatagccattttcttttaatgttccctcagtatttaaaaaggctatgtattctgtactgtgctctatacatgtcaattagttcaaaggttttaatcacattttctattcatttctgaaaacatgtatttattctttcaattaccaggagaagtgtgttaaaatcttactgtaactgtgcttgtcaatttttccttttagtttcattcatttttttatttgtctatactgagcctatatgattaagtgcatttaaatttagaatttctacatattcctggtaaactgaaacttttatcattatgtagtatttttttaattctctaataatcttttttttccataaagtcaacctcttctaatactaatattgcatagccaactttgttttggttagtgtttgcataaatattttccatcttttttattttaatctctgtgtccttgtatttaaattatgtctcttgaaacagtatatttgggttttgttttttaatcaatttgacaatttttggtttttagtgagtgcatttagtccatttacatttactataaccactgatatgtttaggtttaaaactacctaccattctatttgcttttcatttgtcctgcacattttagtttccttttgttttcttaccttcttcctaaattgatggagtattttgtattattctattttcccctctattagctttgtagttttattttttttttttaccattcctttattgtttttcctacagatcatttgaacatgcatccatgacttatcaaaatttaagatcaattagtacttttaactcttcctgcgtgattcaaggaccttaaaatatttaaactctattcctcttcctgccaaactatatatgctattattctcatgtattttaattctaaatattttataaatcccaaaatactttactattattgttttaggcagtcagtacttatttagatttatccacatctttattctttttattgtgctggaattttgaatcaaaaagagaacagaaaaaagaatttagtgcaaataagggccctgaggcatatggagaaacattgcgcagaaagatcataagtaagatataatgaaatgggcaggaaaatacacacaagaaagtaacattctctgaaggcaagaggcacaaaggtattctttattgaaaaagctttaggcagttaatgagttggagaagtattgccaagttacactcaccaaatttagtagtatgcctcaatttagtgggcacaaaagctgcttattgttgaatgaacaacaagcataatgtaattggtttcatacaattaggaggtcagcaagccatgcttgttataattggcactgccatagtcaggggcttatgcgacctcaagtgatgatttgcctgaaggaataagccaggaatgtgtgtgctttgggctccagagacttgactaatctggctgcaaggcctcagggagggaggccaagaatcaaatcacagtgctcaggcagggcttggtagactcagttgaatgtagtcagtctccattcagttcatcactcaccagtgtttgagccggagccggggaagtgggagatagaggagaggagagatcaagtggccgggaaccaggaaaacacaattgaaatgtcagtgcagaggcatcccataatagggcgggatcttaattcctcccaaggccatccactttgaagcaggtctccagcctgtgtggcatgggcttaaaccttcacacaaagggtctttaatttctagtactgagccactctggagcaaagactgatgttgctgtttgtttcaaaatacaggtttacctccacaaggtagcagactgatgaatggttgttaatatcccaaatatcagggttttcttttcccaaacattttctaaattaataattaagtttaagaaggcctgtaatcccagcactttgggaggccaaggtgggtgaatcacaaggtcaggcgtttgagaccagcctggccaacatagtgaaaccctgcctctactaaaaatacaaaaaattagccaggcatggtggtgggcgcctgtaatcccagctactcaggaggctgagtcaggagaatcgctggaatctgggaggtggaggtttcagtgagccaagattgcaccactaaatgctagcccaggcaacagtgcaagactccatctcaaaaaaaaaaaaaaaaaaaaagtttaagaaggaaaaaaaaagagtttagctgggtatgacatactcacaaagatgccagaaaatactcctaacaattaacaatcatttaacagtagacaatgttgtttccttgagattctgaaagcataagcttcatgttgccagtgggcaaaaacagctgaagaatgagaagtaaagcctttgtttctttgctcttcctctgtttcagcctatgacccattggttcatctggtttatgtgtagtacagatgagtcacagattggtcgttcacatgcattagttggttttcttccccatgttcatgaactgtatgcctaacctcatccaatcatctggcaaatgaacactgttgtccacagaggaagctacgtgaggggggtccatttgcaatgcaaatccgtcatcattgctagaaaagcaattcgaagtagcatgatttttttcctatgagaacagcatattgtaaagttctgatagaacacaatgcaatgccaagggcttctaggacacttgatttcgccactctctaaaacaaagaaatgaactatcagggaggctgataatttgttgattttggtgatatttttgtttatcatttaaagcacaccaaattattaacaatctgttttgccagaactgataagaatctagaactataaatctactgctggccatcgattaagacagttctctcttgttacttaatattagtatttattttctccactagaactgcttagcttgagtgaattctagctgataatttcagaagggtgaaaagctaactagaactgggcatttggcccagataaatctgattccagtactatgaaagaaacagcaagggaactagaaagtctttgacaaaaaaatgttgataattggctaaaaactggggagggaaacagaaaacttggagagctatgaatgttattctaagtagaagaaagacgcaagggaggaatcaaggtgctgtgacattaacaaccctatctttaaggctaaaaaaaattaaaaacacctataaattcacttaaaactactctccagaactcataggaaataagtcttcctcaggacctaaattgcagaaacaaaatggaaatctggtgtttgaatctctgctctgtgtgaccctgggcaagttccctcaactgagtctacatttcagtgacatccttttttttcttcatctgtaaactgtggatgaagtaactacctcttccacagggctattaggattaaataagaagctttgtaattctgccttcccaatcaaataatagatctttttatattgctaagaatttacctatttttataccaattaattttagaatgttaccaagtttgtatatgaatctgtataaaatattatatacttttttctaaatcagatttcaatctacataatttattatattaattactcaggttatcattatcaatagcaaatactggatgagtaaaacagtagtaaacttcagtgccctcaggtcttgctgaagtaattcttaccttccaggattatattgaaaaacaaaatactccaaatacctctaagaccttcactcagtgagtcccttttatttaaaaagtttcagagagtaagtaaaaagagtactttggtaggaactagtttatcaccctgtctctagaaaggattgggagcaatcattttgagcaggtgggtatctaaatcattaagaatgttgggaggaaggaggccaatggtaaagaagctcttccttctaacaaacatgaatcctttaccttgaccatttttctactttactccatttatgagattaaatcagtttgattgaggaagctaggtataataaggttttaaatccacacagatcaagaagtatcaccaacttgaatttaaccactatcttttctttaaccacaagagttcacaggatagcaccattaaataatatttgcaaagcatgcacagtgccccacacagaactagtaaagatacggttattttactccaggggtttacagtctggaaacaaaaaaagtatattgtgaagaatctgaatacttttaaaaatctgtgtgttattgttgaggatagactctctatttcagagatggagaaacaaagagaaaaaattgataccatgaccctagatcacacagggagtgacagattcaaaataatttcagtcttctttgtcctattactagtgcattctcatcactagtctacagtggcttattcaaaagtagttctaaattatttcttaaaccaaaagcagcacaaattataaaagtctaaatggtactcaacaccattcaaggtgcagataatttttgcccatgaaaacatgctaaagggactccatgttgtggtaagttatcaaattatggaaagaacattgcagagattaaaatgttgcataagagagagaaagcagcatgagtcaggggtttgggaaatatgagtcagactgaagggaaggagccaaaaacatagagaatgagggcctaagcagggacttaatggacaccacagagatgtggacaaagttgtctccattaactttgagagaaaatcaaatgtgcggttccctagacgtgggggtcggtgtgataaagaggctagaagagctgagcaaagattagcctgtgttatttaaagcaactaacggtgccaaagtcagcaagagagggacctacaatagtataaatcactaggagggagcacgtgggcacatttttgaaaaatgagggaatcaccaaatattgccattagctattgttaatgtattagaatgacgaaatgtgttatggtattttaggaagcacaatctattattttgttctttggtaatgttaacattaggctctgtctacatagttcagagagactccttatgttgttcaatccagactctctaatcctgcctttaaggccttgaattttgttcacgacagatctagcatttcatgatcctcttcaaccaggcactgcaccaggctcctcacacagagccccggcagctgtgctgacgccatctgtctgccattcttctcatggaaaccagttttgtcttatcagcattttctaatgtgagctgctttctgcctagaaacagcttccttttcctggcaacccatgtatctcgtcttcttcaaaatgcagtggagaacccacctcttctggcgaatctgctttatacctcatagcctctgcactcctggactcacttgctcaacatcatttttcttttactaacatcttactgattttgctgtgtttctcagatataccttgttactctgcttcatacatttttagctccattaggtaaaacactgatcctacttttcctgaaactttaggtaccaattctcagcaaatggtaataactcatttatccatttattgcacaaatatttattgaaaatccaccatgtttcatgcactatcctaggcactgggaatacaggggggaaaataagacatagatcccccatccccacccaaagagcttgggtccaggtcccaggaaatttattaactgactgcctgaaaaaccaagtgagcttaactgtcaaggataaattataatcatgcaaaaacaacaaaaaatttctccccatagtaatttgtcctagattatcaggaaaatcatggctgacctgagtagtttcccttataaataaagcattgcttttgctaatgcagatattctcccatacaaatgtaggaaacagatttttcttacacaccatggagatacctacaaaaggctgtgtttgcactatgggaagtcaggagcaagtagagggcagtggactgtcatcaacactcctgggagagccaccttttccagagcatctgcacagggatgggtattctgctttgagtttctgacatcattgtccattttagtaaattttgtatcatagtgagctttctggtatttatgacaaatggaaatgcatagaagtagaaaagccaaacataacggaatttaacaatgtataataattttatatgactttgcatagatgtgtaaataagtaattccaggatctcaaagtataattttcaaaataatattgtgttatttaaataaactaataaattgacattaacgtaattgaaaataggtcaaagaaattcagtctgtttatagcctttagcattagataaaccaccaacagcaaaggagaggataaatattctaaaccacagccagagaagccataaatggaaatgtagttagtagctgcctcctggtcacagaggtcacttttttgacaattttatgagtcccagtaagtaaaatgtgtaatcaccagtcagtcctaggtgaggcaagtcttgttgcagctttgtttgggtgttggtggagaaagggaaggaaagtagtggcagtgagcacagtggtatttgttttttgttgttgtttgtttttattaatttaactcacctaatatttttattaaataacccactcagaaggtaaacagacctcattcttaagaaggagtagcacaggtttttgtgtttaaaatctacttaatgatacattaattccactggaaatgttagcctatttatcagacactaagaaatgagcaacaagaaagtaggaaggaagtcatagggcatcagttgtaggaatgcagcggggtggaggcagtttgcagatagatgtcaaaaagaaaagcctcagtcactgctgaggcctcccttagaaaatgcagcagccagcccagggccttgatctgctgccagaggaaacttgccacatctgaatctaacattgccgtatctctcaggactgttatcactgcaaatgctggcaaatgttcttgacataaaacaatagatactctgctgtcatttctgcattaacgagtcataaagctctgaagaaaccccagtaaaaaggttttcatcaagtgcatctgagaaaataataaaagacacaaaaaacagcagataatttcaaagcaggattgttgcaccatcgcatagtacctaaaaaggacagtttgtaatcactgacttgaaaataatactagtagtaattataataaatttcaaaacaaaacaaaataacaaaaaccttagccaaaactttaaaaccaagttcaaagaattacgtaagtggatgctttatagattattatccaataaatagccatacatcactcaagtatttttcatctcccctccctctttcttatcgaaagaatctctcttatcatttccacacccagctaagtgaagctgatttctgaggacaacccttttacaatctcaacttcatatattattatactgcatagtgtaaatgcgcagtcctccttgaaaatacagaaaagtgaaaggcaaaccaacctcagggtctactctcagagattcttagagggaagacagaaattgggtgaattttttattattgattctttccctactttttcttccaacatactaccatgagtctgccacagtgatgatctaagacctctgaaatctgcctcaggggtcttaaatcatcactgtggtagacccagggtagtattttggtttttatacaaaaattgtcatctaggaatcacaagttttatgatattgttaatgaagcttagagtggttgttgaagaatgatgaaattatatgatccttttttgtgtactacttaacttcatgatataggagagccgaatgaatataaaagtgatacagataaggcaaaattagattttacttataaattactgtaaatatgaatgtacacacacaaatttatatcaccttttgatctgaaagaaatttcttataactagttcattatgctatcactgagcattttttacttttctagaactgtaacctgcatactcattaaggcacatttagtaaattattccaagaagtacactgctttgagaaaatatggatttttaaactacacaggctagaggaatatgatcaaattgaatcctttgcattctgaaatttgcaatgaaagatttatacatacatgttgccctgctgtttgcaaaaacaaacagctacagggaacgtataatattaaaggttgattacacccagttattggttagatttttagaaatttgtcaatggaaattatctcaaatacaatatattggatggaaaagcaagtatcatacaatctattaaaatttttaacatacaaaacaataccatatgttctaatggatgcatccctgtctaacaaaagtacaaaaacatctcagggaaggattcattcctaccgagacagtggtagctgatgggtcaagggatgaggatggtgtgaggctttagctgtatctgaaatgtttcttaacaaaacaaaatgagccaagaccaacatgacaaaatgttagcatttgttaaatctgagcagtactcactggtatttgcaaaattattttctgaacacttgaaataatttataattttaaacatttccaatgcaagaacattataaacttttaagaataaagtaaaaatttagcttaagaagtggcaaaatggaggaaatatcaacatcttcacaactgacaattctttctgtgttgcatgtctctgacagacatagacgagtgcactgcagggacgcacaactgtagagcagaccaagtgtgcatcaatttacggggatcctttgcatgtcagtgccctcctggatatcagaagcgaggggagcagtgcgtaggtaagtaccacagtgcagtgagcacggtcctgtcttgagtaccttaactgtttcaacctcaagcattccaatcaaagcattcatgtttctttggagagtggtagccaataattccttatttttttatagactaccaatccattttccacaataacaagaaacaaccttaaaggttgagctattctggataacaaagtgttggttaaatgttagacgaagcaagagcagaaatttggggtatgaatgggacaataaaaacaaccacaaaaaaatttaaatttgctgttttgggggccatcgcgctaacacactggtactgtgggcttcattcaccattcactgctgcagagcatagcatagcacagcacatagagcaaatggtggagttgcattccaagcaccaaccccagctcgctttgagaccttgagcaagttacttaaatcctgtgtctcactatgttcacttgtactgtggagatgatactaggccctacctccagagctcatgtagggaatgcttagaatagtgcctgtccctgtgcagtaaagctgtttgctatcgttgtattctgagtcaacagatgggtattaaaggctctttatactgcaagcctttgtagggtaccatgagtacaaagccaagttcagcacgtgcctctgctggagggcctaagagcgtgagctccctgacagcaagaccaggtcatcttgtgtcactgtggtctccccagtccctgaagtgtgcccaccatgtgatggaggctctatgcgtgtgttttgagtgaatggaagatcaaagtatgaggaagccaactggcagatagtgaagtaaaatacagtactctgggctcaatcatgaggcccagcactaggcatgaaactctgactgtccatttatttacataccccttcttaccacagatcagtgaaaaagccttatttcctcttaggaacagagggtgaggatgtggggacagacaaccagcgtcagttttcgcctgagaatgtgagctgttgatgttcacatgtcaacactgagttccatgtgggccccagcccagttctgtctgccatagggctgtgcctagatgctggggttagtgcccagcctctgaggaaggcccagggtttgctataaatgaagctgtgatttaaaagaagagtgtgtagaaaactccagagataacaaagtttggccattgtattagacaggaaaataaatatttgagggcataaaaagtacagaaaaaagaactaatccaacttagtgtggggtgaatcaaagataatggaacatacggtcacagcccttttaatgtggtaggaggaaatattcctaaactcagatctaatcatgtgtcttcccctcctgcttccctcactgagagaatcaagtctacattcctcgacagagcatgaaaggtcttgctcaatctgatcattgtccagttctgttgcataaacacctctcccccaccacaaaatattacaccccagctttattccaccagttccccacacacgtcacacagtgttacttacactttggtgcctctatacaagctctttacacaacaaaaacattccctcctggcaaattcttatttcactgtcaaatcctagcttaggatcacttcctctgggaagcctgctatgatttacccaaatataattagttgctcctcccctgtgccagtacttctcaaattatgatgaaggatacttttttgtaaatttccaatctacggcagaccaatacttctgtaaagcacaataaaaataatgttgcactaatgtcaaattgctatttctaaacatgtactctcagtttctgtatttattcattgcagactggtccaaatagcccatgaaccagcagcagtcagcaggccacacttcaagtagcatggtgctccctgtgtcccatacactcctttctattgttgatcttctcattccatggaataatttgtttcatgcctgtctttcataccagacaaggcagaacacatgtatactgattatcattataaacttggggtgccaaacacagtaccagcaaataagaatggttcaatgaatgtttattagttaagaagacatgcgtcacatattcaccaaatagttattgagggcttactgtgtaacaagcattgttctaggaactgggataatagtaaacaaattttacaaattcatagccctcgtggagctattagaaagtataataccattcatacaaattagctatcaatactagcacctgatgatagtactgaggactaggaagcactatgctaaaattgctcttaattagtgtgaagtttcgatttattcgaataatgtttattgaacacctactactatgccaggccctattccagatctaacaatgaacagacaaaaaaccctctacctccacctcaaggggagaatgtcatgcactatagtgagggaacacacaagaagcaaataaacacataacacaatgtcgagtactgttaaggactacaaagaagtctaaagcaaggtaagggaatagatagggcagaagaacctatttgatattggtgggaaaggtggccaccctgaggaggtgacatttgaatggacacctgaaccaaagtaaggggaaaagccatgtgaatatcttcttactatttatttcagtattcaagttaaatcaaatatatcttgcagcttattagctcccatttatgtttacttgctttgtgccagtaactttgcctacattatgtcttgtaaccctcccaataattctactcacagaagaggaaatgcaagctcgagaagttaagaccaagctagtaattgccagaacaaagattcagactcaggttatcctgaggccacttgagcacactacttaattttagttattaaagtaccaaaagagcccagcataaaggtttgttttgttttgttttgttttaccacaaggcagtgtcactatatagcattacattgtatatgcataatggttgttttaaattacacatgccatgttgaagttgtcacaaagtgtagaatcatgaattaatgaaattttattatgcttctaagatgttagtcctacttagcaagttcttagttgagcattttatagttgaaaatatttatatgagaaggacacaggctggaacacttcatcaaagtgtcaaaagagcactctcaagaggtaacttatttagcatccaattcttccacagtgttcttttatttgatacacaaaaacgtcctaagatacacatggcaagccttgctatccacatcttatagaagaaaaaccaagatactgaaggcgtaagtgacttagccaaggtcaccagttgagcacagcccacaactctttcttctttgttttgtgctgcaccatgcacttcagtagttcttttttacttctgtaattatatataagcttttagctccccaaactgacatcttatatatatatgcaatagtctcaattattttgttttctttaaatctcaatccacccaccaagtttatttaccactgaatggcatgaacattgagtctttgttcttaacttcttaactcagaatacaaagtatatttaaaatacatataccctaattttaacaaaataggaaattattacttttaaaaagagattttctctacataggttttctagataatgcttttcagagaatgctaattcaataatttggttctctttgtgtgtgtgcctgataacctagacatagatgaatgtaccatccctccatattgccaccaaagatgcgtgaatacaccaggctcattttattgccagtgcagtcctgggtttcaattggcagcaaacaactatacctgcgtaggtaagccttttgagaacttgctgatttctgtcttcacaaaaggaaaccccatgccatgttgcagtatttccagttttctatgttcttgagtaaatagtttccatcgacttcccttcagcaatcataaagcttaaaagataataaccaatctgtgtcttaaaacacatcaagatgtgaacagaaaactttttaactttggttttagttctcctctgtggatagatcaacaaatttaaaactacaaatcaattgatatacatacaccagtcaatcagcagtgtgtgatataatgctgaaagtgccaaaggggttactacaagttcaagtatataaactttccactgaaagtgcatctgatttttacatgcctcttctcccctttcagaatgcaatgtcacggcacacaattaaaagattggcatgacatggaaaaaatctagtgtaggaaaaatgccttttcacaatattttcagtgctttagagcattgcaaaactccgtatgggtctcaaaggcttatgttataattgtaatggaatttaacagaacccatttaaaaagtaataaatagcacagataaatcttcagtacagcatgctgagagaccatatcagtataagtgtcttatatcaattatttatagaattggcattttgtatctgaacaacaaaagaaaatcgataccggagtgtatatttattagaagcattaaattcctttggaaagattcatcaaacatcaaactaactgtcattcctagaaaaaatatttcggtatttccaaaagaagtatatgacagacgtttgtagttgttccaacaaatatgaaacctaaatggatgttctccagtgagcttctgcagggcaaataattcagctagggaattactcacttgtcagcagatgacgtaggtacaaaagagtaaggatatgtttaaagtctatatatatatgtgtgtgtatatatatacatatacatatatatatatataaaactttttttcagatataaatgaatgtgatgccagcaatcaatgtgctcagcagtgctacaacattcttggttcattcatctgtcagtgcaatcaaggatatgagctaagcagtgacaggctcaactgtgaaggtaaaactcttcccagatagtatggaataaagtccaattcctgtgactgctgttgttttatctgattatgtacccatttatgaaaacaaacgcttacccatgggaattctgttctaaaatccagttaatgtagttcagttgttacattgcctttttagtgtgttaccaagaaaaaggaaaagaaataaaaataactgaaatattaggtgcaggctggctctaataattagaaagggtgctctagcatgttgcgtctcagtgtgttatccagtgaccaggtatgtcagcacctcctgggagcttatgagaaatgcagaatctcaggctgcaacccagacctcctgagtctgaatctacattcaacaaaaactgcaggtgactggtgtgcacatttaagtttcagaatagccaagtgcatgtcaaaacattaaaataaaaatcaggagatctggtttctggttctattcctgctactgtgtgacttgggcacatttcttgagttgcctgggtttcactttccacatgaacaagaggagggccatttaactagattcatgaccttcagggtccattgcatgtgcacatttcgttatataattcaaaaggcattagacatcctgagggggatgccacagacacttgatgtccctgacctcctcacggttcactcagctttacacaaagctcaaaccccaccgagagaggcctcacatcatgccattacactcaaaactgaaagaggctacctcaggacagctgcctctgcccttctgagtaaactgtagggacatcactattcagaaatgcaaagcattcttcccctgaaagtcagatcctgccaagctgtcattctggaagcttgcacaggttaggggacttggcattcaaagctcaaatgaacttggcttcaaagtcacccaatttctgagaagacaaacatgaactctacatcctggatgggtctgcagagtccaaaatgaaggccgtcaaccacaagccaattcattcagtagtgtagttaggtccaggattagccaaattgtcagcaatgattcagtaaaagtcatgataagaaaaactttttgtgctatgaagtcatagagggaaataagctgatattgttagaatttgccttttagctgcttataaagttttgtatttctatttcagaatttgcaatatttttactctctttagctcacctcaaaagtgtattacttcctctggactgttgagcagaacaaaaaaaatatatatgtgtgtgtgtgtgtgtgtgtgtgtgtgtgtatatatgaaacccaggcaacttaagaaatgtgcccaagtcacacagtagcaggaataggacaagaagccagatctctttatatatatataggtagatataatttttcctccttaaaatataaataattttaattatatataattattttaatatagatattttaaatcttataatttatatatatatataatttatatatatatatatatccaaagtagtggtgcacaaacttttcaactctgtgtcctttctcttgtctaattcaacagacattgatgaatgcagaacctcaagctacctgtgtcaatatcaatgtgtcaatgaacctgggaaattctcatgtatgtgcccccagggataccaagtggtgagaagtagaacatgtcaaggtaagtttattttttttttcatatgttaggtatttagttttagccaggaagagacaagaggaagttataggattctcctatagactttcatttttcccactttcaatatacaatttaagctcttttttcccctgttcatcataaaatatatacatctcataaagaggtgattctatgctaatgccgacatttttcgtccttaaaagataaataattttaataaaatattgatatgtattctatgtaacctacatcatctctttgagatacatcttcaaatcatccactggaaaagattcagttattaaaatgtttcacctgtgagtttgagtttagagcataagctcaatatgtgagttaaacatacctccatccagtcttagccctctaaaacacaaggattataaattgcgtaagaatgtaggtgctgagaaaagtcagcctaatatgttgtaaaatatagttgaatattttagagaaaactactagccccaaaatagctaatgaccttgggtccagtttcaaaataaacattcagatgatcttcacacctatacgtaagtggaagaggcagctccccacaatggtatgatttcagagtttctcaggaagatctaaaaaaaaaaaggaccctacctccaatgttgcatgtagttgaaaattttcttaacagggaaaggactgtcagataaaaccaaaaacgtagaaaatcctggaaaagctagtacaaacacttaaatttacacaaagcaacaaaagaatgaaaaaatgaccaaacttgacagaaaacctgtttgaatcccagctccactgtattcagtctgcacaatcttgaacaaattatcaaactactctgagcctcagcttcctcatttggaaaagggagttgtgggaatttagtggaataacatacataaaaataatttgtaaactataaagcttgtacaggtcaaggtgtttttatgaaatttacttaccaatgtaagtgaccagtagtacgtcttctgtagagagtcctttttaatcagagttggagtgaaggcacacaaggacaataaagatcctgttaagaaaagaaagatcaaggaaaggagacactggggattctcagtctatatcatgattttacaggaaaatattaacttagaggaaatccattacctgggattttataataggcacacaatttttcgactagactccaaccactgagtatgagcataatcagaatgtagttcattgcacaatgaacatctttataaccctttccaggttactagagactttataaatgttaattatgggaaaacattgcattccaatgattttacttactgaaccctaattgagactttcaacatgcatattacatgcaagaaaatgttagctagtggaatgtcttaacaaatttctctggagtccttcaaacaaatatctatgtgtttctgatcaaaaattgatttgatgctcagcaaaagacagaagcagattaatgcacggtgggatccgacctgcctagcctatctatgtggaaacatttatatctattgtaattaaaggtggaaaatgcaccaaaattgtaagtgggggattcctaaatgttatatattgaagatatgcagcttcagaatgtttggttaagccaaaacattttttgtgaaaaagacttagcattcttctaaagtataaagcaattgctttctcctacggaaatcgttccttctgagccttgtccacaggaataaaatgaaattgaaagttttggattcttaactttctctaaaagacttattttgtggatgaaataactgttctcatttcacaggcctatacaaatgaaaactgtgtgtgtgtgtgtgtgtgtgtgtgtgtgtgtgtggagagagagacagagagacaaaagaatacacatacacatagacacacactcatcaaatattttgagagtattaatttctgaaaaatcttccagaatgattaaggtgatgattatgctaggctctacattaatggaagtaataaatgaaattataaggttgtcttttgcttctgttggactccatataacaaataagtattagttttccctgtacctaaacagcatctttattcttcaaaaaagtggaaaatactgaaaggataagtcaattgtgatttcatttgaagaatctaagttttctttcttcagccatagccagcccaagaagacactttttgtaactgtctcttggagactacctagctttcccagtctgttcttgagttccagataactttagccagtttggaagctaaaatacttttttttcctccaaagtcaaggcatgaattatttagagtatatgaacttgaatgagccactaaacccttatttgtttttcatccatatcaagtggaaatatctttctcacctacctccacacagtttgtgtgaagagcaacttagttcaatttaatatttcttaaaagccagatgctctattgcattaatgctaggtgatgaaaggattaaaagatgggtacaataacccttgccctcaaggagtttacaagctaatagaagggttaagctagacatgcagattgcaataatgcaaagcagaaagcaataaaggcccttaaaaaagaacaccgggtatgagaattcaaaagagatcatatcccagcacctagcccatgcttggcttacagcaaggattcagtaaattacttatggaatgagtaaattcatgaataaaaatatctcattgtggagaaggaatgattcagaaaaagtttacattgaataaaatataaatcactattcaaatgtaaagggagacagacatagagatgtagatattaattttatttttattgttgttgttgttgttgttataaatgtaatggctctctagtaaaactgttctctcagatgtcatctggaggcttctgattcccaaatttaaagtcaatctttgtccagcctgaggtaaacacaacccttcttcccaggattctctctccctctgacttctttggcattgccttttcctgggttgtctccctgcactgacagcctcttccttaacttcctctttttccttacagtcctaaaattgctatgctctatgaggtggaacacttcatagtttcacttcctgtgctgtgcttcctctggacagtataatccactcccagcatgcttcagcttactgaaaccagatttctagcctttacctttctcccaagttcctgaaagagatgataagctgccctccatagtttatgcttcctgatttctcagcttggaaagccttccctgccccagccatgaaaactccatctaaccaccacccttcaaggccacgttgagatgcctcttccttccttcagccttccctaatccccctggcaaaattacccaactctgctccacatgccccagtatacttatctatctcttacttaattccattttactttctaagtaatcatatacacattccctcaattataatgtccctgatgacaagaactggtgtttaacttttatataggcagagtcagtggttaacattggggtttgaattcaacagatgaacaataggtgcttgataaaatatcatgaaatgacacatattaatctgcctagaatgtctcagctctgtctgtcctgaattcaatacaatgaacacccagtcttgtgtctaaaagcaggttgaacacagtccagatgctctcacacctccttccttgcaaacagaatctgccagttatatgatttaattagatcagttcattagtttagttagtaaactctttgaccctacatctctacagatataaatgagtgtgagaccacaaatgaatgccgggaggatgaaatgtgttggaattatcatggcggcttccgttgttatccacgaaatccttgtcaagatccctacattctaacaccagagaagtaagaaaaatcagaacttttgaaagtgaggattttctggtcttaccaagccaaactgctgaatacttttgtttgtctctgcagccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgagtaagtatcctgaaggcagccttaactattgagaaagatgggagtttgttgttgttgttgttgttgttgttgttgtgtggtatccacatgtggaaggaaagcaaacatttaaagtgtcttatgtgtaggcattgtgtaaggccttccagctacattatttcatttattcctcttggtaacactgccagatagatattaatattcatctccattttttacagaggagaaaagtgagatgcagaaagattaagtagcatccctgaaatcactcaaatattaagtttggcagactctgatagagttgtgtgtgaccacgaaaatacaagcctcccatccccccgcctctgcccccacccaacataccccccaagtaggtatcactaatcattgatggttaattaattatacatagacatacatataattcaaacccaaaataattcctggagctcctaaagagtttttcagacatcatgaattcatcattgttacattcacaagacagtttgtgttcacaccgaaactaaaacctataagtatgtgagaagtgaccccacctccccgcacagtatgtgtcagtagttgtaccattcttgccaacttctgggctggcagtatggagtcatctccctatctttcattgcctgtgtgaaatctactttctgaattctgccatttccctcttcacactgtctcctgggttatctttgcttcctcacatccctatctctcttcctataaactggctcccgtcacttccatgatcccttcagtggcttctgagctggtctccctgaccccaaagcctcagccttccagtctccctacaaaatctcagcaagttcattttaggttaaaatttggacatattttaaatacggctcaccacttcatgtgaaaatgatggcaccctaccaagcagtttgcagagttacggtaactgtttcatgctaatgatgttattcatccagttacaattttctcaaaactcctttgggcactctttatttttaatcaaattttaaagccaatatttcattttgagaatatgaattaaattgggaaattcatccttgtggtacagtttacagatttttaatgtttacccatttatcctgttttttgatatattaatttcccatatagctccagagttatgtgatattatttctttgccagtatattagaaaatgattaatttctcatgaccaacttctgaaaagaaagacccaatgcaaaatgcaatctattacaattatttttttgaataaaaaagaatatattatagttctttaacatttgatattttaaatttgacatattcttgatatttgtaagaaatttccactgaatgaattttacacaattcagatactaccaattaactaattctagcctaaacaaataacattatttttaaataacaaaatctttaaaaataattttctattttgaacttttagccataatgtaagaaaataaaattttctagcagaataatcaaagagtgaaacaaagttccaacatgttttttctttgcaattaaacatggcacttttacagttatttattattcatatcagtgcacttaccgacttcatattttcaaatcaaaatacagtgtttttctccagtgaaatccttattctcatgactgatagaaaacattgccaattttgatatttccagagttaatgttaaattatttgaaagaaaattatttaaaataataaaaatagacatttcaagactatttcttatcacataattcaaaaagtacttggatcaaatcctacagagtttctccactaaaattctacttgtgcagagggcattgaaacgcatgaaaatcaacagcaggttagttaggttaattaattcggttaattaagcacctactacatgctcagctctatgctaggtgtcatgaggaattaaaaggacatgtaatgcacattttctgatttcaaggagctttaaatattattgtgtagaaaaagttaacatctatgaaaatagaagtggggcaattttgtgcttaattccatggtccagatacatcaaaaaatcaatgtgggctgtcaaagaaggtttcttgatagtcatgagtcagcctgattcttgaaaggatatgtggaatataaaattttatttatattccttttgagaaaatactgagaaaaccatcttccctggaaaagagaacgtattgtaaagaaagtacatgaaattgaaggttgaatatccaacatcccccacactgccccagtgtctctgctcccttactgagccttactattattcttcatagccctatcactacctagtctagtattcactgaactgtgtcatccactagaatatgagcataatgagagcagagactacacctgtcggttcagtattctatcctcagcacatagaatggtacctggcacatagcagatgctaaaataaaatttaaatgaataaattaattcaatcaacaccttcaaggtgttattattacctacaactattgtttacaagaggtatgcaccgtggaagatcctggagacacaacaatgaataaagccaagccagttcctgcccccgtggagcttgtagtcaagacattgaacaagtgatcagaaagatgttgactgctgcagcagagggttgcaagctgctcatgagtatataacaagtagccctaaccaaagcattctctcccttggtttaatgtccacccattgaggtgactgctaaatactaatccatgactctatcccttggcattcaaactcacacatccacttacctgcctctccaacctcatctccctccactcacaagagcccatcatattattcatcaaaatgaaactgcacccagttcttctgaacatattactttacaaaactttcatttatgcctggtgactctcatcaggcattcaaaagctttccctcagtgcttcagggctcttccttttcttccctttatacatacacctttatgtatcttcatacgtaccctgcataacctcatatatcttagcatttaccatattctgttgaaaaactgtttccatttctctttacttactagaatgtaaacagatgcacaatgttgagaaaatgaaaagtgacaactttgtttacaagtttagaaattatcagattctcacttaagctctagtctctgtaaagtccacaactactcaataaaagtgaagaaaaatgttaacagagagggaggaatcaaaaacaaagaactatttaaaaaaaaaaaaaagcaagtccttgaaacttggagctaatgactgtattagacaagggataagagccaagaagagttgaaaccaagaagggaccaagtagtggctcttttataccaccttcaaaattctccccctaattcttataggaggtatactaacaaagcatagaaactccaatccaagaaaattattctcttcctttctctattttcttttattttagcaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggggatctgccatatttgtgttggtttttattttcatatccagcctaaaggtggttgtttattatatagtaataaatcattgctgtacaatatgctggtttctgtagggtatttttaattttgtcagaaattttagattgtgaatattttgtaaaaaacagtaagcaaaattttccagaattcccaaaatgaaccagatatcccctagaaaattatactattgagaaatctatggggaggatatgagaaaataaattccttctaaaccacattggaactgacctgaagaagcaaactcggaaaatataataacatccctgaattcaggacttccacaagatgcagaacaaaatggataaaaggtatttcactggagaagttttaatttctaagtaaaatttaaatcctaacacttcactaatttataactaaaatttctcatcttcgtacttgatgctcacagaggaagaaaatgatgatggtttttattcctggcatccagagtgacagtgaacttaagcaaattaccctcctacccaattctatggaatattttatacgtctccttgtttaaaatgtcactgctttactttgatgtatcatatttttaaataaaaataaatattcctttagaagatcactctatctttggaggtttttcagtgtagtcagtagcccccaatataatttttatatctgggataaacatcagttataggtgccagcacaagaactaccattaggttttttttttaataaataaactgggagatgaggaagcaaaaatacagttaaaatcatgccacaaaacagccaactttttcttaagtctagtttcacagcatatatgcataacctctgtcaccaggtaatcttgctgctaaaacaaatacctctcaaagagttgactcatgtgcagaaattgccaaaaagaaagttcagcaaaagcccaaggaacaaaacacaaactccttctgtgagagtaggggatgggctcttaaaggttaaaggggcacagaaacagtggagagagaacagatctgaccaagggacagcacagaagcagagtcaacaaccagccacaacacagcaagactgttgagttcattcctcttaccctgtctacatggttgcttacagtcaagataaattacagcttgatctaaatgtttccatttttaatcaatctagtgattttcctacatacaaaaacagctctcaagtgagagctgggaatagcaacagttaaagaaaaaaagcctaagaccttcttccaacacatttttccctcttaaacaagaaaaccggtcttgtctatggctccccagggaattgtagaagaaacaggaatctctgacatgtttatgctaagccctggccctcaatttctacctccaaatatatatatatatatatattttctgggcctgcggaagccattaactgcagacaagatgtttgcccttttatcccaaagcctagtcctacccacaaattacagacacaaggaagagggttgatactgaagtttcactgaggcaatttctttgttctgttgtgataaaatttaccattttagacattttaaagtgtacagttcagtggcatggagtacactcagagtgttgagcaaatatcgtcactatctagttcaggggcccccaaccactcccccaacaactgggctgcagactggtacctgtccatggcctgttaggaaccgggccgcacagcaggaggtgagtggtgggcgagcattaccacctgagctctgccttctggcagatcatcccagcattagattctcatagaagcatgaaccctattgtgcatgcaagggatctaggttgtgtgctccttatgagaatctgatgcctggtaatctgaggtctgaggtggaacagtttcatccccaaaccatcccctcacccctccccaccctcatcccccactatccccacccatggaaaaattgtcttccaccaaacctggtgccaaaaaggctggggaccactgatctagttccataacatttcatcactcaaaaataaaccccatacctgttaacagtcactcccatttccccttcccataagcccctctgggagtcaacaatctactttctatggatttgcctattccggacgttttatataaataagatcatacaataatatgtggccttttgtgtctggcttctttcactcagcatgttttcaaggtttagccatgttatagcatgtgtcagtacttcatttctttttccaactgaataatattccattgtatagatctatcgcactttgtttattcatcagttaatgaacatcagctgataagctgtttatacctgtgattattgtttttcaatcttgggtgtcaaaaagaaactgtttcctagactattcatccactagtttcacagcctaaattcacccatttttagtttggcctttgactaaaaagaatagcaagtttaaaaaaattgttttaattcatggaagcaaaaacctggaaaaagctttgagaagctaatacatgagttcctttataggtgcaatcatcctcaataaacgtaaatatctcatgctctcttaatttgaaattgaaaataaatatcatgtctaaaaacaaatcaaagcagta

SEQ ID NO: 14145 - DNA, 61083 bp, Human; identical to SEQ ID NO: 14144

SEQ ID NO: 14146 - DNA, 15859 bp, Human
aggccggggcatccttgctgggggtaggaggaagcctgcttggggtgacagtcacacgagggtgacacaggccctgctggccctgagctggcctgcgtccagccacatcctctttcctgtgttccctacgccagggtgctggcccggccactgctcaccacttcctgctttgctggcccagcgacacggtggggtttccctagggccacacacaagccccttgcccatataatggccaaaagcagcccccctgaacttgtgctaagtactgtggaaggatttcacttcatttgcagtgagaaaaccagctccgagaggtgaaagggcttgctcagggccatgcagggcacatcccataataaaactcagttcagagaccttgaccccccccatccaccatcatttccaaaagtgctttttacaaagcactactttgtaaaaagctacttcttcgaaagaacaagtttcctggcccagtgagtgttggaaatgctccagctgctgtgtgcctgctggcaggtactgcatggtagacattcaaggctctgagaaggcctgcagcaaaaacaccagcctctcccagcccattcccagggagcttttctcaggtctaacacctgggcctccttcctagaccaggcattgccatctaatgccaaagtggccaggctcccgcttgggccccacagcctgtggcactggggtgagaagtaactgcaggaggcgaggggaagcctggagcccgggaagtgtccacaggtctggcccgcagctcatcttggccactgatgaaaacaggtgttctttccaaaaacaaggcaggcgcaggactcctgaagcaccgccggtttagcttttcccagacgtaaccgccgtcagagcgtggcatggagcctgtagctgtgcactgaatacttctattccaagcgggtcagtctttccagctcaccgctgggttctttcccttaccgtggtctcccaggcacttactgctgagaccccactcaggctgtctggttgtatcaggccccgaccctgtcagaacaggcctatggcgcccaaccacaagtcccccaattttctgaggaaccacagctgagcttggctgtgactcagtttccaggcccggctctggggctccacttgtccacccctgccgcagccccacaggcctgtgctcgctgtgtggggcttagggatcaccagagctgaagggcccctggcctccagtgggaatgccccaggcctgtccaaagtgcaggcagctggacggtcgtgagtcccagcttccaggcactaggacctgatgacgcccatggtgctgacctggagcaaggtcacagtgacacccccctctaccccccgcggctgcagctgcaggtggagctgacagctggcctctggccccagggtatctcccagggcctgctgggtgcggggcgctgggcagaacaaggcagcatggcctggccctgtgtcctgctgccagtgaagcaggcccagagtggggcagccacccacccaagggccagagcggggcctctccagggtggtcaagagcaggaaggtgtaagcaccggcgggtttcactgccgcccaagggaggggtcccggaggtgggggagcatcctggggaccccaagcccatgagcctgcgaatgttggggtcccatcagccagaggcgcacaagcctcgaagtgagaggagagcagggtctcatctcctatcctgagctgggcctgagcggagctgcccctgcatcggggccagcatagacgcgcgcggttggcagtggtctgttatccgctcctttctccaggcctcctctccgggattaagcgcctcaggacccgtccgccaggccacagcctgggctcaacctctcccagacttcctggactccagtggagccttgggccgggggcggggcgtccctggcccctcccccgtcgtcccgcctgcccggaaaggagtgagcggcgcctagtcccgggctggcgggagtgcagttctgagtcccgcccggcgtgcgcggagcggggcagccagcagcggaggcgcggcgcgcagcacacccggggtgagtgcccctgccggggtctgcggagccccagaatttcctgcccaccctcttccccctgccccggggaggagatcctggcgccccacccagttggctccgtgaatgcagctcagcccgccaccccgcagggtgtcaggccttgcggggggccacggaggatccccaagggaggaggagaaggatggggtgtttaccaacacagcccagcgttcccgggcctggtgtgcgcggagctttccccgctgctgcttccttggagggagggacccattctacagatggggaagctgagaccacacaactaggaagtgtcagagctggagaccagctgggtcatttgactccagagcccaccccatttggaatggagggggcgccagaccctctcctactgccttcccatcatctggaggggagggcagaggtgcagagagacctgctgggttcctggaggggccaggaaaggggcacagggtgaggagtgggctggagcctggaccccagggccgcaggatggaggcgtattcatttacaccataaaagtggctgggtgacccctggctagagcggggaccaagggggacaggggtagggggtgagccagtggagcctcacatgccaggcacgggggctgatcacgtccccacacctttccccccgcccattacaggttgttcccccaccccctgggaagtgctggaaggagcccggccctcgagccctcggcatagtggctgtgggagccctgatggccctgagccaggggtgacccctccccagatccccagagctgattccccacacctccttatttggccagcacagccccaaagggagccaggtcagacacaaccctcctctgagctcaccctttgtgctgggcacataacattggactttacctctccaagtgtcagtggagtcctgtatgaaacaaaagcaccgtaccccctccccaagggtttctccccccagggattagtgtgaggtcgtgtggatgaagggattcagttgaggctctggttatttttgtcacctccctagatcctgtctctgtcaggggtgccacgtcccattcacccaaagaggaagtagaggcacagagagggtgagagacttgcccaaggtcacacacccaatctcagcctgggctccaagtccctctgccctgtggccgggcctggtccttagggatggaacccagccccgctgccccctgccctgcccacctgcagccttgggccatctgctcagtgttccctcgttccctccttctctcctttcccaggctggggctggggctgcgtttccctgtttagagttaagtaaaccagacccaggggaggaagtgactggctgggcaggcggggccctgaccaggcctgtcccctccccctaattttcgagctaagcaactgattcccacagaggggccctgggccctgagagcagtggctttggagctggaggggccccagcatccagggcgggttggaggtggcctggcacctgcccccaccccacatcggccttgagcaaggccccgggcccttccccgccattctgtagtttcacttttgttggtttcaacacctggaaggctgcggctgctgccgggcggcccgggcctcaggggacagcccccccacagcagtgctccctggctagccccagggtacccggtggagatgcccgctcctaccactcagcacatgcagctccacagggagcagcgagggctccagccacccccggggcagccctgggcctaagtgcctgggccagtggggtcctgtctagggtgacggcagcccgagaggagggaggccagagtgaaggtgggggtggagccggtgtcactgggagacgctggaggtaggggcgggggtccccatgggcagagcaagccaggagagagcttgaggtcggcctgagggtgggcttcggggtctcccagtcccactgcttactttctgcgtgacctcagcaccgcatcaagcctgcccaggcctcagtttccacctctgtcagatgggggtggtaacagcagcttccaggattcagtgagtgaaggtgcacaggtgcccgtggttgggaactgtctgtggtctgcccctgactggcccccatccgtgtccacccacaggaccatgggctccatgttccggagcgaggaggtggccctggtccagctctttctgcccacagcggctgcctacacctgcgtgagtcggctgggcgagctgggcctcgtggagttcagagacgtgagttgggtgggcaggcgtgggaagggggctactgccaaggttagcccggaggccggtccaggatggggactgccccccctccgccatagggccctggccccatttgaaccccagcggcccctgccatgggcactgctcatgggaagcccgcagctgaggcccctgagctggctcctccccataccctcctggggcatggggtctggtctgtgctctgatctgcgtcttgtggctcccagggcactccacacctttctggaggaggcagctaaggcctggggagagtcaggcctgggctctagggtgaggagctccctgacccccttcccgggacactcacccctccgtgtggcacccacagctcaacgcctcggtgagcgccttccagagacgctttgtggttgatgttcggcgctgtgaggagctggagaagaccttcagtgagttggtcccaggcctacattccaggcaggcttcctggaggaggcatgggccaagtttgatctgaaaggaagagtctgggtttgccaggtggaaggcagagaagggaggtatatgcagggccctgcagggccaagacagagcagctgggatctgtgaagtgtgcttgcgaaggtggctgccttgtgtgggctgagcagagggcctagggcagggctggctggggaggcctcgaatacagcataagagcccaggacttcgtcctgtgggcgccaggaagccacaggggtttctaagcagggaagaggcacagacagctttctcctctacagctgggctggggtgggtggggcccaggatctagggtagggtacccctaaggagcaggcaaaagggacccctgccctgggcaacccctctcaggaggagcctgtgggggcaccaaggcaggggcatggggcaggcagggttttgtgtttgctggtgcagtttacagcttttcaatgatcaggcagacacaggactcacgccagctccggtcccaagccctgcagcgcaagggccggcctgtggggagacctcaggccctcttctgagtggtggccaagggactggggagggagagtgagcccagacctgagctcagggaggggagcacagcttctggatgaaagtttggccgggattttctggccacctccacctggtgaatccagcagctggtggccgatggagtttggggcagcaggtggggccctcaactgttgagacaacctcaactgcaccccactcccgttcctctgcgcccagccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcaggtcagctcccacccaggcaggagactggggggctggggaggggctgtccagcctagggctcatggtgcttctgggttcctagctggcagccgcccacacagatggggcctcagagaggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcccacagtcccaagccctagccctagggggttctcctcttctggtcctgcccgggaggcctcctgccttcccctgtgggcagggccagtgtgcccaattgcccgattgcccgtgctgggcagggtcctgcccggggggcctggtgggggaggcagggcaggaggttggagcagccctgcccagccccgtggccgccagctttgtggcaggtgccgtggagccccacaaggcccctgccctagagcgcctgctctggagggcctgccgcggcttcctcattgccagcttcagggagctggagcagccgctggagcaccccgtgacggtgagcagctggcgctgggctggggggtcctgggcagagcgggaccccagagtcagctgagcctgctctgcagggcgagccagccacgtggatgaccttcctcatctcctactggggtgagcagatcggacagaagatccgcaagatcacggactggtgagtcactgggaacacccgccccaccgccctgctccccaggcccctgctgtcacctcccagcccgccctatcgtgactcctccccatgagctcccttcagactcagagtctcgtagctgtgtccttctggcccctcacgcagcgcatcctccctccagcttccactgccacgtcttcccgtttctgcagcaggaggaggcccgcctcggggccctgcagcagctgcaacagcagagccaggagctgcaggaggtgggtgcccccggccttccggaggcgggtgtaggaggtgggtgcccccggcctcccggaggtgggtgcaggaggtgggtgccctggcctggcctccaggaggtgggtgcaggaggtgggtgccctggcctggcctccaggaggtgggtgcaggaggtgggtgcccccggcccagcccaccccacctgcctgcccagcccccgctgactgcccactctggcgcaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcggtgagcagcctgaggcctcgccccctctccgcccgcccctcctaccaggccggggcgtttctgcctcacttccagcctctggctccctgcacctgggctttgcctaggggctccttctcctcccagcctcctccatggcccaccgcttccagggagtctgccctgatggccctggcccagcaagccctaccctgactttcctaagtccctggaggctgcacaggatagttttaaagtcagaagcctcattccaatccaggcccccctgtgaccttaggcctgctcatggtctgtggaaccggtgtgatgcccctgcctccgggggtcacccgccgcgcacagcaggtgcttgcgggtgaggctgggctccttctcctgggccgtccctaggaggcagcatgcttgcctttcccaagcaattgccaatccatgtggtgtctttgggcccccaccagggcagagcagggctgatcatctcacgtcagagagaggggaaggggctgcccagtgagcccccacagggctctacatctccagctgggcctggctggagatcccagggtccctgaaggcccccgccaccgttctggtctgtctctgccctggcacccagatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccggtgagagccacggcatccttacccgtgtcctgggaggctcagctgccccactgggtgggtgtgagcctgagggggaggtatctccatcctgggcctggcctgccctcctgggatgaggggcacacatcccatcactctcaaggggctgttgggctctgcagccagtgtgaggctttatgtcggcccccagccaactcccccttgttgagtttacaagggagccggcacgggcttgtgcaaagaacagaggctgtgcggtgggcatggcccaggttggaagcccatctcgcctactttgagacatttcttagcttctctgagcctcagctgcctcacctgcaaaatggaaataatagcgcaaacctcagaggaatgttgggaagcttagtgactgttggagactgcaagctggagccaggggcagcctttggtgtggttgctttggttgcacagctttttttttttttttgagatagagtcttgctcagttgcccaggctggagtgcaatggcatgatctcggctcactgaaacctccgcctcccaggttcaagcgattctcctgcctcagcctcccaagtagctgggattacaggcacgcaccaccacgcctggctaatttcatatttttagtagagatggggtttcaccatgttggtcaggctggtcttgaacccccgacctcacgtgatccacccacacaggccgttgggggcccaagcaccctgactcttgcccactggatgaggcagggcccctccctgtcctgtgaccaagtcccctcccgacatgggctccaccacatcacacccatgctatgggccgggcccccactcagtgtcactgggggcactggggggtttgctgcttctgcagggccagtgtcctggggctggatctgggccccaacaggattcccctgcacgtgggcagaggctggtgcagctagagcatcacctggaggcccgtggcagatagaatgctgccagctcaaagcaccagccgtcggggcagcgtgtttgccagggaagctgtaacaaagtgccaccggctactggcttaaggggcagacacggtcccacagtcctggaggctggaagtccaagaccaaggtgtcagcaggggccgggggcactggctgatgcctgtgatctcagcactttgggaggctgtggtgggaggaggatctctggagtccaggagttcgagaccagcctgggcaacatagcaagcccttgtatcttaaaaaaataaaagatgatgaggtgttgtcagcaggagtggctccttctgaggctgtccaggaagatctgttcccggcctctctcctgggcttggagcggccgtcctcatcttcacacgctgttctccttctatgtgggtccaaatgttccttttcataaggacatcgggcacactggattggggcccactgtaatggccttatcttaacccagtgacctctgtaaggaccctgtctccaaagaaggtcacatctggagttcctgggggttgcgactccagtgtatcttttttggggtcacaacacagcccctgacagtgtgtatgttggggtcctcctgcctcccatgaggacttgttcccattttactgatgggaagtcgagacttcagagctgaagtgaccagctcggcctcccggaacttgccatgtgccagctggggctgcctgtggctccctgtcctctctggcttctgtgtggagctctgggaacagcaacagctgaagctgctaacttcctgtggctccagcagctggcccgtgctgcccgtggagaacttatgaagtggtctggtgttacctgcattttacagatggggaaatggaggctcagagaggtgaagtggctgggccaaggtcacacagctcctaagtggtgggttcttttttttttttttttttttcggagacagaatcttcgctctgtcgcgcaggctggagtgcagtggcgcgagctcggctcactgcaacctccgcctcccgggttcaaatgattctcctgcctcagcctcctgagtagctgggattacaggcacctgccaccatgcccagctaatttttctgtttttagtacaggcagggtttcaccgtgtgggccaggctggtctcgaactcctgacctcgggtgatgcccccccccccccgtctcggcctcccagagtgctgggattacaggcatgagccactgtgcctggctgctaagtgatgggttcttgactgcaggccagcagggcctccgtggcgtcttgggccgggaggcagatgctggtgtgttcgggggttcccagctcacccacctctgcccacagctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgaggtgaggggcggggctggggtcctgatgagggtagcagggccaggcagcccctcaccacaccactgcccccccagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggaggtgaggcccgggccccagcccggctgggggccccgcagcacccgcagccctgaccgccctcccctgcgttgccgcagtgatgcattcctggcccagcacacgatgcttaccctggatcccaacgtcaccggtgtcttcctgggaccctacccctttggcatcgatcctgtgagtcctgggatggagtgtccgtgggtggtgaaggcagctgggagtgggggctggggctcccctcggttcagccgtcctgcagcgctgtcgctgagcactcctgtgtgccaggccctttcctcagcacaagaggcagacaagcctcctgccctgcggagcctgcatcacagtcccctgagtgtgcggaggcaaagcgagaccagccaggaaccagtctcctgagtgtgcagaggcaaagcgagactggacaggaaccagcctgcagcttgcactgtgccaagcactgttcccaaccctctgtggaagtgattttcttttttcttttttttatttttggatatagagtctcattctgttgcccaggctggagtgcagtggtgtgatcttggctcactgcaacctccatctcccgggttcaagcgattcccctgcttcagcctcctgagtagctgggattacaggcgcccgccaccatgcctggctaatttctgtatttttagtagagacagggtttcaccatgttggctaggctggtctcgaactcctgacctcatgtgatccacctgcttcagcctctcgaagtgctgggattacaggcgtgagtcaccgcgcccagcctgattttctatttgaacctcgtaacaaccccgtgggcctcacattagtagtgtcctcacctaaagaagagactgaggcacagaggtcatgcccaaggtcacccaggctggcaccgtggcagctggcccatctgcgctctgttgcccctcggtgggtgggtgatggatgaggctgcaggctccgagggggaaaacagggtggtgagagagtgactcgggccggggacttcctggcagtgatggcgagggagcccctgagtccagcccacccctgctgccaccctagatttggagcctggctgccaaccacttgagcttcctcaactccttcaagatgaagatgtccgtcatcctgggcgtcgtgcacatggcctttggggtggtcctcggagtcttcaaccacgtgtgagggccaaggctgcccgggggacgggaggctggcaggccagagtgggccccagtgagcacacctccctcttgcccgccaggcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggtgggctgcggctggtgggggccgggctcacacggcctcatggggaccccgcggtcacagggccactgggagctgcaagatcctcgtccgagaaacggggatgcaggccccgggccgtgcagacagggccgtcagaggtgatggtgtgcatctttagcaggtggcacaactggcactgggaaccgggggtcccttccctcaggagtccttatggaggcagaccctcacccagtgagggcacggagcccccgggggccctggagggaggagcgaccgcaggctctctgggccccgtgactgctgtgactcaggttcctttgcaggtgtgcacagcagggacgccctgactctcgccctctccctggcaggaggtggtccaggccacgctggtggtcctggccttggccatggtgcccatcctgctgcttggcacacccctgcacctgctgcaccgccaccgccgccgcctgcggaggaggcccgctgaccgacaggtgggaccggggcctaaggtgtggggggctgcttgcggggagaggccactgtccggtgtgtccctgactcctcgcttcctgacagactcctgagtggccaggagcaggcctggcgggtggtgggggacctcctggggctggagtgctgccaacactgcctgctcatgccccaggaggaaaacaaggccgggttgctggacctgcctgacgcatctgtgaatggctggagctccgatgaggaaaaggcagggggcctggatgatgaagaggaggccgaggtgggtgcagtgccttcctgggggtgggacggctgaggccctgccggccctcactgcacccgccccgcagctcgtcccctccgaggtgctcatgcaccaggccatccacaccatcgagttctgcctgggctgcgtctccaacaccgcctcctacctgcgcctgtgggccctgagcctggcccacgcccgtgagtgacctggccaccgacggctggccccagctcctggcttctcacataccgctgctggctgggcgggttgcttctctctgggcctcagtttcccctctgtaaagtgggactgtccaaggaggtccctcgctggccccccgtgcagggagggcttcaggctgcggcaggtaggtagggggctggcaggcacccacttgccgttggcccccactgtctcctttgcttgcagagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactggtgagcgaccacccactggcctgggctgctcaaggcgtgagttcccctcaccaacccctctgcttctcacccccagggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggcagtgatgtctcgtctctcttccctcctttttagctgaggcaggtggcagggtagaaggcatggtgtaggatctgggacctcaaaagtcaaggcctggacctgagcagatctgcaataatgtcagactcttggggtgaaaaggggcagaaaagggccaaggagagatgtttccagcacattctaacttggagtgagcaaatgtcttcccaggccgggtcaggggagtgagctccccatccttggaggtgtgcacctggctgtgagcgggtgtctgggttactctctgttgggagtggtgccaatatccatgccctggtgccgggcctcaggggtctggaagtacagagcagtgtggggcacctgagccccggccagtgctccatgcagggccatggtgtcacacgcccaaggccacacacctgccaggaagggtagaggctgtccccagcagcagacattacccaggaccccggggttcagaacaggggctgagcctgactccaggcccagcctcccctcacctgagactacagtcttcctgatccctcccaggtggtccttcctgcgttgctggcagaatgggggtggctttctgcagttccctctggcctgggtcccacccccactgggaggcagaggaagtgcttcccagaagccaacaagctgcaaagtggttcttcccacagctgtggctgaggccagctgctgggaggagcctgtccattggctcctggactgctttgctcaggacctctggatgccaggggtcgtatcaggggctctaaggtaattccacatgcccagcagattcagcttagagaaacggtgctcacagtgctggggtaggagcagagaaggctaaatgaaggactccggagagctgcaggtggatctggaccaaatccagaacccaacgccttactccctcctggggagagagctgggcagagacttggggcgggcagtgaggtggggataggtgagcagcactcgtggtgagtggccccagtgtgatttaggaggggtgcagtgtgggatcccagggacatgaccagtcagccccgccctggctttgacatgggggtgcctggcagtggtggctagagaagtccagtttgccaagagaatggcacataaggcactggggtgggcacctctggggcatggacatagggagacatagggatggggtgggtcacctgcgtggaggactgggcactgaacagcacaggcccgagcccatccttgtccacgtgagcttatggcctgatgtagagaccaccaggggctccaggaaagttaagctgcatggagagaaacgatgggccagggccgggcccagggtggtttagggaatggcagtgtcctgggtagaataggaaggcctgagactgtgactgagctgacagtggggcaaagtgaaggagcccagtattggaagatcggctccacatgtatctctgcgaggagactgcaagcgagctcgtgtggaccaggcagaggcgagggctgagtgaggccagcagtggcctgggcacaggaagacggtgagtgagaagccactggagctcctgtgcaggagcgcaacacctttactgcttcattcagtttggcttcacctgcttaaaactgtaactctctagaaggctgaacagcaaaagcctccctcctgcccagccgctcagcatccccaggcaccagcactgctcccagtctccaacgtcctccagggctcttcgcttctgggctagaagcagggaaaccagagtgtgctggggaagaagaggaggaggtggaggagggctgatgatggggccacatgctgctgggatgccagctgagagcagcggagcactgctaagctaaggggctgagtgggtgcagatggagccctccgtgggctccttcaggtaccaggagccctgcctgagattcaggacacatccaagggtgacagcttgaggttgggtttttatttttttatttgtatagtacaatctct

SEQ ID NO: 14147 - DNA, 15859 bp, Human; identical to SEQ ID NO: 14146

SEQ ID NO: 14148 - DNA, 15100 bp, Human
tctaactattccttttgcagaattttccttcccttggctttcctccaaagttagatccttggaccatgttctttttgtccaaattttctctcccagtcatctcattcactcccatagcttcgatttttatctctgtatctgactctccagtctaaatctagcctccagcctctttcaggtttttgtccaacatttccaactaccagcagaatattttcatttgcatgttcttccaccgcctcacactcagtatatctaaaatgtaacttagaattttctttcaaagcttgttccttcttatttcttgatttgcactaacagttacccctcctatttaaagaattgtaggcgtctgtgacttcttgcttatatccttttccttcttccctactggtcctactttaggcaaagttcttgttgcccgactgtgatttttgcatgatgttttcagtcatctttcaaccatcttaaacaccagtcacatatatcttattacaacatagctctcattatctctctcacctattgagtacatccatctgttccatctttacgcacagcccgtgacctcagtgtgggctcactcccttgtcctccttgaaattttctcttgttcaaatctatgaaaaatattacattcaaggccgcacagacataacatcttaaacctcttcctggcattgttcccagccgtgtcttagcttagaaaactacctgaagtggtttctcttccagaactcctgtagcacttattagctacacaccttagttttgaatttgcaaaagctatcttctgttatctcttcatgtggcctacctttacacaatggtctctttagcagatatgaagcctatttttttttattacccaagtatctagaatagtgacttttatataatagatttctctgattctataaatcctcagactagaaatatttttccaacatactaccatcatattatagtagtttatagtgtaaaattttaccattccaaatagaataacgaattttgtgtttaaaaggaaatctgcttcacagcaggcctgccaagccaacaaaagtagtgttgttccatagaggaaaagacttaggctagaaatttggagactgtcactggtcactgtcattattgtcacttcacctctgttagcctcatttcttcacctgtaaaatgcaagactttttaagcagtcttttgaccctgttcgagctatatcaagatcagttaattcagtctagagaaggaccctgttatattatacacttatatataatatatacacaattacatactatgtatacaatatagagaacagaaatcacctttgttataaaatatctagtacacagataatcaagtttttaaaaagatccagaaaaaatatctacctctaagaaatactgaattttgaaatctgaagtagcccagtttacccgtaacctcatgggagattttcttctggaagagaggtaacagaagtgcacctgctgtatttaccctgctagtcttaagaaaaagtgggaactatttaaagacttagataatctattttataattgtgaatatgcttgcacttctgtaaaataaaagcaggtttcctggaaaattaggcttttcttcattatatatgttgattcagccctatcgaataagaatttctatttccttatttgagttgtcaagttgtccatactgaacttattcccatgcaatagggttttatgggaaaagtctgcctgtctgtgactaagcaccagagtagataacgtaacaatttgttttacttcgggaatgcattttaaatcaggaagagaagtttctgtcctacttgaacccagcttcactctcctcctgggcgaaagctgagaggcctaggtgtgcccagctctcagttaactgaagtcacgtggtggtggaccccgcccccagggcccggttggctgtggccccgcccccgagccctggggtcggtgcttgctgcctgcggctctcagaagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagcatggtggcacatgatgagactggaggtctcctacctattaaaaggaccatacgagtcctagatgtcaataaccagtccttcagagaacaagaggtaagactttaagagaaacgttaggcaaaaggaatgttttctaactccacggagcttttaaaatttttaacaaggtattaacagtataattttaaacttttgatcttattattacaatgtatgttcttgatttatgtgcaagcttgaaatgtgtttagggactgtggtctaagtttaaatagtttatacatagcatagcttgagtgtacacagcttttataaaaaaggaaaagattttaaatgtatatgttactcgggttacgtttgtcacatttctgatgcttaatataattgtttttttaacttgaattgatatcatccagtcttagaaactaccttaatggagcaagaggaaaagaatcccgttcttgtaaatcaatgctagtgaacaaattgcaactaaagtttagtctgacctggtgtgcatttttcttccatctgatgagttcattgtatgccacttttttcttcagaaggaaagaggcatgttagaatatttaaaccagtgactcattatttttaccctccttgctttgtctgagtctttttttagtctttatgaacatttatcaatataaatcaaattactttatgccattttacgtaatcttgatttaacattgtgtgatattctgtttatactatatactttaatatatactacattgtcacttatatgctaggaatagtgttcctgcattcagttaactgtgtatctcttgattgtggtagtggtttccgtctctatacacacgtcaaaacttatctaattgtgcattttaaatatgtaaagcttactgaataccccagcaaagttgcttgtcatgtgtacacatacacacaccttttggtagttaaaatagctgccgtcttcaggaagtacacttttatttggtgtggtttggctttggtttttgttcttggttttggtctttgcctatgtgtcggttttctcaaaatgtataagcatttcctttgagtagagcagtcatccacagtcactagtgtgaatcctgcagcttatcatctgttgggcccatagaagctggcctttgtttagtatcagcatgggctgtgtttctgccttacctttatttctaagttacaagcactaggaatgttgtcacggttttagatctagtgacacagctctaaataatttgagtatttctagaaaaggaattcatcccatgtgatcataactcgtttttatctttttaaaaataacttttattttcttttgattttaaagttttgctaaagattttaagagacgattatttaactattataacccaaaggaatagacccaggtgcatactattttttttattcagtgtcttgatatgattggttatagaagagaccctcctaaaatatgttctctaactggcatcattagaagaaaaagcctttctacagaatgctgacttctcaacaggatttttccatgtcgttgcagttagctgtaaggcataacctgaaaaatactttaacttattctcaacaattttctgtttatagatgtcgagaaatttttaaggcataaaatctaactacaagtggattactaacattaattaataccctgatctgtggacagattgcctataataatgtatgtgactgcctggctaacctagtctgattaaaaattaacctaaattgacaacataaacttatgttagagagtgttggactttttttccctccaagtgaactttagccctggtgaaaggttccctgcagcagaaaattcattgagcatgtaaagcttgttggcattttttgtttattcccatggatttttggatttttttttttttttttttgaggagagtaaggttccagtattcgtatctgttctttaagcttcttgaatttgccataacgtgtttccaggactccaaagtaaaaaataaacaatcctagcagtggaactatgggtgccttccatttggtggtggtgagatagaaagcgcctgttccactcccccttcatcacctccaaatgctgtgtctggcctatctaaatattgtattaggaatctgttttgtgactgcaaatatttaggttcttaatagtcaaatcaagattattaagatagttcatgtggacctctaaagaaaactacttttggtttcggctcacatgggccaatttctgacgtgtattccgaaagacacaaatttttgtcccaatcttttaggtggcctgtgaatgcctaaaccatgtcacttttccacagaagtttcatgtatgagtctgttttcaaatagtatatgtatcctgaaattagtagcagcattatacctttacatttcataatcacacttttcgttattttagtcattaaaattgttcatacttttaaaatatatatactaaaagtttgttttgtatttgccaaacattcttcatgtatgtcctttgagtgaggcaggaaagttatccaccatcatccccaaaagcatgtgaaaaagtgcaaagtgccctcctcctttctctccctctcccaacctgtatttcctgagtaagcatcatacttcccaagacatcctagatttgataaactctgaaaagcagcatttcctttgtggagaagtgggattatagttggatttttaaaggactgtggaacatatttaaccaccaaataccacttggcataatatgctgccaccctaaagagaccacatcaacaaaacccgtgttcgtttcagaagtatgctttagatatatctacattcacttatctaaatctaaattctgtagttttaaaatatcacataattttgagttaccaggaagttagtagttgtacagtaactggtcctataaagataataaatttttatcattaatttgattttatgtgataaaatagatatcaaaaatttatttcctgctaacaaaattttcctttcatattcactgggaaaagcacctttccaaagaccttttaagttgaaattaaatattatattttctgggaagtcaaatttgttatgcatgaaacaaggaagaggagttaacctctgttcccaaaaagcggaacagaactttctgacaactgctttgttccagtgaaatgtcggcatttcttactctgtgaggtaattctatcttcagtccaacaggagactctttgtgctgtctttactaaatggaaaggaatgcctgtgctggcccctgcacacgcgtgtgtcagtcagcacagatgtacgtgggggaggcatccacacatgtcctcagaagcacagcgtgtgccatcttattacatatcgcgaaggtttcttttgcagttagtttatattcaaagttttactttggagttgattatttggtatgaggggttgatctacaactctgcctcttaaagccttcagatttccaaattctttcattatctaccaagtttccttaatagttcacattcctttctgatacatatgtatacatttaggagctttaatgagtctaattgtttctttggatattcaaattatttacatttctttccaaataatgttaacttttcctatcagtttattcttaaataattaattaaaaaaaatttttttttacccaaaccaaaaatggtcaatatagtcttcagttgtttaaaggcattatttttactcattttctacaccccttcctttttatattactttagtcatgtcaaagaatttttagaaaaagttgcttcttctgttatttttaaatgatgtcttatttttcagtgataattttaatataattttaaattatatatcctcctggattctcatcaaaattattttgtcaagtatgccacaattgtcagaagcacaaaatacaaatagttatgctccatagacataaagaatagacctgctagttttatgatctggcattcttcatttcagtaactgtgtgagtcacctactggtatgcctccatttttctagcgataaaattagaataatgcaatttttgtaaagtttcaaaatccttgaataagtgatgtgtttgctatattattatttaaaagcaataacatgtagaatcataactatttcttctcgatttgtatatatctttcctttaagttaataaattactgtttgagagaggatctaatttatctatgaatcccagtgtttatgtagtaaatggaaatattcctaaaatctgttagtaatagctcaaactgagtatgtgccaggcactgtttcaagccatattattcatttaatcttcacaacaacttcataagagaagtgctacttttagccccattttatagatgagaaaactgatgccaagggtgtgccctagcaagtggtagagccgggatttgtgcccagtcagatttcagagcctgggtgctcttttaactcctccctgccttggcttcaatatttttcagcccattccagtgtcagacatgttgattgaaaggttgtattttctaacggaagtagttaagaatgaaatgatacaatgtctgagatttgctttaaaacatttaagtagggacaaaaatgaaacaaattgttataccagacactgtggaggcccctcgatagacacatgggatccattatgccattctccactttcatgtatgttcgaaaattttcataacaataaggctttttttttaaaaaaaaaaaaagttattccctgcattaaactgaaaagttcattagattttaggatgtaatttccttgtttgaattttaattttttcccctattggaaatatttgactggcctttcttacacacttattttttgaaaagttactgctactcaatagagttcttattgttttgacaatgaagaacaactcttactttcatgtttctgtattttataatgtacaaaaattgttttgtgagagggctttactttgtccaagtttgtatgaaatcattgcacctagacatatatttagtgtcatctggtttgtttttataggagccaagcaataaaagagttcgacctctggctcgtgtcacgtccttggcaaatttaatctctcctgtaagaaatggagctgtcagacgttttggtcaaacaatacaggtaaaaagagaggaggaagagtaatgtagtcagcggactttatagaagcctggaatttgtagttgtctttgagctgtacaaacaagtttgcattattatatttaaacatagttttctttttggaatatgctagtaaggaatattgttccagaacaatgtgtagcctcattatattaatttgcatcttatattaatttgcatcttataatgcatagtcttggctagtttttattcccaaaaatgtaattttagctgataaatatttaagattggtaggtggaaacttggataaattattgttttctgcattgagaaattctcagaactttgtctttcttcactttaaaaaaaaagaaaatgggaataattctatttcttccaaatcttattttctcttttgttcaccttttcttttttaagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggtatgctggcactcagtgtacatgttttcccaaaagaacagcaaattgatgccgatggcaaaattaacttggatttttgtgtttgagcaacaattcctaatacatggtgaacaaaacctaatgatgggtggtggtcaaattaaacaactctaatagggtaaacttaccaaacatacggcaaccttgtatttgagattccattctgaattacaattttcagactgagttactttttaaaatgccgttcaaaacatcaaataatgtaattatcagttgtatataattttcctttctcgaaggaatgacctctgatgtttgctggatgtttttaggcaatatatgaaatgtcccgaggtgaacaggatttaattgaggatctcaaacttgcaagaaaggtcagtaaataactttttatcagatgccctagtttttaaaaattacatttcacaaaatctaaaggatagttttcttaacctttagaagtagaagaatagaaaatatctactggtgaatacattttttttaggtgaggtctagacacatcctcaaatacaagtattagtaagagagtttatttggggattaatacatactaatttattttatgtgtagcaaacagaatccacgctagcttttatgtaattaattctctttgtttccaagtatagatccctcatgttttcctcacatgatctctctgtgacacatttctcccctctgacaggcctaccatgaccccatgttaaagttgtccatcatgtcagaagaggaactcacacatatatttggtgatctggactcttacatacctctgcatgaaggttagatgtgccacttaattgtcattaaatctaaagagcagcggtgcatgtaattttcagtctaaacttctaatgtagtgctgacctattttttaaataaacctgttaatggtgtttatgcttttttatcacttcagatttgttgacaagaataggagaagcaaccaagcctgatggaacagtggagcagattggtcacattctcgtgagctgggtatgtagtgagttgttgaccccagatacagtttcttacagatgtgccatgttgcagtttctgatgaatatgagacagatttgatcccacaactctgttctacaaacacataaggcgttaaaactgaacaaatttacagtgacataagaagttacagtctgtttaaaaaaaaaaaaaaacaccttcattaatgctataggttcatttgtgttacaaatacgttcctgcttggatagaattcccacatcatgtgtgattatccgttgcattctgtcatgtatgtttaagcgcatgccaaatgcggggcactgtttgaggaggagtcgctgggagtcagtgatgaaaggcagtctctgcctttatagcctagtgaaggaatagccaagcacataaacagtctcagggctggtggcaaatggaggacactcaagtgtcctgggagcacagactgccagtgtctgaggttggaggggagtagaagtcatgaatcttcacttggatttagccaaattatgaaaatttgaagagcattttgatgattgctaaaatgctattcagcttccattattatctgccagaaaatgtccacagcttgttaaaactctcaagaatagctgtacattttgtgtttcatgtttgcaggcttgttaatgcactcggtcataacaggaacacatcataccttttcttttattactcttcagttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctgtaagtagtcccttaagtgattgttttgttttttaagtttatacattaggctgctttagaacgttatcttctgaagatgctgattcacatcagcatagtgaattgttttgttgttttaagtacccagtgcgttagtacgctgtgcactaagcaataaggagctgtgtatgctggacttcgcacattttgtatcttaagggacaggattctcctctgatctcaccttgtcacctttgaacaaatcactcaatttggctaggactgtttcttgatctataaaatgaacagactggcagaattaactgatttctagagtcccttcaagctttaaagttcttccattccatatgacatttttgctctgcaggaagcagaatgagttaataaactgaagctgctctgtcaattttatttatcattttcagatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacatgtaggtgacttttgctgccgtggcagagcagccttccctcctgcctctttaacttttacacgtttgttatgaagcaggcttgtaaagggaaagtcatgacatagtaaaagaaggttgccaattttaattttatattaccagcttgataaagccaacaaagaagataccttaaatgtctcagtggagaatcagtaatactttattttttagtttcgaagcataaatcaacttgttaggccaggggttcctgtctaaatacagtattagttccataatgcttaataaaaaagcatccttcaaaaaaaacttctaagagtttatcttatgcttatgaaagtggtttttcgcactacataacaaatttctgaagcagattgaatgaatgcaaatgtattttttaaatgctaattataaaagtacctgctagaactaagtgcagtcacggaatggtatttttgtttcatcatgcattttcaaaagcccaatttataagttggagttttgtttaaaaaaatttgaaatctgacatctttgatttttccctcacgaggggaaaatttataaaggtataaatttgtgtgggacaaaatagaaccattaacattttaccagcttgcatttttaatccctccttcgtgttagaaaactgtggtatacaacgctagtgtttcaagtcatgttgctactaataggtctttgtgatgcagagcattcacttagctgctgcttaatctgatattacataccaataagaaacattttatttattctgagattggaaaaactttccaaatagaacatgcttagccttgaaattgccatctttatggattactagatttgtcacttagagagatcttcgaaaaataaatctgatgaaattaataatgtcgagttattttagcaatatatttcagtcacttaaaaacacaagtttcctatttagcgtttgtttcccatttctccagaaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaaggtaaaatgcagtccttcaataatttaaagaaatagaagctcagaactgaagtgaatttagttttgcctttaagaattctagagatgaaatggctccattgtcctatacttgttacatccattgagttgtccaggccttcccagctcgaacacccgcaggtgtatctaagaaataatgcataggcttaatgtattcacattgacataaataaattgccataaattgacagtcacgttaagattgtatgaccactttgtctagaataaacctttttttagcctgatttcttttttttttccaattttttttttcagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgagttatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatttttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactattaaaaaaaaaaaaagcacacacataatcaccttgaaggtttcttgcctggtggctatgttgggggcatttggcaaaatatgctggtgtggcaaaggaggtagtggtaagcctcataaaagttagtaaaaattgtagttcaacctttgaaatcattgatgaatcagcgaaaggtaggtaagtcttgtgttaggaaatcttttaagaacatggtgtaatcagacacagcaattgtattgaaaataactgaacacctgttactttctggataggatagtaagggtagtagtggcaaaggatcctgattaatttcagattttaatgtaagtacctcaggttcttgtctttggaaattcacattcataagtgtatattacaccaatgattgtgatctgcaacaccagaaagcaagatttctaatcatttccagaggtgttgtatagaatagttattccagagttaccttgatcagcttctgaagtttaagaagcaagtaatagttcaagtgttgttaatggaattatgttttatttaaaaccgtatcttcttttggttccctcaaaggtaaaaataagacccagaatctgagtaaatctattaaatgaatgttcttcagaaatagcacctgtgtttgagagcattcagtgatttagcacattagttctcaaacttctttgggtatcacaatcactagaggtgctttaaaaaaaaaaaaagtaactgggcctcaccccctaacatacccgctgcaaccccatatacaccatgttactgaatccagattgtggggcgtcagggtagagggctgattgtttctgttcgcaagcatccctcctagcaattccagtgctgtgaattccttggatcagcattgagtattcactcatctattatatatcagccccctttgggtaactgctatataataagtcaacatgtatccaccatattcctagtttttgccttaacctgttccgagtcagagctgaagagaaatttccctgcctttttacctttctccagtgggtgtgcttacatattttcagcaaagaatagtctctgccctgaaaatcttcttaaacttcatggtccgtctcaggatgtgtgtatgcacagtggtaagggaaaccaggtcatcttattagccatccgtggatcacaggtaaatcaccctgggatctatcaggacacaactgacccatcagatgtgttcagcgacttttgtggtagctgggtctactttgtatttaatgcttttctcagtatgcagacagcat

SEQ ID NO: 14149 - DNA, 11490 bp, Human
tatgagcatgtttctttcttttctttctttttttttttttatttaaagagagagggtcttgctctgtcacccaggctgaagtgcagtgctcagtgaactgcagccttcaattcttgggctcaagcgatcctcctgccttagcctcccaaatagctgggactacaggcatgcaccaccatgcccagataattatttaattttttgtacagatggggtctcactttgttgcccaggcttgagctagctagcttgcttgcttgcttgctttctctctcttcctctctctctctctttctttcttttttttttcagagtcttgctctgttgcctaggctggagtgcactggtgagatctcggctcattgcaacctccacctctcgggttcaagtgactctcctgcctcagccttctgaatagctgggattattggcacatgccaccacacccagctactttttgtatttttagtagagacaggctttcaccatgttggccaggctggtctcgaactcctggcctcaagtgatctgcctgcctccccctcccaaagtgctgggattacaggtgtgagccactgtgcccggccaagcatgtttctaagaaaagggcaaacaattctcaaagaggcccctaatatctaaaattggtttagaatccctgccctaggtgaatacaggaaacactatcaaaactaaaagggaacttgtagggcatcttaatcaatcaaccaagataggtaccaaggcccaaaaccatgtagaggcttgtgcaagatcacaagcagaggtgcaatttgaagctagattctcccactcttaaactagtgccggacagacgaaggcctagcacatgggctacggagccctagtagattcctgtccccacactgagccaggaggggtcgctgcccagggatacctacagccatactcgagctggacaaggcgcacgctctttgtggaagcaaacacgtccaccaccgcgtagaggggctgcgcagctggcagtccccgggcgctcgggcccatgtcctcgccgttgatgatgatgtgcatgtcggccgtgccatcggggcgcgggcaaaagaggacacccaggcggctacggcgcgcggtcggaggcagcacgttcagctcatagagctggtccaagagatggctgtagagccctggccggctgcggcccaccaggcggtcccggggaatgcgaaactgctcaatgcgcagatatggttccacgaggagggttggaggtcggctgggggccgctgcctccgcctccgggcggccctcccggggcacgcggttgtggtggcgcgtgatggcgaagacccaggtgtggcccaggttgaccagatcgggcagagaaaactcgggaacgggggccagactggcggggtccagcgcggtcagaccgagacgcagatgtccgcaccagcccagctctttctcctcgatctcgaccaggaagacctggcccggggccagcggctcgcggctgaagcacacgccgtgggcgaagctctccacgcgtgtggcccgcgtcccagaggggtccacgcggatgttggcaccgtgcacccgatggaagcgggtgggagggggctccgggcgctcgagtccccagagtgcacccgaatccacgggctcggaggcagcagccatctctcggccataaggcaggccagctggcgccgggggctattttgggcggcgggcaatgatggtgaccgcaaggcgaccttgtaaggcatttcccccctgactcccttccccgagcctctgcccgggggtcctagcgccgctttctcagccatcccgcctacaacttagccgtccacaacaggatcatctgatcgcgtgcgcccgggctacgatctgcgaggcccgcggaccttgacccggcattgaccgccaccgccccccaggtccgtagggaccaaagaaggggcgggaggaagactgtcacgtggcgccggagttcacgtgactcgtacacatgacttccagtccccgggcgcctcctggagagcaaggacgcgggggagcagaggtgagctggcaccggaggctggaggggatccccgagcccgggatcggtgcgcggcagaggaggctcgcgggtgggagctggcgctggggccggggcttccctcgcggaggcgccgccagcaactccccgggggctgctgcacggaagcgctgaggagcgagtcaacagcccctctgctgcctcccgtagatgatccgagccgcgccgccgccgctgttcctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtctgccgccctgccttctgggcgggattgggagaagagatgacggatgagggatggggggtagttctgcagacccctgaggatgcctgggagccgggagggctggaaagggcccctccaactgcgccaaccctgccctgacccccctcccaggtttgtggagtcccagaaggatcccgagaacagccctgtggtgctttggctcaatgggggtcccggctgcagctcactagatgggctcctcacagagcatggccccttcctggtgagtggacagcagggggaaagcacagttcccaaagtaaaaggctggggaaagcgagagaggggctttgtgattttccaaaaagtttccttccttctaagcctcgggattttcctctatgccattggctttgctgcctgtacctctcagaggttttacccacatgtaaagtgcctctcatggtggccctttccctccacccagctggcccttgggacttactcagccatctctttcctcctcaggtccagccagatggtgtcaccctggagtacaacccctattcttggaatctggtatagctggagctgtgggtgtgtctgggcacttggatggggtggcatttagctaatttttccctcccctctagattgccaatgtgttatacctggagtccccagctggggtgggcttctcctactccgatgacaagttttatgcaactaatgacactgaggtgagtctggtgcctgcccatctgccccaggctccccggtcctccatccatggcatgatgctgggagagagagcatggccttggagtctacttttcgctctgtcatatgctattgtggtatggtggccagtcacttcctcttgcacaaatagggtgggttaatgtcattatctctgaagttctttccagttcaaataccaaagcttcctgattccctctgtcttgctctgccatccccaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggtgcagggtagctgcaggagggaagggaggtagcttgaggctgtggccttacagttagcaaggtcagactgactggtcaatgtccccatccaacccagcttcctgcataacctccccaccaccggctgccctaggtctgtctgtgtgcctcccacacaggaaactcacctgtcaggctgccagctctgtgttttgcattgagtggcctctcatacccaccggcctacataaaccaccctgggtttcagcttccggattgctgaaggtctgggtggtagggtgagggaggctcttcctttttgccctccacatgagctgagcaccctgggtgtttcacaggggctggctgtgggcaatggactctcctcctatgagcagaatgacaactccctggtctactttgcctactaccatggccttctggggaacaggtatgggatagggcagttgggcaatctctggggtgaggcaggtcacatgatctcgggtctgtcctccaggcacatgatatgacaggcccagcccaggtttatgagcagcaggtgggttgcagaaagaacctagtgctgaaaggccaaagaatagagatcagtttttctttctttctttttttttttttttgagacagattcttactttgtcacccaggctggagtgcagtggcacgatcttagctcactgcaacctccacctcccaggttcaagcaattctcatgcctcagactcccaggcagctgggactacaggcgcgtaccaccacacctgcctaattttttgtatttttagtagagatggggttttgctgtgttggccaggctggacttgaactcctggcctcaaatgatcttcccaaagtgctgggattacaggcatgagctacagcgcccagccagaaatcagattttaaaggaactaaggaggcctgtctgtatgaccctggggcacctctttgggagctagcttagatgacatacagaccacaccctgtgatatctttcccagtctcctagggtcagggaggttggtgggaggtggggggtatgctcgcctcctctgccttcctcttcccaccagcagctgatgcgcttttcactctcatctcctacaggctttggtcttctctccagacccactgctgctctcaaaacaagtgtaacttctatgacaacaaagacctggaatgcgtgaccaatgtgaggttctgccatcactttgcatgagctctcccatccctaatcctgagaacaggaccacattccctccttggggactccttgttctccgtccctcattgctttcttgcacctttaagcaatttagtgttctctgggacatgtgtctaagtgtgtattcccaccaccacctcctatggtggcaaatcccataacctccgtgaggagaaaggacttcttcacatttatcaaacacctgcaatgtggcaggcactgtgctgaactgtgtctatgtagattatttaagcttcaagattccccctcaaatgagatcatactacccacattttccagataaggaaactgagggctatgaattttgaaatcactgtctgaagtcacagtgttgggaggcagtgatgctaggatttggacccaggtctgggaagattcctgccactgagcctcagtttccctacctgtgaaaaaaagtgggtgaagaggtgaaatccaagagcagtaaatcttgggacaacttggtggggtcgtggagaggccggggatctgtaaagcatggtggcttggtgtatcattgcagcttcaggaagtggcccgcatcgtgggcaactctggcctcaacatctacaatctctatgccccgtgtgctggaggggtgcccagccattttaggtaggtgctgctgggtgcccctggagccaaccccagccccatctggaggctccacacccattccccacctcacattgcaggtatgagaaggacactgttgtggtccaggatttgggcaacatcttcactcgcctgccactcaagcggatgtggcatcaggtgtgcaagggcgtgggcttcctcctggtgaggtgggggcagggggaggggcagggaagcagaggccctgacccactgtctgtgccttccaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaagtgaggttctgtggccacctgtgacttggggtggtgggttgctggggcttgtgggcatcggcaggtttctcagggatcttctgtgtagagtttctcaatgagatgagctgtagaggatgtttaacatccatccctgacccctcagtggattgagagtcagccaattcattcttttatcttttttaaatttaaaatttttttgtttgagacaaggtctcactctgtcacctaggctggagtgcagtggtgtgatcatagctcactgcagcctcaaactcatgggctcaagcaatcctcccacctccccagtagctgggactacagacgcacaccaccacccccaacaagtttttgtattttttgtacagatggtgttttaccacattgctcaggctggttttgaactctggggctcaagtgatctgcccatttcagcctcccaaagtactgggattacaggcatgagccaccccgcccagccccatttcattacgtagccacattggttgttgtttcacagttcactacagcctcaacctcctaggctcaagcgatcctcccaccttagtctactgagtagctgggtctacaggcacatgccaccattcctggctaatttttaaaaaatttttttgtagagacagggtctcactatgttgtccaggttggtctcaaactcttggtctcaagcaatcctccctccttggcctcccaaagtgctgggattacaggcgagggtccctacacccggccatcacattggttaataactattacttccgactgggcgcagtggttcacgcctgtaatcctagcacttttggaggctgaggtgggggaatcacctgaggtcaggagttcgagaccagcctggccaacatgaagaaaccccatctctactaaaaatacaacaattagccaggtgtgctgttgggcacctgtaatcccagctattcaggaggctgagggaggagaatcgcttgaacccaggaggcagaggttgcagtgagctgagatcatgctactgcactccagcctgggcaacaaaagtgaaactccatctcaaacaacaataacaaactgttaacttccatgtccagtctcctgtggccacccccccccacaaccccaagtaaaagggtaacactgggcccagcagggctgctcaggtccattttgattggtcagtgctcacactctaccctgttgtatgttgtgactcccacacctgctggcccctagacactaaatgccagatgcatcccagtcctcgtaacaaccaaaatgcgtcccttgtacatttctttttctttttttttttgagatggagtcttgctgtcactcaggctggagtgcagtgctgcgatcttggctcactgcaacctccgcctcccgggttcaagtgattctcctgcctcagccttctgagtagctgggactacaggcacgcaccaccacgcctggctaatttttgtatttttttttttagtagagacggggtttcaccatgttggtcaggctggtctcgaactcctgacctcgtgatccactcacctcggtctcccaaagtgctaggattacaggcgtgagccaccacgcccagcatccctgtacctttctaaatggtggtgagttgaggctgtctgaatcccagcccatccagcccaacatccaagtcagtcctagagaggtggcccccccccaaaaaggggagtggaacccagctgtctgccttctgggttggagcttggagataggagagaaggtctgatctgttgactacttttcgccccgacctggtcttcctggggcctgctcgtatgttcccggcagctttctggtaaacttacagtaccgccgtctctaccgaagcatgaactcccagtatctgaagctgcttagctcacaggtgagtggggagagcacagctggatcaccagcagccttaggaccccagagtagcacagcaagctgggggcccttgagacttcctgtcaggacaagggaagctgaaactccgaaaggcgaagcccagggtcctgtgattggtggggtcagaatttgaacctgggtttgtccccacccatgctgtcctgctataggaggcctaggggtctgcatcagccacggagtcttaagggtgagaagagcttcattcatgccaaaaatgggccagcagaggtccagggtgggaggagaccttgcacaaggtgatataggaagcactggcagggccaagttaggactaggttctgtccagcacagtggttaatagcatgggctctggagtcacatggcctgggtgcaagtccctgtactagccacataatcttgggcaaatttcttaaatatgagcctcaggttctccatctgtaaaatggggataataatgatatctaccttcacagataaaacatttagtagaatactggacatgcagtaagtcgttagaaaacatgaaaattccctggttcgtgttatctagcttggccccttgaatttcctgaggggtaggccttgaactagggaagggctggggactgggcttgttccacacccctcatttttaccccatcctgctttagaaataccagatcctattatataatggagatgtagacatggcctgcaatttcatgggggatgagtggtttgtggattccctcaaccagaaggtaaggtagagattcctggccctgggataggggctgctgtggaggattgggagcgggtatgcctgggagtggccagctggctgcctggctctggcccacagagggcaagtgtggaggaattcccagccctaaggtcttgctggtagctgtgagcaaggatgcagctgctgtaggctgatgtctttcctggtggggcagatggaggtgcagcgccggccctggttagtgaagtacggggacagcggggagcagattgccggcttcgtgaaggagttctcccacatcgcctttctcacgatcaaggtagggactgggcctgctgagagataactgggccggaggcaaaggagcaggacccacccgtcctttccctctggctgccttttaggctgggtcatgggtcaccatctggcccctgtatgggcaagtttttttggagaggggtggggagggttctgggaagaataaagggtttgggatgaaggaattgcccccgagtgagcagttatatggggaggagggaatggtggggtcaggagctcacgaacattgctcctcagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaatcccgtcttctctgtggcactgggggttagagggggcactacaggctatgaatgtgggaaaagaggggctgagaggggttggggtcctgaatgacagctgccagcttggggattgagggctcagacagctgctgtggacggtgtgggggcagtggacgccctgacatcagcaggccggttcttctcaatcacctctcgcagccctttggcaaagtggagatcagccccgatggtgaggaatccctgtgttggggagaggggagcctcatttattcattcagttattgaggccagagtttagagatcaagagacagagtgtttgtctttcaggaactcaatctaatggataattccatgtcaaggtgttaaaatgaggctgtaggagtgtagactatgggtgtcaaggagggcttcttggaggaggtgacctctgagctaagacctgaacaattagtaggtattgggatgggagaagagtgctccaagaagtcacagtgtgtgcaacggcttttaggagtctaagattaaaatgggaggggcgactggtaatgggggagctggggtcaggtaatggagggcactggggagctatagagagaggggaaggccctccctccttccccatcctgcccccactcaccgcatggttcgtcaccacctcatgcacaaagttgatgccctcaggtagtgggatctgcaccccacgccaggtccgctctgtgggtgggagcaccccgctcagtctgggcccgcccagttcacccctcctttcttcctccatcctcacaccccagccttaccattgagcatgggcatcaccccaatctgcagcatggtcttcagaggggcctgtaatgggatcagctgggaggggcgagggcggaaacagggcagtgagtcagggttgggtttgcctttagctgcccgcaggtgagcagttatatgaggagggggggatggtgagggtcaggatctcacgaacccagcccagcccacccacccttccccactcacagccagcgactccagtgcagaatggttggaatagattcggaacctgcgggaaagaaaggagccctgtgggcaggaagcctggaagctccccttcctcaggccacccaggcctacctgccagaggtgtctgagttgcaggctcagatgcccacctaggcacctttccaagtgctacaactttccaggtatcctcggggcagtcattgctgccacttgggtctccttttctccaagactgctactttttatttattgagcacctctttttttttttttttttttttttttttgagacagagtctcgctgtgtcgcccacactggagtgcagtggcgcgatctcggctcactgctccgtctcccgggttcacgccattctcctggctcagcctcccgagtaactgggactataggtgcccgccaccaagcccagctaattttttgtgtttttagtagagacggggtttcaccgtgttagccaggatggtctcggatttcctgaccttgtgatccgcccgtctcggcctcccaaagtgctgggattacaggcgtgagccaccacgcccggcctttattgagcacttctaatgtgccagacttctgctggtagctttgcaggtgttatttattttatgtaacaaaacttcacattgcttagttcctgtcagacactaagcatatttattttctttttttatttttatttatttttgagacagcgtctcactgtgttgcccaggctggagggcagtggtgtaattttactcactgtggctttgacctccagggctcaagtcagcctcccacctcaggcttccaagtagctgggaccacaggcgtgcatcactatgaccaactaacttttaaatttttttgtagagacaggatctcactttgtagctcaggctggtatcgaactcctggcctcaagcgatctacccgccttggtctcccaaagtgttgagattacaggtgtgagccact

SEQ ID NO: 14150 - DNA, 49440 bp, Human
ggagattctaaggattttagaagttgtgttacctggaaatggtgttgaagaccaaatacatgtatcacaatatcacaatactgaataccaaggatgtgtcaggcacccttgcaaggcctagggaatcaacactgacaggtccctgccctcatgaagctcacagtatagtgggaggccagacaataggacaaggaaacaaaaacaaacatgataattgctgatagtaataaatgtaatagaaaaaataaataggctgatatgacaggcagaaaccggggagagggtatttgggggctacttgggataagaaaactagagatgacctgtatgacctgaaatctggaagttaagaaggagatggcatgcagagagctgagaaagcgcattaggttagagagttccagttccttatgatgggagtgtctggaaggtttgtgctgctacacagcctgccagattggggggtgagcactcgtgcacactgctggatgagtgcagtgccccaagaatttattacactctacaataaaggaggcaatctgcttcccagtaaaggtcatttttgaagttcaaagtgctagcaactgtctataattatgcgttccacatagtttacaacatagaggtgccaggctatagtggatatagtcatggaagctaaagtaagtttcatccagaaagaaaagtgctctgtctccttcctagtgggcaggaagggcattttaatgaagattctggtatttcaagattcactggagttgctagaatgtggaccattgtgtgtatttctttctttccttttctttttttctttttgagacaaagtctaggtcttgtcgcccaggctggagtacaatggcgcaattttggcttactgcaactttgcctcctgggttcaagcgattctcctgcctcaggctcccgcgtagctaggatgacaggcagtgccactatgccctgctaatttttgtatttgtagtagagatggggtttcaccctgttgcccaggctggtctcaaactcctgacctcaggtgatccacccaccttggcctcccaaagtgctgggattacaggcgtgagccactgcacccagccccttgtgtgtatttctgacagacaacccaagaaattacaggctgaaaccagaaaagaacacattaaagcaccaagagaaagttggagtgggttgaagggaaacagatttttaaagttaaggctctgtgaaatgggtagaattaactacaggttaaaaataaaatgttaactaaaggttgcctctgagtaacaggattatgggtgattttaattgtcttctttgtgtatgttcaacagtgactataatatgtattacttttggaataaaggaaaacctgaaaggtgtgttgttttataagggcccttaggttgccaaaattagagtcattgaaatctaaagctgataaaaactttagtgcaaagattgtgacatgggagactacacataccagatccataatgtacatgaggacagtaggccgaggggccctgcacattgaaagcccacatgggagaagcccttgggaaggggagtggaaggatgaggcaaggggccggggggatgcagaggctggcaggcagtcatttctcagcttcagccattcccgccatgggggaatgtggacagagaagccaaacaaatctcctaaacagtaaatgtcagtcttctgtgtcagatatttaagaaaactaacagaggtcagagaagacacacctacagcaagtagactgtccctgtgctgcctttttgcaacccctgctttggcagtgctcaagcccacctcctgctctgtgcagacatctcttctttgctcttactagaccaaggtgaaagaaaactctcaccttctcccatctggccccacagcatctggaacacactgatcctcataatccttgttcttgagaaatattaatgacttaatctcccaagcttgctccctctcctgtgcaggccatctcagtatgttttgcagacaagacccagagaagtccagactggacttgttgcagactgcaaaactgccattggaaggcctccgtcccagtccttctacagagtagccagtgggattcccagccatgggcgaggtgacagcagaggaggtggagaagttcctggactcgaatattggctttgccaaacagtactacaacctccactaccgggccaagctcatctccgacctccttggggccaaggaggctgccgtggacttcagcaactaccactccccgagcagcatggaggagagcgaaatcatctttgatctcctgcgggactttcaggagaatttacagacagagaaatgcatcttcaatgtcatgaagaagctgtgcttcctcctgcaggcagaccgcatgagcctgttcatgtaccggacccgcaatggcatcgcagagctggccaccaggcttttcaatgtccacaaggatgctgtcctcgaggactgcctggtgatgcccgaccaagagatcgtcttccctttggacatgggcatcgtgggccatgtcgcacactctaagaagattgctaacgtccccaacacagaggaggtactctcttccccatgagagagagggcatggggcattattacatggagttctggggtacaggtggggtgaggggcattggccaccaagacaaggctggtgacaacatggtgcttcttctttatttatttacatatttactcataattctttattttgaaaaaaaaattcaaacttaacagaaaagtttgaaataatacagagaactgtatgtctttcatccaaatttatcattcattaacatcttgccacatttgctttctctctccattttctctgacccatttgggagaaagttgcagacatcatgccctttgtctgtaagtactggcgatgctcccatcattgtactgtggataggtaagaaatgtccctgttctggaaatacacagtacttccacagtacttctacacagtacttccacagtacctccacagtacctccacagtacttccacagtacttccacacagtacctccacaatacctccacagtacttccagaacaaggacatttcttacctatccacagtacaatgacggaatcatagaaatgtaatgtggatacgacaccattatctgctgggagtagtggcacatgcctgtagtcccatctactcggagggctgaggcaagagaatcacttgagcccaagagtttgagaccagcttgtgcaacatagggagactcctgtctctacaaaaaattttaaaattagctggatgtggtagtgcactgtgggggaaagaaagagagatcagactgttactgtgtctatgtagaaagaaaaagacataagaaactccattttgttctgtactaagaaaaattattctgccttgagatgctattaatctgtaaccctagccccaaccctgtgcttgcagaaacatgtgctgtgttgactcaaggtttaatggatttagggctgtgcaggatgtgctttgttaaaaatgtgtttgcaggcagtatgcttggtaaaagtcatcgccattctccagtctcgagtacccagggacacaatgcactgcggaaggccgcagggacctctgcccaagaaaccctgggtatggtccaaggtttctccccactgagacagcctgagatatggcctcatgggaagggaaagacctgaccatcccccagcccaacacccgtaaagggtctatgctgaggaggattagtgaaagaggaaggcctctttgcagttaagataagaggaaggcatctgtctcctgcttgtccctgggaatggaatgtctcggtgtaaaacccaatcatatgttctatttactgagataggagaaaactgccttatggctggaggtgggacatgctggtggcaatactgctctttactgcactgagatgcttgtgtaaagtcaaacataaacctggcctccgtgcacatcaaggcacagcaccttttcttaaacttatgacacagagacctttgctcacatgttttcccgctgaacctctccccaccattaccctatagtcctgccacatccccctcacctagatagtagagatagtgatcaataaatactgagggaactcagagaccagtgctggcacgggtcctccatatgctgagtgccagtcccctgggcccactgctctttctctagactttgtctctgtgtcttatttctttcctcagtctctcatcccacctgacgagaaatacccaggtatttctcatggaggggctggcccccttcagttcacacctgtggtcagcatcaatatggtgacttcccaggagtaagggaccaccaggctgcctaaggtggggtgaaccagcccaggtcagaaagggaacaggtcaaactctcatgctggttagtagtgggattgcacctgtgaatagacactgcactccagcctgggcaatatagcaagaaccgtaatgaagaggaaaaaatgaaaaaaggctgggtgtggtggctcacacctgtaatcccagcactttgggaggctgaggtgggaagaccacttgagcccagaaatttgagaccaggctgggcaacacagggaggtccctgtctttacaaaaaataaaaaaactcgctgggtgtggtggtgcacacctgtggtcctgtctactctggaggctgagatgggagcatcacttgagcccaggaggttgaggctgcagtgagccatgattgcgccattgcactccagcttgagtgccagagtgtgaccctgtcaagaaaaggaaaggaaaggaaaagaaaggcaaggcaaggcaaggaaaggaaagctaccatccaatcggctgggtgaaaaggaaaaaagaaaaaaattgctaaaaaataaagaaaaaaaagatgcaacaccatgatctaataaacagttcatattcagtttctgtcagttgtctcagacaccgatgtagcgctgtcttttgagtctccttgaatctgggactgttcctcagtctgtctttgttttccacggtgctgacatttttgaagggtacaaatcaaatcttttgcagaaatgtcctttcatttgggcttgtctgatatttcttcataattagatgcaggtcacacatttccggcaggagcagcacagaggtgatgtgtttttctttgtgctttacatgcggaggcacaatggcagtctgtcccattactggaagtgtaaacactgatcacttggttaaacacttggctctttcttccaggatccactgttccctgagattctcctggtggttctgacaaagacttctttgatcaccttgggcaaatcactccccctctctggatgttggtttttaaaggcagtaatgcagttctccacatagccctctgcccaggccaactcctactcatccttcagaaaaagtcacccttcctcagggaggccctttctaatctccctgttatagccccctccctaagccatttctcataataagccctggaggtcagggaccaggtctgccttgtccaccaggcttttactccaggacccagcacagtgtctggcacaaagcatgtgcttggtaagcacttggtgtaaaagactcacaatcaagtaattatgcaataatttctttaacactgtctcacccagaagaatgtttgtcccattacggcagggcccatgcgggtcttattcactcctacactggccaaaccaggagctgtgttccggcatttccaaaatccagcctttggacatggtgtgattttgtgctcattttacctctggagttacttcagattaagcatcttaaggttaaaaataggagaggaagggggcttcagagactgtcttatccaactgccttatttaatagacaaggaaactaaacctaggagagtgtgggcagaggcttgccaatgctccacatgcatgaatgcaagaattcaaacaggtaggccgggcgcagtggctcacacctgtaatcccagtgctttgggaggccgaggcaggcagatcacttgaggtcaggaatttgaaaccagcctggccaacatggtgaaaccccatctctactaaaaatccaaaaattagctgggcctgggggtgcatgcctgtaatcccagctactcgggaggctgaggcaggagaatcatttgaacctgggaggtggaggttgcagtgagccgagaccgcaccattgcactccagactgggcaacaagagcaaaactgtctccaaaaaaaaaaggattcaaacaggtatcttttggtcttgggctccttagtgagataagccagacttgtgcctctgtggaaagcatacccggtgggctcccacatgggcgcatggctcccgtcatctcctcttgggcatccaggggccgggcaatggttctccactcaggagactttccggaggactcatccaactggactggagtctattctcccttcaactcttctaactgtaattgtagccaacaaggattgcctcactcgtttcccctcataacgatctatgtcataactgtcattatctctgtttcacagatgatgaaacagaaacccagaaagttttggtaacttgctcaggattatgcagatagaaagtggcagatcctggctggttcaagtacacaggtgtttataactaattgatcacagccagttatagatttctttgttccccctccactcctactgcttcactcgactagcctaaaaaaagaaaaaaggaaagaaaaaaaaaagtggcagactgggaatgatttgaactcaggcattctgaccttgagctcacaatctttttttttttttttaactagttggttcagccagggagtcgttacagagccttaattcctcttaattgctctgctattctgtactccctcctcctctataaaatgagggcatcgcactgggtatttgagcaaggtcattggatcatgtagcagagagttaagatcttatgctttaaggtgagatctggatgtgaaccaggactctgtcactttcaaagaatgtggccttggcaaatcgtttagcttgactgggtttatttcctattttataaaatggggaaataagagctaccccacagcattgttgtagaaattaaatgaatgaattatctcatcagcagtgttcttggcacaccgtaatggctcctattggcagctcccgttccttattactattacgaccattttgctactgttattgttgtcgttgttaaggatctattctaagtgatggatgctgtaccaggtttgagtggaatttggagaagaatccagtcttgcccttctggagctttcagtttagattctgtttgtgggaaaacagagaacataaatgctgagagcttctctataccttggtgttaagggattgaggattcagggtgtttttctgagtctagaagatcctgacttaacagtttttggagcctctgtgctaagggacggcctgttgctttctgttcatccgtcagagtttacccaggaaaccacacctcaccttccctggaaacttttggggcctgagtcagtgtccctggccagtgacttgggcctgtgggtgaagtctgtctaggccagtcatccctgcgtacttggtatttgcacgtgtttacttcaggaaatcttactcaattcatggccctgggcagaatgcaaccttgggccccagtggcagaatgcaaccttcgccaccaaacagtgactggggctgggtgaaggagaaggaaggtggtgtagacaggggtctagattctttctggaccaccaaaaagtgatactctcaacctttagcaccctccaaaaacctgagaaatggttgcaattgctgcattgttgaaatgcgaaatcacaaaggtagttcttttgggctgtaatgaacttccccaccccctccaaattcctacttatcttgggaattgccttgggaagatttgccacaggactgccagaaaaaatataagatgcccagtaaagtttgaattttagataaacaaagaatgatattttagttaaagaagatcctgtgcaatattttggacacagttacactaaaaaattatttatagtttatctgaaattcaaatttcattgggaaggcccacttgccattcaatatttacttgtatatcattcctttgccctttctcctggcaggaaaacccatgaggtctgtctgtctgtccctgtcgatcttattcaccactggcccctggcacctagcccagtgtcttggacagagtgcatacttaccatagtttattgagtgagtgaatgactaaatgtcagcccttcaccagcacttcctctggctaataaattccatttctgaaggctgtacctgagatgaccgtcatttgtagaccctctcacatttgttatctgcccctgctttccttcatttcccatgagacctgagacctagcaggctagaacaggaaaacaaagaaaaaaaaaaccttcacagaggaccttattcaatactctgacttcagcaaaggggaaattgaggttcagagtgttttcaactactgacaatgtactgagtggcccttgaagccactcataggacaagtttctccttatctgggtccccagcgtggtctgcttcacatgctttgagtcgtgggctcatgttttgcatgacattccactataccatgagaacccactgagaacaacctcatcttacaggtctttgcatatacaatgcctggcatagtgagtgctcaatgaatatgaatgaatcaatctgtcaatcagtgaatcaatgaataagtcaatgaatgaataagtggagcaactgtgccacttaccagcaagggagttgtctataaaatgggaaaggtggcagttctatttggcagggctgatgtgagagttaatgagataatatatgtcagttgtctggctctgagcctagtcattattactcagtaaatagtagatctcatcatgagatgcaacagagcttggcactgtgaatgtttgcaaaggggaaatgaggaatctgggaatgagaagtagtgttgcattgcactttaaaatccaaactcagccaggtgcaggctgacacctgtaaccccagcactttgggaggccgaggtgggaggatcacttgagcccaggtgttcaggactaccctgggcaacacagcaaaatcctagtgttacaaaaaatacaaaaattagtcgggcatggtggtacgcccctgttgtttcagattctctggaggctgaggtgggaggatggcttgagctcaggaggtcgaggctgcagtgagccatgatggctacactgcactccagcctggatggcagagcaagactctgtctcaaaaataaataagtgaatacataaaaatgaaatcaaaactctttcccatggcctccaaagccctgctggatctggcccctgcctgcctctttaacttccttgccctctgctttccctctccctctctatgctttagctacactgattttctttctgttcctcacgaggaccagcctcattcctacctgctggcctttgcatgctccgtgcttagaatgtgcttcatatacctggctcccttgatccttcagctcttagctcagcattacatcttcagagaaggctccctacccaccagcctgccatccctttcatcactctctacagcaccatccagtccatttccttcaaagcagtttcctcaagttggaggaagaatgcctagttgtttacttgcttttttgtctgtctcgccgtttgaatgtaaggttcaccttatattacaacagtaatgttcattgctgtagtttcagggtctggaagagtgcctagcatatggaagacactctgataatgctaactgaatggatgaatcactttggtctttccctagctcagcctctgattctaggatttaaaataaatataagttggtgcaaaagtaatcgtggttcttgccattacttttactagtttgagctaaatggcttctaagtctccttctgcctttgataatctgagattctgtgacatggttgtttagaacactttatatgctgaatatatagggatgataatgatcatgtaaatgccagtcaattggcagttgaagtactcatgaggggagttccaggactgagtacccagtgggaatgagctttctggtggatttggtagcatctgccttggatgcaggtgaggcccaaatatttgcttttcctgaaagaagtgaacattgggaaactgaaatgacttcatgaaatgaatctgagcatactccacctagacacgtgctcaggaactcatcagtagcttagaaaatgacacagataccacttcttgactaatgcctttttagagattttgcttaatcctcaaatgttaattcaagtacagcactacaagcttctcttaattcctttacccttcacctggttttaaacagcttcactgataataatgctgttgactatttatttaatcccattccaactagaagaaatctatagatgcagagcattatgctctgaattccttccttccttccttccttccttccttccttccttccttccttttttagagacagggtcttgctctgtcacccagggtaaagtgcaatggtacaatcatagctcactgcagcctccaactcctgggctcaagcaatcctcctgcctcagcttcctgagtagctggaactacaggcacatgtcaccacacctggctaattttttttgagttttagtagatacaagatattgctatgttgcccaggctggtcttggactactgaacgcaagcaatactcccaccttggccttccaaagtgctgggattatagacgtaaaccaccacgcctggcccagacttagttttagaaaagttctgtgaattggctctatgaagtacatttccactcagaacggcgtgagctgagcatgtttgggctggcccgcctcccaagcaatgctgacagtccaaaaacctcacagtgctaccaataaacagaaaggaggattcttgtaaatttaagagaacaattcaagctctgtcttttcatcctgaccgcatggtccaccacagcctataatggcttctctgggctgcattaggggaggtttatggaggtgtgtgctcctctatacactcagagcttcaagccaatcccttgtgacctacattactattattgatttttctttgagctggcctgaaccttggtcacccatatcccccgtgcttaacataaggcctgacacatagtggggtttctactaagattcgtagaatggggatatctactgaactggttgtgtggtgctagaactggattgtttaaaaagctgaaaataacaaattcttttgttcaatgacctagacccaagtctaaccttatccaggcttctctaagaggcagcagagctgaaggcaggctctggagttacacatacacacacacacacactcacacacacagtctacacaatctacacacatgacattaaccttcttgagttacagatcccccttctgtaagatgggctactgatggtacttatctcatagcttattgcgaagataaaagtaagataacgcaggtaaaatgccatgcacgctgcctgctagcaactgtcgttgtacttcctaaagtctttacccggcttcctcttagctgtaccctgggtttttattctgggcttaattgtcatcacctcaagaaagccttctctaaccctccttctccaggcaaagtcagtcccccactcccatccctggaacccacactgctttgcacacctctcctccacagccctcagtggatttcatctcagactttcttcttctactggattttggaagcttccatgacagatgtcatctctgatttccctgcccctgttgaagaggaatagatggaagcacctttattcccttgtcaacaggggctttgggccgttccactgttcttgctcttcatttgcctgtccgtgcttatctctgccttcctttaggatgagcatttctgtgactttgtggacatcctcacagagtacaagaccaagaacatcttggcttcccccataatgaatgggaaggatgtggtggccataatcatggctgtgaataaagtggatggatcccacttcaccaagagagatgaagaggtaagaatgctttagagactaaggatagccatgctagcacattctcccagcctatgaagtcccctgaactttgctgtttgacctggcctcagttttcccatctgtaagacagggaattcacctgatgttctctgagggaggcaggataaaataatagttaagacattgggctttggagtcaggaatagagggataattgttctggctccgccaatagctgtttgccttttgcaagttatttaacttctttgaactttggttttcttatttgtaaaatgttgataatttttcagtatcaacctcatagggaacttattaataaatagtagctatttttcatgaatacactcccatcaacatcaacattctacattcggtgagttttatgctcatgcaacatcttatgagtctgcattctaggatccatctgcccaaattgtctctgatgaagctttgaaaatattcagatatttgctgatggtaaaagtagccagaggatggatttcttcttctcacctgcctcccctcatgctgtttgatttttagattcttctcaagtacctcaattttgcaaatctaatcatgaaggtgtaccacctgagttacctgcacaactgtgaaactcgacgtggccaggtaaggggcttgggccaagggaatggacttgactcgtcctttccctgaagcattgatgtggtcaggactggcaggcagatgggaatgaaggtgcctaggaagccagtctctggccagcatcacgagtgttatgaggtagtggttgtctgtaaagctgtataccacagtggttatatgcacaagcttcaagacagatggctttgatctgaatccctgctcaaccactgcctagctctaagaccctaagtgagtcacttaatctctctatgcttcagtctccccatttgaaaaatagggatgattatggtgccaccctcaaaaggttgccatcaatagtaaacgagataatgcatatagggcaatagtgctcaattgaagtttcttattatttttattaaaaacctatgagataaatgaaagggaaagagctggacccaatgtaaagcagccagttacttcatctctctgagccccagtttgtttgtctacaaatggaagataattggactgggcatggtggctcacgcctgtagttccagcactttgggaggccaaggcaggaagattgcttgagcccagaagttcgagaccagcctgggaaacatagtaagaccccatctctatttttaaaataaaatttttaaaataaatggatgataatgggctgggtaaggtggctcatgcccataatcccagcactttgggaggctgaggtaggaggattgcttgaggccagaagtggaaactcatctctacaaaaaatttaaagattatctgtgtgcagtggcgtccacctgtagtcccagctgctggggaggctgagatgggagaattgcctgagcccgggagttggagactacagtgagctatgatcgtgctactgtactccagcctggatgacagagtaagactctgtccctaaaaaataaatacataaaaacaaacactttagcttttgcgcttctgccctggccctctgctggccactccgccggtgctgtgcctgggcgcctccgtgctctcggccaactgcctctgagagcgcccacttgagcgccctgggagccggagggcggcggtcctcaccgggaccctcctgtgggcggagggggacaaaagtgtctctcaatccagcacatgcacattgaagcaagttaaaggatttaatatgaagcacagaagccgacagtgccaaacagcaagcagtagttggtacacatttggtgagtggggcagcatttccttctcccactgctgctgagatggcagaaattagtcgaattcgtacgaaatggaatatactgaaggcattagtcagcgaatgagggtcccagaaaagttaaaagtagcaccgccaaacgccaacctggaacagggattccaaaaaggagttccaaatgctagcgtgataataatgcaagttccagagaggattgttgtagcaggaaataatgaggatgtttcattttcaagaccagcagatcttgaccttattcagtcaactccctttaaactcctcgcactaaaaacagcacctcgtgtacttaggctaagtgaaagaccactagattttctggatttagaaagacctcctacaacccctcaaaatgaagaaatccgtgcagttggccgactaaaaagagagcggtctacgagtgaaactgctgttcgccaaaatggacagctggtcagaaatgattctctttatggcatttcaaatacagatacaacaattgaaggaacatcagatgacctgactgttgtagatgcagcttcactaagacgacagataatcaaactaaatagacgtctacaacttccggacgaggagaacaaagaacgtgctaaaagagaaatggtcgtgtattcaattactgtagctttctggctgcttaatagctggctctggttttgccgctagaggtaacatcagctctcaaaaatattatctcaacagctggaaatataaaagatttgcaaacttctttgtttctgtctcttcattgtacgccattttatagtccacaacctgaaaatatatttcttccagaaactctggaggtaacacctgcttaaaattctccttttgcatgttttgtaaataggctccagttttgttttttaaaaggaattcatcttttgcctcatcggtccacacaactgattctgaatgggagagagtctgtagagaattgatttagaaaaatgtctgtgaaagaaaaacaattattttgtcgtgtttctcaaacactgtaagcagttttgttaatagacatttttccatcaacacttcaacattaacactttcaaagtcatggtctgttgccagatttgagaaactcgaaccacctaatatttcataaccttcttcattaggtacttgtacagattaatttctaacatttcagcagtttaatatgtgtgcaataagtgcattctttcattttagttttgtacttggttttctataaagtacgtttttactcagttcatgtgtgaacaatttttaaaaactacagaataaggtacaaatgtagtgtatttaataaactgtcaaccaaagcaaaaaaaaaaattaaaaactttaaaaaaatctaaaagtaaaaataggggatagttaacctgtctatttctctggattattgtgaagggtaaatgaaataaactccagacaactttacagaattgttgttattctccagctaagtgagctactactttgcacctcaaaacctatgaatatgtttttgtgttttttcagatactgctgtggtctgggagcaaagtctttgaagaacttacggacatcgaacgacagttccacaaagccctgtacacagtccgtgctttcctcaactgtgacagatactctgtgggtctcttagacatgaccaagcagaaggtgagaaaacttcagcaacagacatttccaagaaaagattaaacagacactgactgacggctagagtcttggcacacattcaattgcacgggggaagaggctgggtgaattgggatggttgtagaaagtcttacataggtctctactgaggagtatcagcctttaaaggggaaaagtcaatctagggcacaggtgagtgaaaacaatctgtactttccttagtcatttggaaagaaaaaaagtgtacatgaaaagaaactgatgaggtgatgaaggccagtgataaagaaatttctatgtgggttgagagtccaggagaaagttgccaacttcagggattctcaaaaaatgtactgaaagttgtgtgtaaagctttgctgcaatttatctattccagagctcacccaggcaattaagtggaggcagatgccgacatcgggtccctcacatgttcaggggccagatttgtggcagatacagcagctaaggaggcagagttcgatgtcgctcccagcgatgttttttagatatgttttcccaaacaacttcctcatttctctttgtttatttgcttctgccttatgaggctaatcattttctgccttgaaacagagtttcagagttatctaagtttaatatctcctatcctgaaaacccaaggattccagccagtttcattttgtacgccttgtcatgctgagggtggtgcccagaccaatgcagactctccaaatatattggattgagtgaatacatggatcacagaatctggggttggaaaagcccttggatatagtccagaggctcccaaacttggcagttcatcagaatattctgaagagctgattaaaaaattactggactgcattttctgatagtctgccattttttacttaatgttttacaaacatctttccatgtcagcacataggaattctttttaatgagcctttatattgaaacataggcctggcacagtggctcacacctgtaatcccaggactttaggaggttgaggtgggaggatggcctgtggccaggagttcgagtccagcttgggcagcatggtgagacctgtctctacaaaaaataaaataaaaataaaaaaagaaggacaacgtagacacagaaaagggacattaattatagctgctgatataacagttcaatgagtgaacattcccatgaaaccaccaccaaaattaaggaacagaacatgacaaacagcacctcagcagcctccttcatacctttttcagtacctcccacagcctcctcctgaaaggttaccaccatctgacgtttaacaccatattagttttacctttttgaggttcatatatatgaaatcctacaatacacatgcttttgtgtttggcttcttttatttatttatttatttatttatttatttatttattttttgagacggagtctcgctctgtcacccaggctggagtgcagtggcgcaatctcggctcactgcaagttccacctcccgggttcacgccattctcctgcctcagtctcccgagtagctgggactacaggcgcccaccaccatgcctggctaatttttttgtatttttagtagagacggggtttcactgttttagccaggatggtctcaatctcccgacctcgtgatccgcctgcctcggcctcccaaagtgctgggattacaggcgtggtgtttgacttcttttgattcattcttattacttcatttagcatgagttcattcatttttattcctgtggaattttccatcatatgtacaatctacagtgtatttattcatttccactgttggtggacatttgagttttcagatctgatctattattaatactgttattatgaaacttctagtatattactagtacacagttgtgccctttctgttaggtatttacctagaagtagaatttcagagtattagctttagtagatattgcccatctgattttcaaaatgattgtaccattttataccctcaccagcaatgtatcaagggtttcttcatcaatacttggtattattattcttagtaactttagccattctggtgagcatgtggctttatctcttttgttatcaacataaattcccctaatgactgatgaggttgaatattttaaaatacgtttattggccatttggatgtattattttttgaagtgactgttcaagtttctcctccatttaaaaaaatcacattgtcttttttatctcactgatttgtaggagttctttgcaaattctgggcacaagtccactttcaaatacatgcattgcaaatacagtcacacaccatataacaacattttgatcaatgatggcccgcctataccatggtcccatagaattataatggagctgaaaaattctatcgtctagtgatgtcatagtgcaacgcattcttcacatttgtggtgatgctggtataagaaaaacctaccgcactgccagttgcataaaagtatagcacatacaggccgggcgcggtggctcacgcctgtaatcccaacactttgggaggccgaggcaggcggatcacgaggtcaggagttcgagaccagcctgaccaacatggtgaaaccccgtctctactaaaaataaaaaaattagctgggcatggtggtgggtgcctgtaatcccagctactcaggaggctgaggcaggagaattgcctgaacctgggaggtggaggttgcagtgagccgagattgtgccactcactgcactccagtttgggtgacagagtgagactccgtctcaaaaaaaaaaaaaaaaaaaaaaaaaaaaaaaatatatatatatatatatatatatatatagcacatacaattatgagctgtagtacataatgcttgataatagaaaactagaaaactatgttactggtttatgtatttactatactacaacttttttccattattttagagttgactccttctacttattaaaaaagaaaaaagttaactgtaaaacagcctcaggcaggtccttcaggagacattctggaagaaagcattgttatcataggagatgggagctccatgcgtgtttttgcccctgaagacgttccagggggacaaagtgtggaggtggaagatggggatattgatgatcctgaccctgtgtaggtctaggctaatgtgtgtgtttgtgtcttagtttttaacaaaaaagtttagaaagtaaaagaaaaaaaaatttaagagaaaaaaagcttgtaggataaagatataaagcaaatatttttgttctgattcaagcaccaaagacataaaaaaagaaaaaagaataacagaatttgagatttttttaaaaagaaaatatttttgtacagctgtataatgtgtttgtgtattaagctaagtgttattacaagagagtcaaagtttttaaaaataaaaaattttataaagaaaaatttaaaaatttatagagtaaaaaagttacaagccaggcttggtggctcatacctgcaatcccagctactcaagaggctgcggtagaagaatcgcttgagaccaggagtccgaatctgcagtgagctatgatgagcaagatctcatctctaacataattaattaattaattaaaaattacagtaagctaaggttaatttactattgaagaaagaaattttaaaaatacatttggtgtagcctaagtgtccagtgtttataaagtctatagtagcgtacagtaatgtcctaggccttcacattcactcaccactcactcactgactcacgcagagcaactctcagtcccgcaggctccattcatgctaagtgccctttataggtgtatgattcttaaacttttataccttatttttactgtgttttttatgtttagctatgtttaggtgtgtagtaggctatacaatctggagtaatgcaagtgcactctgcaatgttcacacaatgacaaaattgcccaaagaaacacacatttcctggagcatatccccgccattaagtgacgcatgactgtattctcccacttggtgttttcattctctctctctctctttttttttttttttttttggagacggagtttcgctcttgttgcccaggctggagtgcaatggcacgatctcagctcattgcaacctccacctcccgggttcaaacaattctccagcctcagcctcccaagtagctgggattacaggcccccaccaccacacccagctaatttttgtgtttttagtagagacagggttttactatgttggccaggctggccttgaactcctgacctcgtgatccacccacctcagtctcccaaagtgctgggattataggcgtgagccactgcacctggcccatgctttcattctcttaatggtgtgtttttatgaatataagttctgaatgataatgtagttcaatttatcaatcttttcctttatagtcattgattcttgtgctgtaatgaggaaatctttcctggatctaagattgtagagatatttacatatgtcaaattctaaaagctttattgttttaactttcacatatagctctacaatctacctggaacttttttatgtttagtgtgaagtaatgtgagtattcatttttctgtacaagcatccaattggcccagcactgtttattgaaaagaccattctttccctactcttctagtgaaaagatcatccttccctatcatacctttattatcaaccaagtgtccatatatgtatgggtctgtttctggattctctattttgttccattggtatatatatatgttttttttaattaatttttttttcaagacagatatctcactcttttgcccagcgtggagtgcagtggtgcgattttggctcactgcaacctccaactcccaggttcaagcaattctcctgccttggtctcccgagtagatgagattacagacacgtgccaccatgcccagctaatttgtgtatttttagtacagatggggtttcaccatattggccaggttggcctcgaactcctgatctcaagtaatctgcccaccttggcctctcaaagtgctaggattacaggtgtgagccaccatgcctagcctccattggtatatttacctattcttctgcaatactatcctgtcttaatttcagtatgtttataaaatatcatgatatctggtaatgaaaagacctctaagtttattattattatatgttagactttttcaccatggtttgtgtctcttatacttctttgtgtgtttttcatcatttcgttttttgtgctttagtttgaatatttcttcgatctatcttctattaattactaactctttttttttttttttttttgagacagagtctcattctgtcacccatgctggattgcagtggcatgatcttggctcactgcaacctccgcctcctgggttcaagagattctcatgcctcagcctcctgagaagctgggactatgagtgcaggccaccatgctcagctaatttttgtgtttttagcacagatggggtttcgtcatattggccaggctggtctcgaactcctgacctcaagtggtctgcctgtcttggcctcccaaagtgctggtattacaggcgtgagccactgcctggctaactctctcttcaacagtgtctaattgactgttaaactattgagtttttaactttagatatttttcaattttagaatttccaactcattctgtttttgtagtttccagttctctgctaaagttctctgttttgtacttgattcttggacataatcacagttatttttgagtctctgtctgaaagctataatatttataggcatcttctatggacctatttctatgatctgtttcccctctagatttttccgtgaattgtctgttacatgctttattatttttgtttgaagactagagacatgtatggaaatatgttatcttcctccaaaggggatggttttacttctggcaagcagttggggtaaaggcagagaacctcaatccatttaggaattgaactgatgtgaagctggtcttcagtcttcgtgaggcctggtctgcttctggttcacttttacttcttggggcgtgaggatcccagcctagggtgttttcaagggtctctcctccttggcaggctctgaattccaattttgtcctccttgcccagtgagtcttccgtaagcttggctcagcttcttagctgctcacagcatctttggtatcaacaagtgggtcaaaaggaaaggtcgaatcaagggtcaggtttacatctctgggtttcctttctctctgggattttggcccactaactccctgctgccttgccggctatataagtccttcacataaacaaatgttcatacacatacacacagtccagatggtgtaatttttccagttggaggattggtctgaaacaaacgagtcatcatgaacagaagtaggaatcctctctctttgttttgtagtccatatggatttatctcattcatttgagtagtataaatataccgtaattaatttatcctttcccctattgctagacattaaaaattatttctaaatattcttataactaaatatatatatatatctatttctaaatattcttataactaaatatatatatatctatttctaaatattcttataactaaagacaatgctggccatacaaccccttgtttgacaacttctcttctccttgggacaatctttggagccactcagtgtttggcccacatgaggtgtcaggccaatatatttgttcttcttctgggctcctctagcatttatcctctccttccagcactgttttggttcttgcctcatttacctcactattagttatcttcttcatgagacaataagttcttccaggatacaaactgtgccttattcgcctgtgtataactagcagtcagcaggttgtggggctcaggtagggcctggttatatttttgcctagaattaaaattgttttctaaatgttcacctagaattaaatttcttcctgttgttggtagtctagaaaaagagctcaactggggagaagggcaaaaacatggactctgcatttcatgtggcttcccttctgcttctctggatgatattagaataagcagaccatgacaaacatgttcaaatgagaggaatgaggagggcttggcatcctacccacagtaacccagtgctaatagatcacggtttgtccctgtatagtaacagatgaatgaacagaaagggcactggaggatggaagcccctctctcaggcccagacttgaccccacacaagctttgctgctctatgggcaaaggaaaccatgaagaagtagtggggaagaacctgtgtggttctcagttggcctctcctgaggctgcatgactgtgcagctcctttgctggctctttttcctcttccctctgcctgtgtcttggccacttttatttatgttgttgttgttatgttatgttatgttatgttatgttatgttatgttatgttatgttatgttatttatttgagacagagtctcactctgtcacccaggctggagggcagtggcacaatctcagctcactgcaacctccccctcccgggttcaagtgattctcctgcctcagcctcctgagaagctgggattacaggcacataccaccacgcccggctaatttttgtatttttggtagagacggggttttgccatgttgctcaggctggtgtcaaactcctgggctcaagtgatccatccgcctcagcctcccaaatggctgggattataggtgtgagccaccgtgcccgaccttggccacttttagacaaaacaaattcaacagagtttatatgagcaacgaacaactcatgaattgggcaaccttcaaaaccagaagaggttcaaagagctctgctgcacagcaaggccagtgagctttcatagctgaacatggaagtaaagtatagaaataacatgattagttacaatagggcatttgtctgatttggacatgatctgatcagttgggctgcctgtgattggttgaaactcgaccatttgttacagtaatatactcctaaattgggttttggtttgtttgcctactgaggttgcagtttcttttgtaggagctcaaattattacatggaaactggaagaacagagatagcctcaggctaaggcacctgtgtattttgctttagcagccacttatcttacaggtgtcagcctttcttattggatcccagatataggtctattgtccatatttgatatcatttttttctttcttatttgtgaaaaatattttttcctgattacaaaagcaataaagtttgttatgaaaaatttctaaataaattgcagtctgattccaatcactcagagaaaatcacttgttaatactttgttgtgggccaggcatggtggctgatgcctgtaatcccagcactttgggaggctgaggcagatggatcacctgaggtctggagttcgagactagcctggccaatatggtgaaaccccatctctactaaaaatataaaaattagccggatgtggtggcacacacctgtaatcccagctacttgggaggctgagccaggagaattgctagaacccgggaggtggaggttgcagtgagctgagatggagccactgcactccagcctgggcaacagagcgagaccctgtctccaaaataataataataataataataataataatttgttgtaaatgtattcatgacagtttctatatataattgaacattagggtcacatgatatattctttttggcctctcacatttgtcacttatcagtgtatcatctttccaatcagcacacacacgtctgtaacatcattgttaatagatgtaccataattgatttaataagtcctttcttcttgggcacttatattgtctctaatttttcactactataaatgatactgcttgggacattgttttagctaaatctttgagcacatattagcatggtcttaaggtgaatttcttagccgtaaagaccctgctttccctctcatgtccaataacactgagggtgccccagttcagctcccatgtttttggctaatgactagacaggcccagttcatcaatattttgaagggcaaatgtgactattttctaactgtagtgagtcttactgcctttccaagtttaggtttcactgagttcttctcactttctaaatttcagtgttagctgactcatggaggtgggacatcttaatctcctttccttgatctcttttcaaaacatgtaattattgtttttctcattcctaggaattttttgatgtgtggccggttctgatgggtgaagttccaccttactctggtcccaggactccggatggaagagtacgttctctctgaccttttcagtatgatttaatatattcaaatgcaaggcacagtaaaccctgttaaaggattttttattagcatataggtatttgtctttgcgttgggttgtctcctttgaagttagaataatctctcatattcaatagcagacaggtgctaaaagtaaaataaaacaacagagagaaaaaaagtaaaaaaaaaacagcaacaataattcctcataattgtcatgccctaacatccctaacatttgcaaagtggtcttccttccttccttccttcctgccttcctgccttcctgctttccttccttccttcctttttctttctttctttctaagcactatactaacaagaagctaagtgtttaatatcttattggggtttcacagtaaccttgcggggtagaccaaacagggaccaacatactcatttcacagctgtggaaagagacccagaaaggtcaagcaacctactcaaggcttcaccttgcaggaatttagagttatagacaatatgagcttagaaaaccttcatatctagtctataatgtacaaattggtagccagaaagccaattccagctgacagatacacttgcttggctacgtaggttttctattttctttctttttctttctttctttctttctttctttctttctttctttctttctttctttctttctttctttttctctctttctctctttcttctttctttcttttcttctctctctctctctctctgtctctctctttctctctcagatagggtctttgtatgttgcctaggctggtcttgacttcctagtgctcaagtgatcctcctaccttggcctcccaaagtgctgggaaattggcggctaacccttaaaaatcaaagtctttccataaatacctgaattctcagtttcttttgaaaaggtggatgattaatccatactggacccacaatccagcagggcaaatttgattggagctgagtagcagctacctccttgggatgtggcctgagttctctagtttgccacagtccccgccactttctctttttgagatggagttttgctcttgtcacccaggctggagtgcaatggcgtgatcttggctcactgcaacctctgcctcccgattcaagtgattctcctgcctcagcctcccgagtagctaggattacaggcacctgccaccatacctggctaattttcgtatttttagtagagacagggttttgccatgttggccaggctggtctcgaactcctgacctcaggtgatccgcccacctcggcctcccacagtgctgagattacaggtgtgagccactgcgcccggcccccaccactctcttttatgtacatctgtgccctgctttcatttttgtttttatcaacctctctaggcatttaagtttctgatctctgatctcatccaattgcagcattttattttatttgtttttgttttttatatagagatgaggtcttgctatattgcccaggctggtcttgaactcctggcctcaagtgatcctcctgccttgagctcccaaagtgctgagattacaagcatgagccaccgcacctggcctaaattaggccctttaacattccctctgccttctaacatccctctcacgctttatctgccacattcacttggaaacacagcttttgtctgaattccaaccaattaatgttcccgaatcttaggtcgaaagcctcacagtgtcagctacatcttgcttcatctacttttaaaaataaaatagtgtgtgtatgttttaaatatttaaaagttatacaggctaaaaagccttcatggaaaaaaaaatagcagtcttttaaaaagtggtgtatttccatgggtatctgtggctctttcaaagccccttgtgtcagctgctcaggtagaaggtaacaaaggtactcttgatgactcagttttgactttccagaggctggtgaatttgtacatgaatatggctttaaagactttgactgagatacagtgagtggaaaaagcctagttacccaaagcacactgatctttttgttaattctgggaaagaaaaactttgcagtttttctcctgtgggattccaaaaaaaatgtccatttctttttttgagatggactgtcactctgttgcccaggctggagtgcagtggcatgatctcagctcactgcaacctccgcctcctgggctcaagcaattctcctgcctcagattcccgagtagctgggattacaggtgccccaccattatgtctggctaatttttatatttttagtagagatgaggtttcactatgttggccaggctggtctcagactcctgacctcaagtgctctgcccacctccgcctcccaaagtgctaggattacaggcgcgagccaccgcacccggcctagaaatgtccatttctaacctttctaaagactctcgtgggaatccctgggtaggacagcagccaggcccaggaagccctgagcctgccaggagtacagtgagcagcacaggcccaaggacaggtggccctaaggcaagacaaagatgtcaagaaggtcctggaactctgcctcctccccctcgcaggcagaaacttatctcctaggaaataagtgttctagaaagcagccacctttgctttctagaactgcttatagggtacaacttgactatttaaaaatatttttaagaaagtttgttgtgccaggtgcagtggttcatgcctataatccaagaactttgggaggctgaggcagaaggatcacttaaggccaggagttcaagacctgcctaagcaacaaagtgagaccttgtctctaactaaaaaaaaaagaaaaaaagaaaagtagccgggcatggtgacgcgtgcctgtattaccagttacttgggaggctaagataggaggattgcttgagcctgggaaactgaggctccagtgagccaagattgtgccactgcactccagcctgggtgacagaatgagatcctggctcaaaaaaagtaaattaataaaataaagcaaaataaaaaatataaaaaaagaaaattggtttgtatgttggaaaaataatatatgagcacagtgaaaagttcactccatacgaaattaagtgccaccttcctcctagtcagcccctgtgaagcagctgctgttagcaaactctctttgcaggaacatttaggtatatccagatatccacagagaagtatacgtattccaccaccacccctctgcactaacgctatgattctattttgtgccttgcttttttcacttaactgaatattttgtcacctttccctttcagcacaggcacagcaatcttgctctggaaacgtgtggtgtccactgtacaaccactttcctaataagagaccttacatcatctccagactttttaaagcagtctagctaagacccttggacggggcaaaaaatgcttttacccacatttgggagtatatctctaggatccatcaccacatgtgggtcaaataatatgtctgttttgatctttgagagatattgctacctatcttatcataaccttagaatcatagcttggagggtctttatggattttctaaaacaattttctttctcccccattgtccttagaaccttagagttccacagtagctgccttgaccaggggttaatagaaaaggaagaggacaggaaagggagtaagagagaacaaaggggcagggactctatatacccggccctgattccattaggacagtttcatataattagcttccatgctttgcttggggaaagagagctgctactgaacagctgtagcaaacacataccaccattccaattttacagccagagaaactgaggcctagagaacacccatagtaggaccgaaactagaacaggaatcctcactctaggtctagtctcagctccattttatttattgtatttcagcgttcatctagtctccccttggatgcttcctattttagggagctcactacccctgggggtagcctgtgccattggagtggtttcagcttctgccttttgtttaaccagagctcgcctcctagaagtattcagtcagtgcagctgccgccaatgctaggctttgagcagcagagcctctcccttatgagttggaagttgaccattgctgattgcccgtcaaccaaacagaccttcagacatctttaactggttcaggaattcctctttgtggaggttctgagtcgggaggcttggggtggagcccaggtatctgcactgaaatctctagggaggtacttctcaaaatacctgtagtaaaggaacagtttggtttttctttttaaaaaaatttccaatttttttttgtgtgtgtgaaaaacacactcaagaaaggggagtgcaggcatactcaagagagtgagtcacgcctccagtatgttttgattgctacttttaaaaatatgataaaatatattcctagaaaaacaaaattgtataaagacagacaaaatataaacttggatcatgccactgcacttgtactccagcttgggcgacagagcaagactccgtcacaaaaaaaaaaaaaaagatatccccttttattcaattaaacagacctgatctaactcagtcaaattgttacaaaacttcctaagtgactctcagtttctgtttttatcttctcctggaatagtaaagagttcacaagacaggcaccggcccagggattacactctgagcaaccctgttcaaggtgacagtgatgcggacagtaaaacactaagctgttaacgttaggtgacatagaggaaaagcactgagctgggaattaaggacccaggttctgattttggttcactgtcttgctacaagtgagtcctttcctctctctgtgtctcagctttctcatttgtgaaatagttgctcatcacgcttgggcatacagaggacctaagaaaaaggtaatagaatttcccctggagagctaggggaatggagtcacatgccaacatccaattgcatgctagagagtaatgtaattgaagagctctgctttaagagaatgggaattttaacaatgcaaggaggcgggagagatggaagaggcagagagttagtttggggtcatgaaacatgatgagaaggtaggtctgaagtgacgacacagcaaagagaacagctgagtggtaggcatgaaggagaaatggggccatgacatagagatgcaccctgcagggaggatggctggttggctgtgattttaaatgggatgggaacctcctgaccacttccccatctccctagattctggcagccgtctttatctctttcttcttgcacttatcaaagtcaaaattaaaacgcagagacgaatctctatatttaatgttttggggcaaaggaagacttgcaatttggggcatacatgcagactaagtagtcttcagtatgtccaaagaaaaaagagaaggtagacggttttataaaaaagagaaatgaggccgggcatggtggctcatgcctgtcatcccagtgctttgggaagccaaggcaggaggatcacgtgagcccaggaattcgaggctacagtgagccatgactgtgccactgcactccagcctgggtgacacagcaagaccctgtgtttaaaagaaaaaagagaaatattacatgttgctctctgagaaagttcattgacaccagtaagggtctggggagctggcaagttttgactgatgagtaatggcagtgggtaaaattagtcctagagttgcagcaggttgtttcagcaactatcagataaaactggtttcaagtcacagcaggtagcgtaagcagccaggcatgcaaagaattacattctgggagcaatgctagtgtcctgagtacttttttgccccctggcttctcaactctcttttatttgggtatgacaaaaatgtcccaacttgtgtgatcaacttgcacacaatcaacctccagatcctcttagaggatttcctatccctcttcccagcctcagatcccagccctcttcctgatcactgtgagctgcctccaaggtgaagcacgctgaattctgagggtcagcagaggacagggagcaccagaaggcagcccaggcacatccttggagggagtttatggccaggcttggcacttcctgaaaaccatggggcaaaatatgtacaactactgtatatcaataaaaacattaatttattaaaacaacaaaaactacggggcatacgatggtaaaaggacaaagttggtttcagggacatactcctgttgaacttctatttgactcttgaaggtataattttttggctgggtgcagtggctcacgcctgtaatcccagcacttcgggaggctgaggtgggcagatcatggggtcaggagttggaaccctgactctgctaaaaatacaataattagccgggcatggtggtgcgtgcctgtagtcccatttactcgggaggctgaggcagaagaatagcttgaacgcaggagatggaggttgcagtgagctgagatcaagccattgcactccagcctgggcgacaaagtgaaactgtctcaaaaaaaaaaaaaaaaaaaagtataatttttctctcttttgccaggaaattaacttttacaaggtcattgactacatcctgcatggcaaagaggacatcaaagtcatcccgtaagtttcacctgtcaaaagacaaaatgacaacaaattagcttaaagatctcaattggctttatcggtgattctggaattgggcaacacttcattccataaaatacataagtgttctgacaaggttgactttatagacagagaaggactgaagaaagacaagcaaagatcaaagaacatgttaatcatttttaagatacttttcttataaggtgggagagggagatagaacaatagaaaaataactgattaatgtcaggttactgctacctttttttttttttttttggtgtaaggattaaagcagaggaacttcattatcatgcctattaaagactggaacaggactttttgggaaattggcgtttacctctctcctaatctctaagaggatcagaaaacaacttagtttagatttggtgaagtggaacgttatcacggtgactccacactgatttttagtttggtttgttggagcttggtgcagagctttgtccaaaacaagggcctcctatagtttttattttaacacatctcaaaacatggaaaactgcaggcacattatcaacttccaaaagatactcattccaagatcaacactgaccaaatccaatgagaccccacagttggttagaggcagggagagtgggaaggaggcagtgtgagacggtagagagactcagagggtgagcagtgaggcccaagaagggggaagacttgaccagagccttgatgagggctacagtggaccaggttgtgagtcaggtgctctgagtcccaatctcacagccagggccagtaagtggtttgtctggaccttagagtcccatgtatagaatgagactgggatgaaatcagggattttcaactgttttctgcagtgctactcttctggtacttgaaggaggcaaagcaaaagcaggaagctgcaaaggaactgactcagcccccacagaaagcctattctcaatgtcccctcatgtgtgaccaaggaagacagtgaaaagaaaaggaaagaatgctctcagtcctgcatctaggtagctgagactcaatgaccattagaagatttgaacggttgcaaactgtttaaatatgggcttatacttttttggtcagtagacctttctcaaaaacctagttaccttcttctctgtttgaatcctctccacgtgctaaaagccacatccatggttctgtcctgagacatggccctttttctcaacttaactgcagaggccttgaggctgtaattcggttcgtgggagagccacacctttagtcttagcccccacagcaattttgtccaactgaagggatttactgcatgccaacttaatcttcaagaagtgggtgtgataggccatgctgattcagtttggtcaccagaccaaactgtaataatcccgtcacccagataaacaagttctcagggttgtctgttactggtgaggatgagaagctgcctcaagtttctcaatttctaggttatctctattcctttattgctgcctgcataaggactgattaccttattctattctcttttttttttttttttaagatggagtcctgctctgtctcccaggctggagtgcagtggccgaatctcagctcactacaacttccacctcctgggttaaagcgattctcctgcctcagcctcccgagtagctgggattacaggcacacaccaccacacccagctaatatgtgtatttttagtagagatggggttttgccatgttggtcaggctggtctcaaactcctgacctcaagtgattcacctaccttggcctcccaaagtgctgggattactggcatgagccctggcacccagcctgattcccttattatcttctaaagttcatctctctttttttttctaccttatcaaaagcatactcttcaacaattctgttttctagccccttttctagcttctagagccacaatcttattaactcattatctgtctcttaaatggtcacaggtcgcaattttctgtttgtctctgcttgaccagcatcacatcctactagcttctgataacattcatcttgttgcctaccacccagtccctaacctatgtttctcgttttaggttttttattatggcagcaccctgtttctgacacaaatctttgtttcagccaagataggccaggctctgctttcataacaagacctggagacctgagtggtataaacaactaaaatttatttcaccatcccagtatgggtgcactgccagctagcgggtgtggttggagatatggtgggtgggttgtagtcaggcaggagccaaggctgataaagcagctgccattttgaaccttgcaagatagaataaccttgccacagagaagagaggaaaaatacacactggctcttaaaatctccatctggaggtgacacacacatagcacttatactcacattttattggtcaaagctagttacatggccacacattacttgagtggttaggaaacgcagtctgaccttgtgcccaggatagacagccagaatgtctgtaaacatgcagaatggctgtcacagtatatgccatccacactaacagaggggaaaattgaatagtaaataaatgactaatcaaaccaaaggaaggcaaaataaaagttcaggaagaacatagatgttggatgtggatgcactgtctatagccccagctaatcaggaggctgaggcaggaggattgcttgagcctaggaatttgaggctgcagtgagctatgattgcacctgtgaatagccactgtactccagcctgggcaacatagtgagacactttcactaaaaaagagagggagaaagaaggagagaagaacatagagcaggtaggaaaacaaaatgtacatatcaaggtgaaattcgaattcaaatatatcaattatttgaattttatttatttaattagcgtgttagtgttttatagagacagtctcactatgttgccaggctggtctcaaatttctgggttcaagcgatcctctcacctctacctcccaaagtgctgggattacaggcgtgagccaccttgcctggccaataatttttttttttttttttttttttttggtaatagagatggggtctcaccatgttgcccaggctggcttcttcaaactcctgagctcaagcaatcctcccaacttagcctcccaaagtgctcagattataggcataagctgatgcaatggccaataatttaaaaaaatataaatcaactagatgttcaagttaaatgacaaagattgccagcctggttaagaaagaaatacattacctttcattaattctaagatgctgttttctactttttgacatttctgaaatagaattgtgtgatcgttgttagccatggcagacatgacaaagttgttattgcctaggtgtgaactcggtcataaccatagtcaaaagacaaagttacaataagtttcatctacagatctcaaatggctttatttgagactctagaattgggcaatgatttgttgtgtaaaatagagtaagtgttccaatgagttgagcagaaggggttggttttataggaacaaagaacaaaaaagcagattggtcattttaaagctacttttcttgtaaggcaggacagggaaataggacaatagaaaaatgactgagaagtaaacatcaagctatttcaggctacctttgtgtgtgtgtaaggactaaagcagaggaaacttcatcatcatgccaattgaaactggcttgttgccgggcacagtggctcacacctataaacccagcactttgggaggctaaggtaggcagatcccttgagctcaggactttgagaccagcctgggcaatatggcaagaccccatctccacaaaaaaatacaaaaattagccaggcatggtggtgcacacctgtggtcccagctgctcaggaggctgaggcaggaggatcacttgagccggggaggtggaggctacagtgagccatgatcgcaccactgcactccagcctaggggacagagtgagaccctgtctcaaaaaaaaaaaaaaaaaaaaaaaaaaggaaaaagaaactggcttgtttggaaaattagcttttgtttctcctgatttctcagaaggtcagatagcaatttagtgtttggtgacttggaactttgatgtaggtgacttcattttaatttttagttcgatctgttagggcccctactacaggagtttagttgaaaacaatggtctcctgtaattttcatttcccaccattcatattgttgtaagtatagttattgttgagcaaccattgctggttgctattcacattgaattcaattgccatgtaaaataattttaaagagagattatgctatgattcagcattgaagtgaaaaattatcttaactggcacaaaatgacagaaaaaagtgtgagatatgataaaaaatctgtgtataaatgctaaaagagcaatgttgatctgaataaagtaaaaattacaagtgataagcattatagattacgttataggttaattggcagcatttaatctttctctgcacatacaaaagttagtcaacaatgattactcccaagatatgatgaaaaatcctatatcctgtttacaggagactaatctgaaagagaatacaaagaggttgaacataaaagactgaaaaaagacataccatgcaaatgctaatcaaaagaaaacttgtataaccatgttaatatcatagaaaaatagacataccaaagagcattagtagagataaagagtcacttaatgataaaggggtcaatctacctcaatattacaggaagatattaccattctaaatttgcaagcgcctcataacatgacctcaaaaaatataaaacaaaaactaacagaaatacaaggagatatagatgaatctgtttgctaattgacttaaggagcaaactaaaatgaacaaacagaatatagaatatttgaataatccaattaatgaatttaacctaataaatatagatagaacactgctttaagccagtaacaaaaagctaattaggaaattctcatatgcttgggaactaagaaatacccttctgaaaccaaacaacctatggataaaagaatcaattaatggaaattagaaaatattctgagctgaaagatatgaaaatattacatattaaagcctctgtaaaaaataaaaaacctgtgtgatgcagtgaaattgtgcttaatgtaaaatttacagcctcaaatgcacatgtttaaatgtaaaaaggctgaacaagtaatgagctatgcatccatccatatcagtcagggtctcaactgaaaataggtgtcacattcaaaccaggataattcggtgagggtttatttacagagggacaaattgcaaaggtgtgtgtggaatgaagggaaccataagagaatgtgctattagtgggggagctactaccacttctggccccaaagggaaatttccataatctggaataaaaaagagtctcgtagagcaaaccatcttgacagaagcattgaccttcaggcaaggaacatagccagctcaaagcagccttgccagtggttgccctgtctctataaaaaaattttaaaaattggctgggtgtgatggcacatgcctacagtcctacacgtgaggctgaggtgggagaattgcttgagcccaagaggttgaggctgcagtgagccaggtttgctctgctgcactccagcctgggtgacagagtgagaccctgtctcaaacaaaacaaaaaacctagccaggtgtggtggcacatgcctataatcctggctacttgggagactgaggtgggaggattgcttaaagccaggaattcaagaacagcctggacaacacagtaagaccctatcttgaaaaaaagaataagaggaaaaaaattaatagtaaaactgacaaaatcaagaagaaatataacagttttattacaataaaatatgtattacaataaaataaatcaaaaccttctcacaaagacaacccagacccagatttttttcacaggtgaattctacttagtggtttatatttacttatttatattttttagagatggagtccccctatgttgcccaggctggccctggactcttggtttccagtgatcctcccacttcagactcctcagtcgctggggctataggcacacaccactgcctgagttctaattaatatttaaggaacaaaaatgagtaaaagtagtatttaaggaacaaaaaatgagtaaaagtaaatttaaaagtaatttttaaaaatgagtaaaagacatgaacagaggaacttcacaaaaaaacaatgcaaatgacaaatacatttatggaagttactccattttattaattttgtagagaaatatgaaagaaaactatgatgagataccactagacctcaccacaaggactgtcatttaaaagtctgaaaatagtattgacagagatggagaacaaagcaaactctaatggaccactgataggagtgttaattgctacaatcattttagaaaacagtttggcctcatctagtaaagttgaagatacaaatatcttatgacttagtacttcttctcctaggaatataccatgtagaactgagagcacatatgcaccaatgttgacagcagcactgtttatattagcccctaagtgaagggatgggggatgtccaccaacagttgaatggatagattgtgctacagtagtgtagggaacactgtaagtcagtaaaatgaatgaattacagcaacgtgacaagccagacaaaataatatacgttgtacagtgccatctaaatgagttgaaaaataagcaaaattaaactaacaggtacaggaaaacatgcttagaagctaaaactctacaaaaaagcaaaaatgcaatttagcataatttcagaataatggttacctttggggttagggagaaggttatgattgcgggggaaagtcaatggcttccaaggagctgacaatgctgttcttgatgtccatgtggttttataaatgttcatttcctaatgattggtgaagtttttaatgcttgtttatgtgtgtgtttttttctcacaacaaacaagcaaaaagtaataatacaaaaaattatagtattgtgagggataagtatataatgcacttagcttagtgcttagcacatggtaggaattctccatagatgaattttttcattctctacatagtattagtagcttctaactttatgagggaagtgatggtgtttgtttctgctcagcagcaggtaacaatctgtagaatgaatgctgtctcttttctcagatggtgaaacttggtgggcagacagtaaaatgttatatttgccaccctttctccatgtctagatttgaacattaagatggttggccaacattttgggtttggtcaggtgtagtgaatgtaagcaggtgctgagagccacctgagagcagggggagcgcaaacacccagattttagtctttagtccagcaatccctgcactgagagtcaccgttttgtctttggccttcacaggaatccacctcctgaccattgggctttagtaagcggtctcccagcttatgttgcccagaatggcctggtaagtaatataactttgaagggggagagttttggatcacgtggaagaaagagtggaaggatttcagatcaagaagagagtggaaaagatgatggcaagtgtggatctctaaaagcctaattctcttgtttctctcaattcagttggcaactggtctaaatgaatgaacagataattgacatttgaggaaatatcaaatacatagataaataatccttaggtagaaaggtgcatagtcttggccgggtacagtggctcacgcctataatcccagaactttggggggccgaggcaggtggatcacctgaggtcaggagctggagaccagcctggccaacatggcagaactccatctctactaaaaatataaaaatttgctgggcatggtggcaggcgcctgtaatcccagctacttgggaggctgaggcaggagaatcacctcaacctgggaggcggaggttgcagtgagccgaaatcatgccattgcactccagcctgggcaacagagtgagactccgtctcaaaaaaaaataataataaataaaacaaaataaaaaggtcttaggcagatggggtcataaaaggaggttccaggtggaaggaagaacatgggcaaacaacatgggcatggaggcctggagcagtgtgctgtgtatggttaagtgtggctggagtattagatttgagacaggaagacagcaaaacatgaggctcaagagggaggaaggggctaaattacaacaggccttggatgccttgtctaaaaggtgggatttttttttttttttttttgacagtgtctctgttgcccaggctggaatgcagtggtgagaatttggctcattgcaacctccgcctcctgggctcaaacaattctcatgcctcagccacccgaatagctgtgattacaggcatgcaccaccacacccagctaatttttgtatttttagtagagaaatggttttgccatgttagccaggctggtttcgaacacctggtttcaagtgatccacctgcctcaacctcccaaagtgctgggattataggcgtgaaccaccatgctcatcctcaaaaggtgggattttaatctacaggtgacaggtagacaagcaggagattcacatagtcaattttcattttagaaagataactctggcagggcatagtgactcacgcctgtaatcccaacacttagggaggctgaggcaggaggatcacttgagcccaggagtttgagaccagcttgggcaacataccaagactccgtctctacaaaaaatttaaaaattagccaggcatggtggtgcaagcccacagtcccagctactcaagaggctgagacaggagtatcccttgagcccaggagttccaggctgcagtgaggtatgattgcaccactgcattccagcctgggcaacagagggagaccctgtctctaaaagaaaaaaatagaaagaaaagaaagataactctagcagcttcctgggaagtggatctgaaggactaggactgcaggcaaagtaaccagagcatcattcaagtaagaggtgatgagaatctcagcaaagacaggtggggtaaagaatactatcattcttgctaacagccactgggtgcttaccatgagtcaggcactacctaaatttaatactcacaacaactttgacagaggcaagaacacaagaaggggataatgggtcaggtccaatattgagagggtgaagctggcagggctttgtgattggttgtaggcagagaatggggaagagaggagtcaaagctaatttcaggcttctagactgaatagatagtgctgtcatcatgcttggatgtaagatgacgaggtcagtttcagacaaggtaaaactatgacattttttaggagcagctgtccagcaggtagatgaagagacaattctgatgccatggagagagaggagtgttggaagcagagatttggaagatatcaggaccagatggtgtttgaaattatgagtgtggaggaagccacttagggagagggagacaggcagtggacctagggtgcaataatggagggtgttggcatctacagagtgggtggagaaagaggagggtggatagagaaacagaaggaaggttcagaggtgtttggagacccaggagagggcagtgtctctctggaagtggaaagtggaaagtgtctggaaggaagtggaaagtttcaacagggaaggaaatgatgacatgcagcagagtgaactggtgagagaattgaaaaccctcattgggtttggcactggagaggttattggtggccccagtgaaaatggatttggtggtgaggtggaagcagaaccagcatgtggtttgctgagtagtggatgggtaacgagaaggtaaagaatgcaaaagaaaagaggagaatgcctgggtgcttgctatagggaccatgatggatgcaggaaggatttcattttcaagcatgagagagacaccagcatgctcacagatggagaggaaagagggctccaagaactctgagatcaggagacaatgatagtaactgatagagttggtcaaaggagaggtcagaaggctggtgcagtgagcaggcagtccttggacaggaaggagcaggtacagcctgctctctaagaccacagacagcccactcctgtgttgtcaggcagggtcactacaagcccaggtggtgcctttttgagaactagaaggcaccgtttctcaaggatgactaaagaaaggtcaaggtcatggcgctgcaagcagatcacaggctggatttcagctcccagttgcccctcagccagatgcctgtgtgcagttcacacattacacaactgtacacggtggccccacagtgctctggggagatcagataagtgtcatctgatcccttaccagtagggtaaactggttcaattttcaggagaggaatctggcaatatagaaccagagctacaacacctttcatttattattctactttggggtttatacgcaaaggaaaaacccctacctgcccaaacaaaacagaacccaaatgtagttttttattttattttgagacagggtctcactctgtcgctcaggctggagtgcagtggcacgatctcggctcactgcaacctctgcctcccaggttcaagtgattctcccacctcaacctccagagtagctgggattacaggcgcacgccaccactgctggttaacttctgtatttttagtagagacagggtttcaccacattggctgggctggtatttatattaacttaaagaccatggatacaacccaaataagcaagaaaaggggaacaacaaaatgggataccctccagctactagtaatgacaaattgtagccttaactttttcaaagcttagaaatgattcaagagtggagcaaatcataaaaagtaatgtttataaggtgacttttctgtctagtagcctcagtgaataattcaaaactgtctcgactatgtctacctgatgaaaagaatgtgaatgccttggacaagaacatggtgtttctgaaaatggtatacagtgcttcactgggcaccctctcaggcctaatcacaccttcattattccccttcactgctctcagatttgcaacatcatgaatgcgcctgcggaggacttttttgcatttcaggtaagtcattttttatttgcagtcttagtcatatgattttttttcctccccaaagagcattagaatacattagaatccacccactctgctgggaagcagcctcaacaaagtgaaaatatgacaggataaaattcctgtaccaatggaaatggggacagagttaactgggtaatttccaaggtcctattcagttttaacgttcacactctttgctttctggcctcaggatctatttttccccccacaagatatacaatatataatatacaatatataatacaacattatacaattatacaatatatatacaattatataatgtatacaattatacaatattgtatacaagatatacaatatataatatacaaaagctccaaagtttcatgatcagattcagacattaaagttgtatttcaataaatataatcaaaatgccactttgccaggtgttttgtcgttgttgttgttttcttttgtttttttttttttttttttttttagagagggtctcactctgttgcccaggctggagtgtagtggtgcaatcatagctcattgcagcctcaacctcgtgggttcaagcaaaactcctgcctcagcctgccaattagctagactataggtgtgcaccactatgcctgactggcctcagcacctttgcttatgctgttccctatcatctcctgttcaaatcctgttctaccatctcctattgaaatcctctctgcccttcaatgacaacctcaaatgctactacttctgttaagttttattatgattcctctggctgaatgtaatttctctctccttggtttttttttttttgagacggagtctcgctctgtcgcccaggctggagtgcagtggcgtgatctcggctcactgcaagctccgcctcccaggttcacgccatcctcctgcctcagcctcccaagtagctggaactacaggcgcccgccactacgcccggctaattttttgtatttttagtagaggtgggatctcgccatgttgatcagattggtctcgaactcctgaccgcaggtgatccacccacctcggcctcccaaagtgctgggattacaggcatgagctaccgcgcctgaccttccatttgattttgtcttttttttttttttttaacaaatgtttcatggaagatatcttctgtgaaagcattggcaaaatgttaacacttgctacagtggtgggccagacaagcatagtctttgtctccatgaagctcatgattgcatggggaaagagacaccgagtggtgattaggagaagggcagaggggagaggaggggcatcgctggagattctgacttaatctgggaggaatcaagaaatatgtccccaaaacttatgtttggacagtagagagaggggagaagattgcaggaaaaagatggcttattggaaggaactagaataagccaacaaatctgagtgagaaattgagggagagactggcaggagaagattctagagaggtggacagagaccagatcctgcagggcctggaaaggcacaccaaggaacttgtgtctcttatgtattttccttatgtcatcttttattatccttgtctccgtgtcagactaattcttcttagtaaaatgtgacttcctttggtcaaggttgggtcttatctttcttgatatcctcagctctgggggccctgtcactactgatttggtttagcatgctaggctaaacaaataaaagaaaaacaaatcattatcaatcaggaaataattcagaaggaaataaaaatgactcagaaaagtcagaattacttttttctccttcaagaacattatgaaaaagcttagacagaaaataattccaaagttaaaattgcacttcatgtgttgtgattttgaccacatcaatgcgacaagcctgaagacttgctgagggttgctaacctgaccacaaccacagcagaacgtagtctttactcaagtcatccacttgattgcagtttaactacattagtaaagcaaatttaatcttgtttttagattctggtcttcctcctccaactcatactccataaagtagcctaaataatgttgttttttgtttgtttgtttttgtttttgtttttttgagatggagtttcatacttgttgcccaggctggagtacagtggcacgatctcggctcaccacaacctccgcctcctgggttcaagcgattctgctgcttcagcctcctgagtggctgggattacaggcatgcgcccccattctcagctaattttttattttcagtagagacagggtttcaccatgttggtcagggtggtcttgaactcccgacctcaggtgatctgcctgccttggcctcccaaagtgctgggattacaggcgtgagccactgcgcccagcccctgaataatgtttttaagaaacataggttgggccaggtgcgatggttcacacctgtaatcccaacactttgagagaccgaggcgggcagattacctgaggtcaggggtttgagaccagcctggtcaacatggtgaaactctgtctctactaaaaatacaaaaattagcagagcgtggtagtgggcatctgtaatcccagctatttgggaggctgagacaggagaatcgcttgaacccaggaagcggaggttgcaatgagccgagatagtgccactatactcctgcctgggtgacagagcaaaactccgtctcaacaaaaaacaaaaaacacaggttgaatcaatgatttctttgcttaaaaatctttaatggtgtcctctttcattttcaataaaatctgtctttttatcatggccttcagagggaagggattccatgaagattaggtagagtgctacgggcagccaggtctgagttcaatacaaacctgtgctcttcaggcagtattctgcatccttttggagacactctctcaccaggtgctaagacagctgttttactttccagtattatttaaataataacaattatcatctcaccatgttaagaatcttgaaacttcaggattggaagactcacctactccaggaagccttccttgacttccttttctcctctggctcccatagttccataatgtaactctcttagagaacttcccacactgcagtgtaattgctggtttaccttacagattatgagcaacctgaggacaagatctgtgccttggcttcctcagtttctagctcagtttcttgcacattctaaatgtctgatgaaccaatggatatatatatatatatatatatatatatatatatacatatatatttttcgagatggagtctctgtctgttgcccaggctggagtgcagtggcacgatctcagctcactgcaacctctgcctcctgggttcaagcgattctcccatctcagcctcccgagtagctgggattacaggagcatgccgccacatccggctaattggctaatttttgtatttttagtagagacagggttttaccatgttcttcaggctggtctcaaactcctgacatcaagtgatccgcctgcctcgacttcccaaaatgctgggattataggtgtgagtcgccatgcctagcctcaccaaaggcatcttataattgatcaagaacttcatttgttcagtgaggcacagattctttccattctatagatgagaaaattgaggccccaggagagaaaatgaagtactaaaagtaacataggaagtcagggcaagaggcaaaatgtgcaggttatatctaggttattaattcaacgttacaagaatcatagcattgcccttttaagccagtcccctgccactgcctcccatatctgaaagagaaacactacctctctgggatgttctgcacatcattacatccctgtaacacactgcctgacacacactggccctgacatctgaggggtgaacacaaaatggctacttggcttaaggaattccgaccagatgggttatttctcatggtagttgtcggtaattaaactcatgcgaaatccaatgaactccatcctcttgccacctcctctcagccaatcagggtcatgatgtagggtgaaatctatcatcgttgcctctgtggcctgaaacaagaggaaacctaatctagcccttctcttgtagaaagaacctctggatgagtctggatggatgattaaaaatgtgctttcaatgccgattgtgaacaagaaggaagaaattgttggagtggccacattttacaatcgtaaagatgggaagccctttgatgaaatggatgagacgctcatggaggtatggcttgctaggaggccttttgctgttgggattcagagtcagcttgctgggggaggctgggtgtcactgcgctatcacatggggcagcaacctggttgctataaccctgactctgcctcatcaaccactttcttcactctcactgctgtactgcactgatgtgctgtcagagaaatccacatttcctttttaaaaaatgtaattaagctgagcatggtggctctcacctgtaatcccagcactttgagaggttgaggcagatgaatcacttgagcccaggaactcaagaccagcctggccaacagggcaatatcctatttctacaaaaagttaaaaaaagattagccaggcatggtagcgcatacctgtggtcctagttactcaggagactgaagcaagaggatcacttgagcccaagaggtcaaagctgcagtgagccatgattgtgccattgcaatccatcctgggtgacagagcaagaccccgtctcaaaaaaataaaaaataaaaaataattaacaaactttactttttagagtagttttaggttcttagcaaaattgagcaaaaagtacagcgttcctagatatcccctatccccacataggcaaaaacacattctctttttgtgaagttattacacataagaatggtactttctgtatgttagtgctttaagtacagtgtggtcacatccattcctttatcttagccttataagaactccgcaaggtgggcagcacacagcttatcaaacccattttatagctgagaaaacagaggcctagagactcttgctatgagttttagagtcaagattaaacttaggtgttctgtctctgattcctcctttctttctttttcagtctttgactcaatttctgggctggtctgtcttaaatcctgacacctatgagtcaatgaataaacttgaaaataggaaggatattttccaggacatagtaaaatatcatgtgaagtgtgacaatgaagaaattcagaaaatcttggtgtgtaatgttctttacttgtttctactctaatacagactgcgtctcagagatgtggccagattaaggcaaaacttgcaactccatgagggcacagcctgggcatgggtttgtgcactgttgtgttccttcctgcctagcacagggatgcagcagccctcaacatttaatgaatgaatgaatgaatgagtgcatgagcagatgagtgcctgagagtggtacataacgactgcactgtgtggcctggggacagctattgcttgcagaaacacctcattcttggggtcagatgttggcttgacagctctagaaactccatttttcacagtgctcagggatgacttgctactggagacagagtcaaccagccatagcccctactctgagaggaagctttatctggaagaccagtagacaattatcagtttctcagagcctccctcctgtggggtcagctcacttaaaagaccctattaagttgggtgcagtggcttacacctataatctcagcactttgggaggccaaggtggtcagatcgcttgagcccaggagtttgagaccagcctgggcaacacagcgagaccctgtctctaccaaaaaaaaccccacaaaaattagtcaggcatggtggcgtgtgcctgtagtcccagctactcgggaggctgaggtgggaggatcacctgagcccatggaggtcaaaggctgcagtgagccgtgattgccacaccatgcttcagcctggctgacagagtgagaccagaaaaaaagaaaaaataaagacaggctaatgtttttagagggcatttcttaagctgggaagataccacaacaaatttgatcatttcattccaataactgttaaattcagaagagaaaacatcccgtttaaataaattgcctcatggtttgcttgactcagtccacagtttcagccaaagaatgggtatgtgcaacctatcggggcacagcctcggtgaaccagttacaa

SEQ ID NO: 14151 - DNA, 44120 bp, Human
aggtgcccccaatacatcttctatactgcaccagagacagtctgctaacacccacatcaggttgtgtcactcccttttaaaaaatcctggccggccgggcgcggtggatcaagcctgtaatcccagcactttgggaggccgaggtgggtggatcacttgaggtcaggagttcaagaccagcctggccaatatggcaaaaccccatctctactaaaaatacaaaagttagccgggtgtggtggcaggggcctatagtctcagctacttgggaggctgaggcaggagaactgcttgaacctggggggcggaggttgcagtgagctgagatcacaacactccactacagcctgggtgacagagcaagacccgatctcaaaacaaacaacaaaacctcctaattgacttccgtttactgtcataataaactccaaactctatcctggcatcaaagctcctgccaccctggctggcatcaccacctgcctgctcccagctgcaccagttcctcctgccatagtctggactacccctggggtccctgggtgcctatgggaatccaactctggccaattctgcagaagtcccagcgggactagcgcagaggccctgtccgtgtccctcactgctcactgcagtgcttggcccccagcaggtcctcaacggctgcaggataaatataataagtgccatgccctttcctgttttccctcagaggcaccctcccccgagctgggggagcaggcttctggctgcgtgtgtccttggcacccagcctctccgaggacagcaagttcactgcaggagggcggggatgggacccacagagcctggagtggagagtcccggacagagtggtgggaaaggaagcgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcggggtaagtggcggtccccacggggcaagtggcggtccccacggggcagcggcctagagaggcggaccccgcagtgtccgggtcccgggccctcacccgcgcccactgcaacccgactccggagctccgagcatcccttagttttaagtcatggcgggtgcgaacgggtctctgctgcaggcggctccgtgacagctcctgcttcacatgggtagaggagagacggcaaacgtcggggctcccaggacttcgcggcggcagtcctaacccgtgcactgagtcgggcggggcgggcggcagcgtctgagtagagagctctctagaccaggcctggtgtctcccgggctttcctaggtgcctgtttgcgagctggtcagctgggctgtagttgagttctcccagggagtgtgggaggaaaggttatgcccaccagagacccagggtcctgacggctggaggtccgcagtggggaaggtgggcagaggtgttgctcagatgtccccattcctgtttcgtttgcacagaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagtgagtgagctacctgtgtctttgctaggctagagggaaatgcagagaaggctgggtttggtcttgcaccaggttctgtgggagacgggttgctggcaactgtctacacaggaatgctgtctccagtacttggaggccgacatgtccttcctcaggagacttcgaaagtcaggatcttggtgacctggttcaggcacacttgagttactattcagatgttgatgaaagaaagcccatcttatagatgaggcctgagtatcatcatcttcacaggtaaggatatgtccaggtgttacatgataagatgtgagttcctgggagaagtaggttctttattttattttttttttgagactgagtcttgctctgttgcctaggctggagtgcagtggcacaatctctgctcgctgctacctctgcctcccagtttcaagtggttctcctgcctcagcctcctgagtagctgggactacagacacgtgccaccacacccatttaatttttgtatttttagtagagatggagtttcactatcttggccaggctggtcttgaactgctgacctcaggtgatctgcccgctttggcctcccaaagtgctgggattacaggcatgagccatcgcacatgggctaggtcgttatcttttatgtgtgtttgtgtctttgtcacacatgcctggcattgtgttttgcccatgagtaaatgctgaatttttgcacttgtaaagttttctacttagaaacaactaaaacgttcatcaactgatgaataaaatatagtccatcctggctgggtgcggtggctcacgcctgtcatcccagcactttgggaggccgaggcgggtggatcacctgaggtcaggagtttgagaccagcctggccaacatggcgaaaccccgtctctactaaaaataccaaaaattagccggtcatagtggtgggcgcctgtaattccagctactcggggggctgagacgagaattgcttgaacccgggaggcggaggtttcagtgagccgtgatcgcgccactgcactccatcctggggaagaagagcaaaactccgtctaaaaaaaaattgtgcagtttgaaattgtatttcatgttatgttttatctcaatacaacatttgcagttgtgaaaaaaaattgcacattctcaactcctcgggatggagcagtaaagcccctcagtaaatctttttttttttttttttttgagaccgagtttcgctcttgtcacccaggctggagcgcaggggcgcgatctcggctcactgcaatctccgcctcctgggttcaagggattctcctgcctcactctcccgagtagctgggattatagacgcccaccaccacgcccagcaaattttttgtatttttagtagagacagggtttcatcatgttgggcaggctggtctcaaactcctgacctctggtgatccacctgccttggccccccaaagtgcagggattacaggcctgagccaccgcggctcgtcaagtgaatcttgattccagaaagatctgttttaagtctctagtctggaaaatgcagtgggagtctttaggtggtttgtgacttgcagttaaggagaccgtggcctgagcactggcccctttttcttctttcatctctctccaggaactgagcatggaatgtggcctcaacaatcgcatccggatgatagggcagatttgtgaagtcgcaaaaaccaagaaatttgaagaggtaggtttatccagttgagctactagagagaggcacgtagactattcagagcctgagtttgctttttttaggaacatggttgacagctgactgccgatgatctggtttgcactttttttttttttttttttttgagatggagtcttgctctgtcgcccaggctggcacaatcttggctcactgcagcctctgcctcctgggttcaagcagttctcctgcctcagcctcctgagtagctgggattacaggcacgcgccaccacacccggctttttgtatttttagtagagacggggtttcgccatgttggccaggctggtcttgaactcctgacctcgtgaaccatatgcctcagcctcccaaagtgctgggattacaggcgtgagccactgcgcccagccagtttgcactgttttaggggaatttagctttcatcgtagtgatggggaagctactggaaatgccccgaatacaaccttgagggaccaatcaagcgtggaaatggggagcaaagggattaggcttttctagcaacaccagaaaggatttctatgccgagcgggggtgcgggggcttatgcctgtaatcctaggactttgggaggccgaggtgggtggatcacgaggtcaggagttcaagaccactctggccaacatggcgaaaccccgtctgtactaaaagatgatgagccgggcatggtggcacatgcctgtaatcccagctacttgggaggctgaggcaggagaatcgcttgaacccgggaggcacaggttgcagtgagccgagatcgccccactgcactccagtctgggtgacggagcaagactctgtctcaaaaaaaaaaaaaaggaagagtttgtagtggctgatagaaacgcatgctcactcgctctctcctgttacaagttcaggccaagaaaaatcaagaaagggtttgttccacagagaacaatcctaggcacgctggtcttggtgccattttgggagggtgactggtcggtggtattgggcgacctcacggacatagaaatatttattttgggcaaacattgccagactttcctgatgacttgtggacaggacaggaagtggtcattttgggagtgcaggttgctggtagagcacctgagggctctgcccttgccttgcccagcatttgtgtgtgggagagcagtgagacctggacctctcatgctcagatctgctaagaggagagtgattgctacctctgcagcagctcatctgaaacgtgctggccgtacgctaccaaagataggtgtaaagaacaggtgtccttagccgggcgcagtggttcacgcctgtaatcccagcactttgggaggccaaggtggatggatcacctgaggtgaggagttcgagacccgcctggccaatgtggcaaaaccctgtttctactaaagatacaaaaattagctgggcatggtgtcgggcacctgtaatcccagctacttgggaggctgagggaggagaatcgcttaaactcaggaggcagaggttgtggtgagctgagattgtgccattgcactgcagcctgggcaacagagcaagactgtctcagaaaacaaaaaaaagaacaagcgtcctgcatcctgttctgaaagttgtttgtgtgggtacggggcagcctgtgagtggataaataggcctccgaggctgggatggtcccgggccctgtgtccacggatctttgcagctcaggttgcaacggtaagagtattgtcaatgagacaaaggaggtgagagtgccagttgtctgaattggttgggatgttggtcagatgacatctaaaagaacacggccattttgttattatttggttagagacaaggtctcactctgtcacccaggccggggtgcagtgtcacaatcatggctcactacagcctcaacctgccaggctcacgtgatcctcctactttagcctctcaagtagctgggactacaggcatgcagcaccacgcctggctaagttttgtaatttttgtcgtgacagggtctcactgtgttgcccaggctagtctgaaactcctgggctgacgtgaccctctcccctctgccacccgaagtgctgagattacaggtgtgagccaccgcacttggccggaacacggccattttagttcccctccttagaggagtaaggccaggaatgagcctgtggtctgaaagccgtggctgttggttaatgtggagaagggaaggtggtgagagccagcccaaacccctgccgagtgagactgattctggcagctttagggagcagggatgagcccctcacaggctgggtggtagttagaggaggcagatttcagaaggccacgcagcgctctttctcagcaggtcaggcaggcagcagaggtcgggcaggggcatggggtcgagggcccgatgctggtgtgttcactagaggagagccacaagcagggattctgggtcaggtgcaggcctagggcttagtgtgcacttgtggttctgagactgtcccatgacttcctgtcagcattccggcagctctagtgggactccctcctggtccaggtgaggccaccattgctgccctggcttgctgctgtcctctcagcccccagtctgtcacctggtgggagttaaagggacctgctggggtttgaggaagctctgagccgttccctgtacgaagcctgtggtcatctcaggctgcaggagacacaggagatacgagctttggaggtggggctctcagtcacaagcccccgttgttcctccctgtcctccgctcacggcactgctccagttgccggggccagggttcttggagagcacatcctcaccgctgtcccctctgctggtgacagcacgcagtggaagcactctggaaggcggtcgcggatctgttgcagccggagcggccgctggaggcccggcacgcggtgctggctctgctgaaggccatcgtgcaggggcaggtaaggcccagggcgacgctgggatgggtgacgtcaggctgcccactgactgtcctgtccctgctgggccgtgtttggactcctgcctcggtgagttgctgggcacagggtctaggggctgatgggctctggagctggatggcctgtggggtctcctggtgtcatgaggtctgtgtgaccgtaggcactgcctcctcgcctgtaaacagatggtcactgcaccttcctcttatgggatgttctggggatcatatgaggcagttctcgcagagtgctgagatcgtacctggcagctggtgtggggctacggtgttgttttgcccttgcaccctttcggggccactcccctgctcactgcattccatctgtgctggtcttggctgaccctgaacacccaggcctcttggtgttcctgcctcccctggtcggccacttctactccttcatgtcccagctgctcagaagggccgtccactctcacaggctctcctgggtttcccccactcaggccttgtcctcagtctctgagcacaaggctgtctgccctgcaccgagtgcaggggtcgggcaggagctgtgtcatcccctgctctgcgccacccgctgtgccaggtcccgacacacagcagttgctccccatacgccgctctgcggtcggccggtgcatccggccccctgccctgtacaatgctgatgctgcagacctgtctcttgcagggcgcctctgtgggaaggagaggggtccagggctggagtccgggtgcccctgcacttcagggacttcttggcagccgtgtgggcgacgctggcaggctctgctgatcctgtggcttttgtctttagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctgggtgggtgccaccttgggttggaggtttctctggccttgacgatcaagtgtaacctggatgggaaggacctggggctggggaggggctgccgttctcagggatggcctgcagcgggtatgcccaccctgcttcatgcacctgggctcacctgcgtggccggagtgcccctgaggcacgtgttaaaaatgcagagtcctggccttcaccccagacctgctgactgtgagtctctggggcttggggcctccgaacacctctgcaacggcaggagctgggcgagttctgtcactgggaggtggtgctgctgacttggtctcaaccggagcgtactggtcccgtcttcctcctcctttctccactttgtggaccttcctcctgccatcctgtggtgggaggtttccattagtcttgggtctctgtgtcatgattctgggaagtagagaaagaggaggaagagatcggtctgactctggctttgctgttctgtcgcccagaaaagggcctcagtggctgggctgcctgcaggacaggtgccggccaggtgcctaccgtcaggtttcctgtctgaggtgacgtggccggcagccaagtgtgcacacgtctcctccgagccgctctctgctgggggtggggaacgcccaggagtctggtgatgtcggcgtctcccagcctcgggttgggccctgagtgtacggcatacacacttctgctgccgcctcggcacagaccctctgtgcagccccaggggcggtagatcctagtgtccgtgcgtagccggcctgccctgggctcccctgagcctcttcgggcccagtgcgtggtctgtctgttgctgccgggggactgatgatggggtttctggcagtgacgggtttggacacactgtcctgcggcgggagggggaggtgagtgggagatgtagattcggcgtcctcgcaaactgccgccgcttctcccccagctgactttgtcctgcagtggatggatgttggcttgtcctcggaattccttctggtgctggtgaacttggtcaaattcaatagctgttacctcgacgagtacatcgcaaggatggttcagtaagaaaagaattgagatcctgttctgataatggtcctaagttcagctccgcagtgaataaagttgaaaccaccaaaaaaatagaggttgggctgggcacaatggctcacgcctgtaatctcagcactttgggaggccgaggcaggcggatcacgaggtcaggagttcgagaccagcctggccaacatggtgaaaccctgtctctactaaaaatacaaaaattagccgggcatggtggtgggagcctgtaatcccagctactcaggaggctgaggcaggagaattgcttgaaaccggaaggcagaggttgcagtgagcggagatcgtgccactgcactccagcctgggtgaaagagcaaaactccatctcaaaaaaaaaaaaaaaaaaagagaagtacgtagctatcttctgtttagctctcatctgatgtcttggttatctttttgttgtttgtttagaatgttgcatgagctctgtctcactcatgctgaacacccagcaccgagagcagtggctggcgcacagcaggcacctgagtgcttgttgggtgggtgggacccccagggaggatgagccatgcgtgttattgacgtcatagagtgactagaccacagcccgtggtggctcggccatccaggcagtgctgccgggactgagctcggtgctccctgcaggatgatctgtctgctgtgcgtccggaccgcgtcctctgtggacatagaggtcagtgcctcccctccccagggccggcccatttcaccctggtttctgggaggctggggcttgggggttgagccctgtgtgccacctgctggctgtgtagccctgggcaagctgctcggtctctctgagcctcaggagtcccccatgtaagtcaggatagccgggcgcctccatgtggagatgtagctcagggtggatgacagcatcaatgacccacagtgacagggacgtcaggtgcttcccacatgcccgcttgccctgtggcttggagagagggtgccatggcagcggggagaggtggcagcgcaggctgaaggaggtgggaaggaagcctgggtgtcctctcctgtggggaggagctggggtaggacgggcgtgagccgtctccctctccaccaggtctccctgcaggtgctggacgccgtggtctgctacaactgcctgccggctgagagcctcccgctgttcatcgttaccctctgtcgcaccatcaacgtcaaggagctctgcgagccttgctggaaggtggggtttctgaaactgctctggaaggttcctgagagcacatggatgggacaagggccatcctgtctcccatgaatggttgtctgattcttggggtggccagacaatggcctgttgagggacggccagtgtcattttcccaggcagttgagctgaggtcagggttttggtggcattttgagaaccctgctgcctctgtctttgggaggagatggtggcgagctggccggaccttgggtggctatagggcagcagccaggcggggccagcagcgggactggggctgggggcagggcttatgcctgccagcccctgacacgcattgtgtctcgcagctgatgcggaacctccttggcacccacctgggccacagcgccatctacaacatgtgccacctcatggaggacaggtgagtgtggtgggtggggcgcagggcagtggaggccagcacagccctcggggcagctccagtgtcccttgccaagcacacactggcttagagagtccttgtcctctcgggcagctgttccagaggctgccactagagcgaggcccatgacttctaggatccagcccctgtcctctccttcctctgtcagttcaacagaatatccacacccagctcagtgcctgccccatgctcggacgtcctccagcggtgctccccaactacttagcctgttacaaggcgaggctcggggtcttggcttgacgttgcccttgccctcacccccacagccaggctgtggccacttttgttgctttagccattagagatggctcagctctgcccacaccctggcctcccacccatgctgccagctccccctcctgctctcctgtatccatccgcgcctcctgaagcccactccatgcagcacccgggtggcctttttctgacacagatatgtcggtgtcaccctttgctggaagccaggtggttcccagcgcccttgggatgtaggcttctcctatggaaccaggccctggggccagccctgcctcagccctgcatctctcccagccctgcctcggcccctgcatctctcccagccctgcctcggcccctgcatctctcccagccctgcctcggcccctgcatctctcccagccctgcctcggcccctgcatctctcccagccctgcctcggcccctgcatctctcccagccctgcctcggcccctgcatctctcccagccctgcctcggcccctgcatctctcccagccctgcctcggcccctgcatctctcccagccctgcctcggccctgcatctttccttccctccatccttggaaccaggccctggggcccagccctgcctcagccctgcatctctcctagccctgcctcagcccctgcatctctccctccctcctcccgtagaaccaggccctgggggccagccctgcctcagcctgcatctctcccagccctgccccaccccctgcatctctcctttcctccatcttgccttctcccctccaccaagggcttgtgcatgccctgattcctcttgccagcaggttcttccacctttgccgagttactctgtttactgaggtcttagcgtggtcactgactcccccacctccctgagtagtttttgctgtggctttccttcttggctgtgattggaggaagagattttgcgtttacctgggagattatgtggctggcgcctgtctcccccagactgcgaggctgtgggccatccctcttgcctgcttcctgtccctggcatgacctgtagctcacagcgtggtcagcagtgatgggctgccgcctgtgcgcaggagtgaacaagagtgttactgctggcctctgttccctgcccttccccagcggtgctcctgccccccccaagcacagggacctctggggctgctgcaggagcctcggcaacctcacacatccatggcggaccctgggacagggccctgctcacattccgtctctctggggaacacttttagagcctacatggaggacgcgcccctgctgagaggagccgtgttttttgtgggcatggctctctggggagcccaccggctctattctctcaggaactcgccgacatctgtgttgccatcattttaccaggtaaggcggtttctgtgtgcagtgagctggcaggaacgggagagctcccctcacgcctgcccacccatcccactgggggtcctgctgcgggggctgcggtggcatttctaggcctttccaggcagttgctttgcagctgggggtgaggtttggggccctttgtaggctttagtcttttttttttttttttgagaaggagttctgctctttctgcttggctgactgcaatctccgcctcccggattcaagtgattctattgcctcagactcctgagtagctgggattacaggtgcctggtaccatgcctggctaattttgtgtttttagtagagacggggtttcgccatgttggccaggctggtctcgaattcctgacctgaagtgatccacccatctcagactcccaaagtgctaggattacaggcgtgagccaccatgcctggccaaaggcttttttctctctctctttttttttttttttttttttgagacagagttttactcttgttgcccagggtggagtgcaatggtgcgatctcggctcactgcaacctctgcctccccagttcaagccattctgcctcagcctcctgagtagctgggattacaggtgcctgccacagtgcctggctaatggtttttttttttttttttttttttttaatgggacagagtttcgctcttattgcccaggctggagtgcaatggcgcgatcttggctcagcgcaacctccgcctcccaggttcaagccattctcctgcctcagcctcctgagtagctgggattataggcatgggccactacacacagctaattttttatttttagtagagactgggtttctccacattggtcaggctggtctcaaactcccgacctcaggtgatccgccagcctcagcctcccaaagtgctggaattataggtatgagtcaccgtgcccggccaaggctaatgttttgtatttttattagagatggggtttcaccatgttggtcaggctggtcttgaactcctgacctcaggtgatccacccgccttggtctcccaaagtgctgagattataggcatgagccactgcgcgcagcccaaaggctttattctcaagcaaaccttacatcttgcgagtttcaccttctggagttggcagtggaggggtgaacgctgcctcgggggtagccgttctcttgctgttggcggctctgttttgtcaagtgctggtcttgtcctgtctctgcaatgacgccgtggcacagacgctggtggtacagcttcagtttccgcagtgccccgtgatgacagcgctttttgtgtccgtcctcgttctgtgctcacagctccctggagggtggggcgatcacgtcgtcctggttttatagtgatgagctgcggtgtgggtcacagggctctcctgatcctctgctcttcctgctacccccctccccgtaggggcggtggggggatgttgtctttgtgcacagcttgcagccgaactcagggcagctttcagttgctgctgggctggcccaccgggtgcccaggattcagttgctggtctgtccgagtcagggactttgcaggcaggcatgggggtggggcccgtctgggtcctgactgtgctggagcatgtagaaacccctcctgggcgccccacctgctgtttctgcggcccctgataaacgtgtggtgggcactgcgcgctcaggcgtgctactctcggtcccaagggtgactgggagggcgtcccacagcaagcaagcagctctgaccctgtgtgctggccgggctcgtgttccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccaggtggggtgggggcaggagctccggggagcaccgggaacccagacaggcaggctcggcccactcagaagatggtaccttgggccccatctctgggggtcccgcagagactgccagaaccgtgttctctggtgattcgcagtggcgctcatccaccttccaccggagacaggtctgatttttccagacgtggtgcatcgtttaggccccagacaggaatatgcagtaggtgagccggggctgggccagtgctgtccacagtccgcagagtgacctgcaggccgccttcgtggcctgagtgggccccggcacagttcccagagggatgccagtgtggcttccgcatgactttggaggaccgcattagtcgagtctgttaaccacagctttaaggaggactccacggccacacgggctcgtcagcataggggccctggggaggcgaggctagtatccagcagcctcagggctgtgccttttcctggagcctggggcgggtgatgtacaggaggccaggcagcagaagggaggccgggacttcgccgggacttagcagggactgaagtcctctcagagcctgtcgctgggccagagcattgcccccgaccgctggtggcagtggcagaggtcatagcctggggcttctaaaagaggctggacctgggagaggcaagaaaggcttgtagttgtggctactcttggccctcctgcccgagcttccttcttggcccagctgcatgggcacagccaagattccttggggggtggggtacgggcaggaacagcagctgccatcacagccactgtggccccttgagaggatctggggggtgtcctgggccacgtgggtcagggtggcccctggagaggatctgggggtgtctcaacccatgaggcccggagcggcctcagagggctgggggcgtctgtccccatgcggcccagagcggcctgagagggctgagggcgtctccatgcggtgggtgtgtagcgaggcctctggtgccaagtccatgtggggagtggaagtcagcctgtgtcatcgtgcctggtactgcagaccttggacagcccggagctcaggaccatcgtccatgacctgttgaccacggtggaggagctgtgtgaccagaacgagttccacgggtctcaggagagatactttgaactggtggagagatgtgcggaccagaggcctgtgagaccccctcctgggtggggcctttgggctttggctggtggggaggggccgggtgctgggtgaagtgcagctttctgagcctcagaagccaagggccaggtgggcgcctgctttccaggtttctgcactcggcagggaaggctggcaggcacagcacgtgtttggtaacaagctcggggctagcccacccatcagtttcctcccacctgtgtggagcaagcttccatccggctctgtagagtcctgtggctcccaggcggccgcagtcattttgccaggaacactcagcttagggcccaggcttttccatgggtttggacacaagtcttccccgctgccaggagtgcctttgtgtctgggctgtgggctgcaggctgtgaggcggctgggctctgacagcaaaccagcctctcgaccagcagcccagtgtggagaaggagagcgccggaggggcagaggggcaacaccggctcttcttttgacaggagtcctccctcctgaacctgatctcctatagagcgcagtccatccacccggccaaggacggctggattcagaacctgcaggcgctgatggagagattcttcaggtagggggtcctctgtagccttgcctggcacctggagcctggccctgtctctgtctggggcccacccgggctgggtctcaggatgcccgatgagcagggccctcccctctgcctctggagagccctggctctgggtgagcaggtgctagcttgctttccagtccagcaggacaggtcctctcatgacgccactgggctccctcttttcgggggtcgtctggagagatgctccctgggaagcagagctctgtgccctgtgtgcctggccgcgggaggacccagagtcgggctggcctgcgccaggcagacgggctggtgtggggctgtggccgggcactccccacccgccccagcaggctgccgtcccgcaggagcgagtcccgaggcgccgtgcgcatcaaggtgctggacgtgctgtcctttgtgctgctcatcaacaggcagttctatgaggtgcgtgtccaggcggccgcagctgggggctcagggctatttctccgtgggcgggctgtctctgttgtgcacgtgctcccgcagagccgggctctgcctgggacttcggtcctgccggaccctctgcagcccccagcgtggtctgtttacccctgttcattcactggcttgctcgtcctgggtgcctctgccaggccttgacacgtggccaagtagcaaggaaggcacagtgcctgccctcagggagctccggccggttttcacccaacacaggagcctcttaaaaattctgtgtgagttcgtttcagccagtcttgcatggggacattgtcttccgtttcagtcctgacgttcaccctgtgcacctgcgtgatcgccagccctgcctggtctctcctctgcgggctctccctctccactccctcctctgggagctctgtggccccaggcccaccttccttgagagacatttgtgtgcctgccagtcatacccctttcccaggaggcgcagcttaggctctgaggctgtcccttcccaccgaactcctccctgcagcctcgcagtcctgccctcctgagagctgcccactctgctcctctccccagcgtccactgtccttgaattgccctttgctgggcattgcgatcccgcattctgtctgagggagctaagggcctcctggaagttcctctgggtcctctggcttctcccatcagggctggtcttgtcctggtctctgttcctgtggaactttttacctgcttctgtgaaaactcacgctgtcctcagcacagcacgcacacacacgcatattcacgcatgcacaggcacacacgtgcacatgcccacgcgtgcacacagccacacacaccctcacgcacacacgcacagcaccatgtgggaggggttctcggctgtgacagtgaagggcagggcctcacctcggctgctccttgtgagttgtgggccccgtgtctgtgcccggccgccctgcggtgctcaccagccttctgaacgaggagctggacaggatccctggaaggggccccggggtctctgagtcgcgctcagcgggtgcttgtgctctctgcccagctgtgctgaagtcccgagggacatgtccgctgcttgcgggtcggttcctgaggaattggaagtgtcacgagatgtggccctcgttgggctggcgctcattggcctcccttgtgcctgtgcaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgagagccgttgtacccggggccgggtgctagcgtgccagagctccgtgggcagcaatggcctctgggccctctgtcctcctcttcgagtgaccggatggctgtgtccgtaggtgaggctcccctccctgcagggtgggtgtcccgaggcctgtgcagggcctgccactgctggatttgtgtcctgactgaaagtcctggacatgggtgtcctgtcacactctgggacagctgggctgggcctcctggaccgacgctggagcccagacctggggctggggctttggcctgccgtcctccctgcccagccaacagctttgctctttgattttcagatgcattttggtttctgcacagtcactcgggtataaagggcatctttgcttttgagcaataaagatgaaggccgggcacagtggctcacgcctgtaatcccagcattttgggaggctgaggcaggtggattgcttgagttcaggagttcaagaccagcctggccaacatggtgaaatcctgtctctactaaaaatataaaaattagctgcacgtggtggcgggcacctgcaatcccagctgctcaggaggctgaggcaggagaatcgcttgaacctgggaggtgaaggttgcagtgagccaagattctgccactgcactccagcctggacgacagagcaagactctgtctcaaaaagaaaaaaaaaaagggccgggcacggtggctcatgcctgtaatcccagcactttgggaggccaaggcaggcggatcatgaggtcaggagatcaagaccatcctggctaacacggtgaaaccccatctctactaaaaatacaaaaaattagctgggcgtggtggcgggcgcctgtagtcctagctactggggaggctgaggcaggagaatggcgtgaacctgggaggcggagcttgtagtgagctgagattgtgccaccgcactccagcctgggcgacagagcaagactcgatctcaaaaaaaaaaaaaaaaaaaaaaaaggtgtttgtggtagaaagtgttctcacggctgctgactcagaaccatgagcctgtgtgtaagtcctggccttctcttcaaaggtgatggcccgctccctctccccacccccggagctggaagaaagggatgtggccgcatactcggcctccttggaggatgtgaagacagccgtcctggggcttctggtcatccttcaggtgggtgttctgcacgaggcctctgctcccggggcgcgcatggctagcgtccaccagctgcatctgcgttgtgttggagtctgttccccagcgggacccacaccctccctggatttgctgagggtgcggtggtctcagcaggcagcagaaccttcctcctgctcttgtggagggatggatgcaagaggccccgttgtacgccctgaccagagcttgtctctgtgctcctgagtcagggccggaaccatgtaccatcctcagcgtggcgcttgccctcgtcacccagcacagcacctgggaagtaagggtggccctccattcctgccctgcagtccgtttaatatttgcagctgttttgttgagatttaatttacatatcatgcaatttacccattcacagtgaacagttcagtggttttcagtaaattcacagagctctgcagccaaccccacagtcagcttgagaacctcctgagcataccagtagcacacgctcccatcccccgttgctcccgtacccccgggtaccatcaagctgcttcctgtctctgtggatttacctactctcaacatttcatggaagtggaatcacacaaaattcatccataagatgttggatggtagaacagtttcctgtctgctgactggattgttccacccagcgccatgtgtccaggcccgtccaggctgtggcagctgttggtgctcccctccttttcatggctgagtagtattccatcatctggaaggagcacattttgtctgtccgttcctccattggtggacatttggcctgtgtccgccttgcagctgcggtgagtggtgctgctgtgaaccttctcctacgagggctccgccgggcctgcattttcacttttgggtctgcacctaggagtgaattgttgggccctaggtttagtctgcatttggtgtttcaaggcgataccaggctgttttccactggtgctgtgccattttccatccactcgagcagcatgtaagggttctgatttatctttttttttttttttttttttttttgatacagtctcactctgtcgcccaggctggagtggagtgcagtggcgcgatcttggctcactgcaaccttcgcctcttgggttcaggcgattctcctacctcagcctcctgagcatctcgtattacaggcacctgccaacatactcggctaattttttgtattattagtagaaactgggtttcaccatgttggccaggctggtcttgaactcctgacctcaggtgatcctcccgccttggcctcccaaagtgctgggattacaggtgtgagccaccacgcccggcctgcctctacttttcaaagcctcacagcatcacttacgtgtgactgtcagtgtcagtatcgtgtaaaatataatgtatgaatcagtttgctcaaaagctcatccttaagatgttggatggtagaacaatttcctgtcatgtttatatgtcatgggtttttatttcttgccatggaagttgaaagtggtgatgatttttttttttaattaattttttgagacaagatctcactctgtcgcccaggctggggtgcagtgctgtgaccatagctcagtgcagccttgaactcctgtgaccaagtgatcgtcctgcctcggaggcctcccaagtagctgggaccataggcacacgtcaccacacctggctaattttttcattttttgtagagatggggtctttatatgttgcccagcctggcatcaacctcctggcctcaagcagttctcccaccatagcctcccaaagtgctgggattacaggcatgagccaccacacctggccgtggtgtttgattaaaaaccaggcatcagccgggtgtggtggctcatgcccgtaatcccagcactttgggaggctgaggtgggtggatcacctgaggttgggagttcaagaccagcctgaccaacatggagaaaccccgtctctactaaaaatacaaaattagccgggcgtggtggcgcatgcctgtagtcccagctactcgggaggctgaggcaggagaatcacttgaacccatgaggcagagggtacagtaagcccagatcacgccattgcactccagcctaggcaacaagaatgaaacaacgtctcaaaaacaaaacaaagcaaaaacaggcatcacctccttggtgtctcatccacatgagcaccatgctctttactgactggttgggaaggggtgtgctgggctgtgggggcctatggcctgggagaactgagaacctttctgcttctgcagagggaaggaaagaggttctgttgcccttacttggaactccagccctggaggcctgagggtctgggctgcagaactgagatatttcctagttgaggcagagtcctggttctggctgctttcatttctttatttttttgagatagagtctcaccactatgtcacccaggctggagtgcagcggcacgatctcacctcactgcaacctccgcctcccaggttcaagcaattctcttgcctcagcctcctgagtagctgagatgacaggtgcgcaccaccacacctggctaatttttgtatttttagtagtgacatggtttcaccatgttggccaggctggtctcaatctcctgacctcaagtgatccacccaccccagacccccaaagtgttgggattacaggcgtgagccatcgtgcctggcctgttttcatttcttttgttataattgaaaagtaacacagttgactcttgaacagtatggggctgggagtgccagcccctgtgcaggtgaaaatccccatctaacttttaactccccagaaactttaccaacagccctctgttgactagaagccttgctgatagcagacagtctattaatgtacagctcgtgtgttttatgtattctgtgtttttacagtgaagtaagctagagaaaagcaaatgctgttaagatgctaggcatggtgactcacgcctgtaatcctggcagtttgggaggccgaggcgggcagatcatgaggccaggagttcgagaccagcctgaccaacatggtgaaaccccgtctctactaaaaatacaaaaattagctggatgcggtggtgcgcacctgtaatcccagctactcgggaggctgaggtaggagaatcacttgaacctgggaggtggaggttgcagtgacctgagatcgtgccatggcactccagcctgggcgacagagaaagactccgtctcaaaaaaaaaaaaaaaaaaaaaaatcataaggaagcgaaaatacatttcctgttccttaagtggaagtggctcatcaccaaggtcttcattgttgtcatcctcatgttgaggggactgaggaggaaggagaggagacacatggtcttgctctctcgggtgggagaggcggaagaaaattggcatgtaagtgacccatgaaggccagcctcgtgctgttcgagggtcagagagtttgcacaatggacacggtgacaagtttgattccccttttcctgcctgcctagtgggcccggcagggcggcagctgctgttggttccatgtggccttcccagaatggggggtgccaggcactgtgtgaacccccacctccacctcttttttgtccgaggaagggatgttgcttttatgtcataatattttgagatgaggagaaactgttaatcatttaatcatctttttttttgagatggagtctcgctctgtcgccccagctggagtgcagtggcgcaatcttggttcactgcaacctccgcctcctgggttcaagcgattctcctgcctcagtctcctgagtagctgggatttacaggcatgcaccaccacacctggctaatttttttttttttttgagacagtcttgctctgtcgcccaggctggagtgcagtggcacgatctcggctcactgcaagctctgcctcctgggttcacgccattctcctgcctcagcctcccaagtagctgggactacaggtgcccaccaccacgcccggctaatttttttgtgtttttagtagagacagggtttcaccatgttagccaggatggtcttgatctcctgacctcatgatccacccgcctcggcttcccaaagtgctgggattacaggcgtgagccactgtgcccggcctaattttgtatttttagtagagatgggctttctccatgtaggtcaggctggtcttgaactcctaacttcgtgatccacccacttcagcctcccaaagtgctgggattacaggcgtgagccaccacacctggcctcagtcatttctttcaatgattttttaatcatttaaaggtgttaatcatttctttaaaagaataacagtgtaaccacttacctccagagtgctgcaaagggtccctcaggccagatttcccctggctcctgctggcctcggccccagggttgctggaggcaacagatgctcttcacaccttgccacacgtgtctgggaggtgcccttgaccttttgggaggggctgcctacacctgggatcgccctgcagcacacactccccgccccattctgccctgtctgccacgcagctggagcttctccattgaatggactcttcctcacctgttgatgactgccctgatgatgagatgggcacgaggttgggttttactttttgctgctgtggagagagagtcctggtggtcctgggtttgaaggtcgtgtgttttgaagcacgcactctagagcagccgccccggcccctgctccgggacaagggtgctgtcttaggactgcgttttcacctcctgcgccgtggtgagctgcgtcctctctctgcagaccaagctgtacaccctgcctgcaagccacgccacgcgtgtgtatgagatgctggtcagccacattcagctccactacaagcacagctacaccctgccaatcgcgagcagcatccggctgcaggtatggtggctggggttgcgcagccagttcctgggggcccagccaggtatccccgtctcggcaggtgtggttcctggaagctgcagagacggccccaggatggggcctcagctgaccgtccctcctctgcacccactgtggccgcagcctccccagtcctggtgtccttccctctgcctgcagtccacacatctgtggcttgtcgctctaagccgcacggtgacatgggttggggcagagaaaaggacgcacggcgacttccggggcagtgcatggccctgacgctcctggtgctgcagaatctgtgaaggacctgcagcagagggctgggcaggtgggcggcacagggcagagctgagagggcagagctgagacggcagggcagggctggagagggcagagctgagagggcagggcagggctgggcagaacagggctggaggagtttcgctgagtttgcgctatagatgttggcaccaggctgagcagaggtgactgggatgggagccctccctcctagagcaggtgctctctggggccacccctgtggcctcagagtcctgttcagcctgtcgatggaagaagtggcagggctgggagctgagctccgctttctggcagttgggggcgtgtggtgctgccagaggagcgaggcgcccatcccttccatcccaggcgggcccagctgtggtggtggggacaccaggctctgtgagctccgaggcaagggagggaggaggctgtgggtgctgggcctccggtgtcaccaggacagagcctgtgtctgtgttgggatgtgggtgtgtgcacatcagcaggtggccttttctgagtgcctgtggtgctggacgtgggtctgagcaggtgggacgccgcctgtcctgggcctgcacgagcttggctctggctttcaccatcctcttcctgacaggcctttgacttcctgttgctgctgcgggccgactcactgcaccgcctgggcctgcccaacaaggatggagtcgtgcggttcagcccctactgcgtctgcgactacatgtacgcgggacctcgcccacggcccatgaggctcagggcgtcagaggcgctggggctgtggtggcgctgtttgcatgtctgagggatgtcccagggttgggaagagccaagtctgttccgttcctgctgcggggacttggcctcagctgcttctcttgcttctgcagggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggtgagtggggccgggcagggaccatccgtcccacgttgggccaggaggacagggagctgccacctgcctgctgggcctccctccctgtctggcctgtggagggcagccctccctcagagctgagccttcccccttccccgagcagctgcagggacagaggcctgcgctgggcaggctcccccggctgagaacagggctccatagcccttgacgctgtgcagccacaaagcagagcctcagatgctagcttccgcctctgtctctagggtccagaaggccctgtcctgacgcctcctctcctcgcaggagtctgactggaaggtgctgaagctggttctgggcaggctgcctgagtccctgcgctataaagtgctcatctttacttccccttgcagtgtggaccagctgtgctctgctctctgctccatggtaccatggccggcctggggttggggtgggggacccagtagggtttttccccaaaagactgcgagcctctgggcagagcgagtgagacccttcgggctcgggctccatttccctcaaactcagctgcactctggagcgcagattgtgccttgggcagggtggagggacccctgccccagctcgcagcttttgggactgacgtcagaggtccccagccaagggcatgtcactgaatgtggatgtctcccatctgtgcttttcctaagtggggctcccgtgccgttcacctcacattcctggtgtgttacttggcaggcactcccaccactccgaaagggaggcccttcctgggagggaggcaagaaggctccccagcccctttgccccctttcctgggcctgcgttcccagggcctccccagcccctctggctaccccgtgacctggccgctggggagaggtttcatgcctggatttggtcatcagctttcaggcccaaagacactggagcggctccgaggcgccccagaaggcttctccagaactgacttgcacctggccgtggttccagtgctgacagcattaatctcttaccataactacctggacaaaaccaaacaggtaggaggtcagagcaggacaggcgagcttgatggggcctgggattcgagggcctggcccaggtaggccccacatttttctcataaacgagtttctgccaggccagggatgagtgagttggctctgcttccctgggtggctgccagatgcccagagtggggacatccgattccctggtgcttctagctctctttggggcctgggagccatccagtgttccctgtccaccccggacagcatctctgctctctgtagagcgttgcctggcttgttcctgctgtcccaagggggaggtggccatgccggttggtggagctgggctggttctgaggcgcagggtgggcaggccagagagtctggcttctgcctccctccacgccccatcaggtgccggaaactgtcccttcacctgcgatctgcctcgcccccgtcccagtcgcattcttccacacctctctttgacatggccctccgggacgaggagctggtgtcctagagattctggcctccgctcagggccatgcccgccaggagatgctgactctgaggcttggcccatctgtgccccgggcctcagcttctgatggtggccctgtagggagctgttgttgggttcccatccctcaggctcagccccaccctgttgggccccttcagcccctctgagaggctcactgggtcctcatgggtcttgcctcaaagcatagccagccttgctgggctgcaggttctgaggccttactggcccacagtgtatccgaggggtgaggccggctttgggaaatggaagctgttcccgggacactgcctggcaggccatctggccccgggctctgcctgagctccgctcatcttctgctgtcctcatggaagacactgcccagggttggtgtgggatctggtggcttggccacttcaggcagcactgccccttgcaacagagccagcctgtgaagggcccagaaccaggggatgagagcccagcatgtctgggttctgttggcctgtgggatcgtgtcggaatgcaactgaccggagcagtctgctgtgcagagtctgctcgggtagctcagcactgctggctctgccccacaggcattcagggacttgctaagcctcggctgttctcccggtggagcactcgaggttggcgaggggtaggcgaggctgcctctgctgcaagcgggtggggcctgaggtgtcctgtctcctgcagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccagtgagtccccgccctgcctgcgcatgcacccgagaggttcgggctgtgtaacctgtgcgggcttctctggtgccctctctcaggactccttggggaacctgggtgtctcgccttctgctgcctcagggcctgggcgtctctgcccggctgccatgagtgctctccttcctggctttgaggggcggctcctctcacccctctagtgtccatgtgaacgctcctccttgaagaagcctcttcccccccgagcagtggccctcccctggttttgggcctcctctctgtccaacagagcacacgccgcttcaggggggctttgttcgcttcccccagactgtgacttcaggagctcaggtgcctgtcccttcccctcaccgcctgtgcgcatctgggcaggccctcaatgttgagatggcagaagggcactgctgggcccgcacttggtgtagaggctggagagaagatcgtgtgtgctttgtgggccacatgcaggtcctgtcggtctttctgttttgttgataaccctttagaagtgtagaagcctggccaggcgcggtggctcaggcctgtcatcccagcactgtgggaggccgaggcgggtggatcacctgaggtcaggagttcgagaccagcctggccaacctggcgaaaccctgtctctactaagaatacaaaaattagccgggtgtggtggcgggtgcctgtagtcccagctactcaggaggctaaggcaggaggcaggagaatctcatgaacccaggaggtggagcttctagtgagctgagatcacgccaccgcactccagcctgggcaacagagcgagacaccgtctcaaaaaaaaaaaagagagaagtgaggccgggcacggtggctcacgcctgtaatcccagcactttcggaggccgaggcaggcggatcatgaggtcaggagatcgagaccatctggcgaacacggtgaaaccccgtctctaataaaaatacaaaaaaactagccaggcgtggtggcgggcgcctgtagtcccagctacttgggaggctgaggcaggagaatggcgtgaacccagggggtggagcttgcagtgagccgggatcgcgccactgcactccagcctgggcgacagagccagactcatctcaaaaaaaaaaaaaaaaaaaaaaaaagaggtgcggaagcctttcctcacggatcacacaaatggtaggcgacagctcgaattggcccagaagctgtggttggctggccatgggaccgagagttgaggccagggtcgggaaagccacgtccgtgtggccgtggccttctctcctctgcagcaccccatcgctgccgtgggcagagcagccgtgttggccttcagaggcgctgcacgggaccccggctcccctgaccaccctctccattaccgcagctctggccaggctgccgcacctctacaggaactttgccgcggagcagtatgccagtgtgttcgccatctccctgccgtacaccaacccctccaagtgagtggtcgccccaggccctgtgcctcccagccgtggcccccgctaggccttgcggcagaaagccccggcagcctttgtccccaaggcctgagcgcctcggttttttgcacttcatgccctggggatgtttccctgctgccaggatggagtgccagcccccttctcatctcaggtttaatcagtacatcgtgtgtctggcccatcacgtcatagccatgtggttcatcaggtgccgcctgcccttccggaaggattttgtccctttcatcactaaggtgggctcagggccggtgaaggctgtgtctctcggtaggccagggcttgctttgcccttggctgtccatggtcgggcagagtgacaggcaggtggagggcagtgggagggtgtttggggctgtgcctgtggcgctgggggctctgctgggcagcctgcagggctttgatgcgcggcaggcattgaggggtgggagctgggtgccgccgccttgcccctagcctgcagcttgtccctggccagggggcacccggcaggcctggtgagggcctccagcccccattgccacccctcactgtctgggtgtgctcactctgccagggcctgcggtccaatgtcctcttgtcttttgatgacacccccgagaaggacagcttcagggcccggagtactagtctcaacgagagacccaagaggtacggcctgcgggggtgtgcctggagtcggtgtggggtggggaaggacatggggctgtggcctgcctgacggtgcctccaagtcagtgagtggaaatgggtcctgtgtgccctggagtatgtgaggcagggcaggacctgcaagggccgctaacacccctcagcccctcagcaggttggccgtggtggcctgggtccgggctgcgtgtgccacgggcacctacttgtggaattgggggttggggtgcaagctttaggcgcctgagcccctcgaaggagccggccttgtctggggctgccccctcctctgcagcccccagcctgctgctagccggggactctgcttcatcaccgccgccttgccggaccgcaaagagctgagccagcctctgtgttcttgtttgcatttcatttgaacggctttctcctcctgtcccccaccttcctgcccgagctattttggctttccctagatgggaatacggcattttccagcgtgacctcaactcggaagctgttgtctccagcccctgggggccgggggccaagctcggccattacggccagagactactttctggggtcttggtctcttttcctagtgaccttcagggcctggccactgaggcctcagtgccgcctcggtcagagctgggcggtgcctgccttccgcgggtgggtgggattgcctggccagcacagcctggaatctgccgtgggggtgacccacacacgtttaatttgcactgacgttgtttgttttggtgtcatgcgtgaagccttacttgttctcagtcatgtttaccagacgtattatcatgcatttttgttttctgtctcttccccgctaactgccctttggcatggctctttttgctcatctcacccgcgggatctctccatcctgaccctgtggcctgggacctttcctcctcacccctccactggcttgttctccccttcccgggagctgggctctctggggcgttggggctccttcctcacccgatagtctgaggatagccagaccccccaaacaaggcttgaataactctccacccgtgaaagaattcaaggagagctctgcagccgaggccttccggtgccgcagcatcagtgtgtctgaacatgtggtccgcaggtagcgggactgtcgggtggggggcacggaccctggagcttggccccgtgagcacctgggtggcagtgcatggggctgcttgcatgacctcatcgtctgcccgtgtcctccctggccagcccagggggagccggtgacgaggggtggaaaggttgcattctgtccccaggccccgtatgagcacgggctggttgcacgcatccccaggccccctcggggtgccgctccgagagagccaggcgtgccgggcagcagcctccccaggctgtccccaagggccgcagtgtgggttgggggagacaccactcctggttttggccttttcgtattctctagaatggacgtttttcttcgggctttcttctcaacaaggtttattttttgttgtagctgaaagggaacaaggggcatttgtggagggtgctggggtggggcagcctgggagggcctgggtgggggctaggatcctgcagggcatgggcatgggcctgggccccaggccatggtcttagttctccccgcagtgtctgggtgcaggtgtgggctctcgggctctcggctgtcacctgcctgtgggtcatcgctgctggcactggcagaggggatacctgtctcctcctggaagcccgttgcaggccaaggggtcccatggccctcagtccatccacctcctcacctcaggccggcctctgctgggtgggacttggccaggggttggggtggtagaggtgctcggtgaggcttaaagccattttctagcacattctgtatcatgagcaaaatattgcctaggggctatgaaatttgtatcagaatgaactcccataagcctcttccctgtcactgggtgtggagctcaggcagccgctcgcctgcctgagggtgacggtggaaggccacatggggatcccagacctctgtgtgcttgccggaggcagcctgcgggcagaatgcaatctgggcctgtctgtgtggcctccgcctctctgcatgactacaccgtttcgccaggaggccgtaacctagtgctcccgtgggcttcggtgagggggatgtcggtctctagcctcctgagtctgctccgaccagtaggcctggtcttccccacccagcgtctccccgttctctgggacaatgtggtccacgtgattctcaagctgaggctcgctgggccgcccacgccctgttggggtctttccgagcgaggtcctcagccgtgcatgcgttgagctttggcccttggtgataggtggctcggcccgccctacctggcaccctgaccctggtcacggcctctccctccagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtccaggcggcactacagggctgggcgggcctgcgggagctccacgggcaagctgggtttcacgctccctgtcttctaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgaggtgactgcaccttcctttcctccgcgcctgccagcctcgacaccggctgtcccgagcccaggcccacgtggcaccctcgtaccagcctggggactaagtccaccctgtgcgtgggattctcttctcagctccagccccggggtgcatgtgagacagaccaaggaggcgccggccaagctggagtcccaggctgggcagcaggtgtcccgtggggcccgggatcgggtccgttccatgtcgggtgagccttggccccagccacctccacacaggcaccggggctccctcagttgctgctggtcccagtgttcaggaaggccccgagcccaggggccggggtggctggcttcaggcccggcccacgtcctgactctggggtgagccttccacagctcaccccagagccgtggagtggtggagtgtggcccgcttgctgcagaggggcctgctctgggtgctggtgtttcctgcgggttttcagctcggctcagtcctggagcccttctctgctccagcgagccgtggtctgactgcaggacaggttctgggtccctccctgtggccctgggttcactgaggccagcactgtggtgggccgtgccccaagggcagagctgccaccgtctctggctgcctgtggcactagcttgccaggctcggggggagcattcagcttgaggctggtggttttgcatcaggtaagtggtggtcaccagtcctctgccctcttcttcagggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacaggtactgggcggggctggcctgagcgccatctttctgccagtcacccacagagctgtggacactcaggggcgattgcagacttggccctcttgggatatttgggggtaacttttgttttttttttgagacagagtcttgctctgtggcccacgctggaacgcagtggcgcaatctcggctcactgcaagctccacctcccgggttcacgccattctcctgcctcagcctcccgagtagctgggaccacaggcgcccgccaccacgcctggccaatttttttgtatttctagtagagatggggtttcactgtgttagccaggatggtctcaatctcctgacctcgtgatctgcccgccttggcctcccaaagtgctgggattacaggcgtgagccaccgcgcccagccatttgggggtaacttgtaagtctccagaggtgagctgtgaggggcgatccaggtggctgaggtggggcaggggcctgtggcgaaccaagtgacttccatggcagagagttgccctccccgcctggaggctgcaagtccgagaccaaggtgctcctcggcaggaggtgctcctcagaggcctcaatccttggcatgcagttggttttttccctgtgtcctcacaggctctttcctggatgtctgcgtgttaatctcctcttgggaggaaaccggtcatggcttagggtccgctctggtcccttgctagccgtaattagctttctgaaacccagtctccagagacagtcccgttctgagttcctggggttgggactaaagcataccaacatgggggcacagctcagcctgttcccaggggcagagggagcccccgcagaggcccagagcccagggacagagggaggcctttgcagaggcccagagcccaggggcgcctgggtgtgccgtggctgaggggtgcaaagagtaggggttccagccctcgtggaggccttgggtccggactgtgaggctgtgggctggaggccgctgctctgaggtgcctggcggagcctggcctcgaggcaggggctgagcggggcagcagggtgggtggccgtcagagcagcgctggctccgacatcgtggtcctgaggattgtgggagggagcatgagggcaaaaccagggcccaggccaggaggcccctggggggccagagatgggtaaggggaggtactggcctcaggccaaaggtgctgccgcctccgcagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacaggtgagtggcatggcgggccttggcacgggctctgctcccactggcctggtgctcccggtgacggcaatgtggctcctctctgctgagggcgcccacacggctgggagtggtccctggcctgcctcagcaccattgttctccggtgtttgggaggaggctgacccgtgggaggtgtctgccctgctcaggaagctggggctggcagcttcagaagcagtaggggccctgtggagcctctgcccagcatcctccgtggggagtccagcactgcgggctccaggaggctctgcggcagcctccctccctgcctgggcccaggtttggacacctgagcccgcctgcgcactctgggcccccaccccactcggcaccgtgcttctcgccaggccctctggctcttccctgtggctgcagatggcacttagcggcctaggacgtctattcacgggaggagggaggcactgccctcctcaggtctgcccaagcagcttgtagctagcactgggccccgtgcgcgcccctgccggccgctggccctgccctctctcctctgcaggcacggggcctgtgctctctgctcgacctgtgtgtagcccctcctcctgctgacgtggccgcacacggccttcccttgcagtggcctctttctcctccctgtaccagtccagctgccaaggacagctgcacaggagcgtttcctgggcaggtatcgcctctcagagggaagcggttggctgcagagcgccactctgcctcataggtgctgtgctcgtcgcctcatccgcccacccccatggtccgtctgcctccattgccctggggagcaggtcccgactcgcatgaggacgtctgtgcagaatgtctttggcttggccagcgggatccccttgacttggtccctttgtggctgagccctgttcccacgctgtgcaagcactcccggcccagcttcaggcctgaggggtgggggtggcctgagtctccatggtgacatcagctgagctgcagactctgatgggtggcagctgtttagggggaagcccacccctgggcctgcaccgagcgggccttgccctggcctttggtggctcccctggcctctggaacccacagatggggctgcctcaagtcccaggttgaccaggggccctgcagaccgacctctgcctgttgcccccaagccctggtggggagtgctgtgacctgcatggtgctcccctgccaggtctccacgtgcagacgagctggtttggaagggctgcgtgggacgggccctggggtggctgactgcgcgtgtgcagggctgtggggcgcccgggggctgtgatggtcccctctgttgctgcttctacttcctctccccctgtcctgacgctggcacaggaaatgctgctttgggacctcccaccctctctccttagcgtccccagctgtgggtctggcttggagttggagggtgagcctctgctcttgggagcagtctgtttgcaaacagggacttcccccacgtcacggagtctccgcagctctcctcggttacgagggctggtttcaggctcccgctcttttagagctgaggcccgtcgggcggagagcgtcttgcccctgcctacctggaggcacaggggtggctgctggtggacactagggtgggcagagccgattgcctgcccaacccccgggcactcatgcaggagaggcctgtgtcggggtcacgtgcaggccttcccagcgtcctccctgcccgctcggtggatggcagcagtaagcagagccctggggaggctcgcagggctgctgtccctctggtcaggagaaggctggttctcggaggccacgtcagggccagggcctggcccagccccacatccagcagccccgtctgtgtcctcccagactccgccgtggtcatggaggagggaagtccgggcgaggttcctgtgctggtggagcccccagggttggaggacgttgaggcagcgctaggcatggacaggcgcacggatgcctacagcagggtgagtgtggctcagagcctggaccctgctgacctcggggggctccttaggggaggcagggctctgcgtgggtgtgcctgcaccctgggaactggctctgaacttgggggagatgttcttccacatccctcgtgcacagacggtctgcactttgcagccatccacctgggccggccctggctgctgggcagcctgtggtctcaggggatgctgatacctctgctcacgcagtgtggggcacagctggtggcagtgctgctgcgtcaacgggcgggggccgtagcctggtgctcgggctggtctgtggccctgggatggaggacagatagggcctcaccacctccaggtcaaccccaggtgggctcgagggtgcctgctgacaggggttctctttgggatggtcctttctagtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccaggtgggcctcttgcttccgggcggggctcctgacacctctcctgcgggaacctggtgcctcacttgccccaggccgagcgggctggggtggggtcctcgcctgtgccctagggctggctggaacccctgggagggcggtggagtgggagatggccaggctctgtgttcctccctgtgggctgtggctgccctggccaggccctcacctgggtgcccaccatcccctccctgtgcagtttcgtgttcctgcagctctaccattcccccttctttggcgacgagtcaaacaagccaatcctgctgcccaatgaggtaggcgtggcctccctctcctgcatccgctggagctgtgtggctcgggtgaatggtggggggcccagctctgctgctgggagctcaggcttgcagagggctctggcctaagctccctgtggcagcctgccgtgaccggcctgggtggggcggcctcctgtggacgggcgtctggggctcaggcagggctctgtgtgccacagtcacagtcctttgagcggtcggtgcagctcctcgaccagatcccatcatacgacacccacaagatcgccgtcctgtatgttggagaaggccaggtgaggctgcggggccggcctaggtgcctggacagggccagctgggcctcagcctgcagtgggtagggagtctgggcccccaacgccccacagagctcaacactgccgggtcccctacagcatgaagtgctcattgagctctgtgccaggtgctgctctgagtgctggggaccccggtgcgagtgacaggttagcgtgggagcacccggcacaccaaggagtgggaaggactgggcgggtggcaccggtcgcagggctggggagggcgctgttggtcagtgagctgacagctgagtggtgagggagcgggcagggggagcctgcataaggggtgggggcatcccacacaccagcagcgggggccgggcgcaccctgcccagcttgagcactggtgctgggcgagcacgggagccgacaggatgggcagcctcagcgccctataggctgcaccttcatcccaagggaaagggcagggcctgggctgcttctgagcagagggcacatggcctgactccgcccagtctcagtgagtccctcctgctgtgtggctcgaggaggtgggtggtgatggttcccgtgggagtggggtaggcccctgggggcaggctgctgaggggccagggccccgggtgtgctttgagtgtggagctccctgattttgccggccaggcacacacggggctgagggaagagagggagtcaaggatgacacccgatgtctggcctgggtggctgctggaatggatggtcttgtctgcctcagggatcagagtggggctcccggcagagcctgctgggcacccccaccctctgcggggcagggcccggcccgggagtgatgccaccctgcctctcccctctccccacagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaaggtacggcctggcgcctacccgctcctgctgccccaggcctcagggcacggctcccatccagtcctgctaccccacgccctggggcatggccctggcacccccacctgctccagctccccacgcctcaggttccgagcctaacagcgtgggcatggaggcagtgatggggctggtggctttgcgtcccaaagccctgcccctggggagagccgaggaccactggccaggcaccagaggacgtggtccccgcaggcccccagagcccctggagtaatcaggaggtgccccagtgcaaggcacagagggcctcagcactggccccacaaacccatccggccctgctcaccctcagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaaggtgagtgaggggccgtcagtgaggctgggccccaggcaggtgcccactgctgtgtcccgggttggtggcaggtcctcctccctgagcttcggtcacgaggagcaggaggagaggccgcagtgctcagggccccgtgggcacgagcttcaccccgagcctgcgttgtgtcctctgtgccctgaagcctgtggcgcctgctgctgagtgtctgtcaggagtaactggcaagtgcagactgggtgtgctgggtgggcacagtgtagttggtgcttcctgtctgtccggcgcggcccttgggcccccaccatctccccagtggcagctgtcaggctgctcagttggttatcgccacgcaccactaggcagcaaccagcgtcaccctcttcctggaggtgggctgggtcggccagtgtcacagcacggtccgggtgagccccagcatggcggggagagctggcatggcccaggcagggcagataggctggaggcctcactccaagggccccaggatgctgaggcagccactgaaccaaaaccccggggctggtagtcagagtccaggaggggcaggagcatagggaggtgggctctgctagatgccaagacaaccagttgggggggggggggcacctgggcggctgaggagggtgtggtggtgccgagatggggtgcacggctcacttcatggctgggcagacggattcggacgtgtggctgcagacaccctgggggccccagtgagtggaggtgccccagcaattagaggtgtcttgcctgtggctgcagcatatgtgggtgctgcgcccagatgtggagggggcttggcctgggggaggccagacaaacacagccccgctgccagaggggaaagttcaggggcagatgctgcccatggagctgacaggtgtctagcagtgcaaccaggcagtagccgagatcagccttcagcacacgctgtgtgcggggatgaccctttctcttgtccgggcagggccagttcaactttgtccacgtgatcgtcaccccgctggactacgagtgcaacctggtgtccctgcagtgcaggaaaggtagggccgggtggggccctgcagtgcaggaaaggtagggccgggtggggccctgcagtgtggcgccaagagccctgggcctggcgtgaccaccaagtctccccagacatggagggccttgtggacaccagcgtggccaagatcgtgtctgaccgcaacctgcccttcgtggcccgccagatggccctgcacgcaaatgtgagtgggggtgggtccaggcgtgagctggtgggacaggcccaggtgccacctgatagtgagctcaccccctgcctacgtccccagatggcctcacaggtgcatcatagccgctccaaccccaccgatatctacccctccaagtggattgcccggctccgccacatcaagcggctccgccagcgggtagggaatatggggctccctcagcggggtgtgctggctgcccaagctgtggggcgggtgtgtgggcagagcggttgccacgcctcccagacttactgcccaagccgcctctgccttcagatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcagtcagacagctcttttattgactttgtctgcttggtgcgggggttgggggggtgtcgaggctctagaagcggccatgcccacagaagtggtacacagaagcaggcacagccagctccgagggccttgaggctgcctgggccatacagcacactcgcgcgtgcgcgcgcgcacacacacacacacacagtcaccttcctccaccctgggagccagcccccaggaggagtcttttcctctaaccaccctggggtcctctgacatgcctagtcctgctacttgcccagacctgatgccagcaggcctgggcgctgctctcttgctacctggcctggggcaagggaggatgacaaggcctctggggtgatgagagtgcctggcagacagctgtgcccccagcaccggcccaaggccaagctcgcatccaagcagcagccgggctgccataacgccaccacacctaccaagcgcagcaggtgttgggggaggccagctctgggcgcaggcccctcagccctagtgaaaatagtgacatacaaaaatatacacattttaacaccatataaattactgacacgagacacacagtgagacggtgcagggagtacggtaggaactggagaggtaataacttaggggcagggtggcggcggtgcaggctaaccctccctgaagccagcagccttagcagtgggggacatctgcccagggggtggggccgggcacagcccgctgtacctgaggactcggggaaataaattagcatctcagaggctagaaaccgtccaatactgctgtgtccttcccaagggagctggggaggggaccctgggtcctggttggccacacagcctctttaaagtgctgaagcccacagacagacagatgcccctgcctgctctctggggaacctacgtgcagccattctgcctggccctcggccttgacagcggcagaaagtaatactgagcggtgtccactccgactccacggcccacccccgccaggaaggaggactaagtgctgctggggtggaccttgttcttggcccgaaggggtgtcctgctggggccagtggccaggtccacaccccgactggcccgggcaaggcggctgggcagtgctggccgcaggcccggggatgggccacgggaagatccggcgggcgcccggctgctcctgcggccttgcaggctgtgcagctgctgctccagctggtagacgtcctctgtggcctggttgagtcggtcaaactgggtgagcagggcctcgaacacggcttggaggcgggagggctcaggctcacaccttgtccccagccggcccaggctcacgctcagcccatccagctggctggaggaggtggaggggtgcgaggcatcggagccagcgctgggtgggggcacatccggggataccttggagcccctggaggagcgagagggcagcggctccatcccttcaaagcggactttgtggcggaactgggggcggcacaggggctcagtcagtccggctgcaccctgggcagagcccagggcgtgtccctctcccccccactgggccgtacccacctccttgaccttgctgaggcccatccagaggcgcagcctgcgcaggaacaactccaccatctcgtagtcctggggctcccaggccggccggtacagctctccacgcaaggcgtggtagcgccagcggagaataacagcccccagccgtagggcgccccacagccgcagtgcccagagccccacacacagcaggggtgacaggtgccaggactcggcaggacacagggtagagagcccagtcccagggcacagcaccaacagggcctgggccacgctccagagggagtccacacaggaagacacgagctgcggggaaggcgacaccagtgagggcgtacagctgagctgagctgagctaagacgccctccccggccgcgcagtcacctaccaggatggccagctgggcgtaggctaccccgagcacca

SEQ ID NO: 14152 - DNA, 44120 bp, Human; identical to SEQ ID NO: 14151

SEQ ID NO: 14153 - DNA, 44120 bp, Human; identical to SEQ ID NO: 14151

SEQ ID NO: 14154 - DNA, 44120 bp, Human; identical to SEQ ID NO: 14151

SEQ ID NO: 14155 - DNA, 44120 bp, Human; identical to SEQ ID NO: 14151

SEQ ID NO: 14156 - DNA, 44120 bp, Human; identical to SEQ ID NO: 14151

SEQ ID NO: 14157 - DNA, 455726 bp, Human
  misc_feature (1)...(455726): n = A,T,C or G
tagtatgccttaggtggggtgcagtggctcacgcctgtaatcccagcactttgggaggctgaggtgggcagatcacctgaggtcaggagttgagaccagcctggctaacatggcaaaacctcatctctactaaaaatacaaaaattagccgggtgtggtggcacacacctgtaaccccagctactcgggaggctgaggcaggagaattgcttgaacccgggagatggaggttgcagtgagccgagatcgcaccactgcactccagtatgggcaacaagaacgagactgtctcaaaaaaaaaaaaaaaaaaaaaaagtatgccttaaaacttttcatattttacataataattagtaatacatacttcacttgggccttgtagatctgtaaaacttctccttgcaagacaaagccactgttgattgcaatggaaataaaaattgaggatttttttttttttttttttttttacttctcccaagatgacacattttaagctaaagaaagcagcctccaagaattttatattcctaatattttgggcaagcccgagtttctaggttgtttttacctgcccagttgctgtggtggaagttgtgctagaaaattcagcctccttggtctatgtctgtgaacttactaaattcttgttgttctagaattctagatttggacctggtggttagagatgaagatgggaatattttggatccagaattaactagcacgattagtctcttcagagctcatgaaatagcttctaaacaagtggaggaaaggttacaagaggaaaaagtaagtttgactctgtcatatgccattcacgttttctcagtaataagttttcaacattagtaaagtatcagtcaagcccaaaattgtcactaagaaagaacctgaaaaggagtagctgcagagtttgtgtcctacagtcatgagtggaatggagcctggtggcacaggatgtcacccatgacatgaaagggggtcggacagcattgtgtttcatcgtaggagacaggatcctaatgatgttgattttgtgttctcatctgtcaaatgagacacaagacttgattctgcatttcctctcggataatggtaggcaggtcatgtattccaagctcattgagggcagagagtacatgtcttattgtcttttcgtcttctatgatctttaatggtatcatgtatgcattagcctgttctcgccttactataaagaagtgcctgagactgggtaatttataaagaaaagaggtttaattggttcatggttctgcagactgtataggaaggatagtggcttctgcttctggggaggcctcaggaatcttataattatggtggaaggcgaagtgggagccaacacttcacatggctagagcaggaggaagagagagggtgtgcggggggtgctacacgctacacttttaaacgacgagatcttgtgagagctcaccatcatgaggacagcactgagaggatggtgctaaaccattcatgaaaaatccaccccatgatccagtcacctcccaccagtatatatatatacacacacacacagtagatactcagaaattgactaattgaatcatctgttaattcaacaagtacttactgagcatctactgtgtaccaaatgttgaagacataatgatacatgagacagatgtccttggagggtttagtctaatgagggaacaaaaaattaaataactacacatatataatcattattttgatttattggatggacacctgaaagttttgtatctctgaaaatactcagcacagcagttgcacaggatacaattttttgtctgttgtgtgaatgcatgatttaagaatgtgcaggggagataagaaagtgactgcaccaaggcctttgctgggttatgccaatgagttattacaattttctattctgtagggaataaagaaagcaagtgtcagtgatgagtgttgctggggttgactttctgtttccttccatacacagtctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcaggtgggtgacatttcttggctgccgtctttcctctttggttagtgttaggaacttgggatcagaaccactgaagcgtcccattcatgctgagaggccttggatgaatggctgctggacacgagcaagcagccgagtcaagagctgtcttagacagtgtgatggcagccaggttgggctctgggtcagggtgaaccttcttgcgtgtagattgctatttgctcgtagagttatagcagttgcaggtacactctggccgtatcttaagagtgtagctgaagattgaagtaatactttgtttcctaagttgtcttcgtaagattttatatatcctggtccctcaaatatcactatttccatttttcaaaatttggtttctatgaatgccatttctgtgagttttgtcttgttttttctgcaagatgattggctggaatacatcatttagaatggtgcctgccacatacagactgtcagttaatatttgttaaatgaaaacactgtaagtctattttttcctgcttagccttcagtataactttctctttgcccagatggaaacaatgtggttcaactatgtatgaattatgtgtgtgtctgtgtatatgttaaaactctagtatcttcacttgtattattcaaaatttgaaaacttagtgtatgaatgatacagaaaaatacgagtggattttattctcacttctgataaagactttgtttcctcttgacataggatgcagtttttattttacaatgtatttggtttgtcataggttttgaaataaacatgcattgtgctgaattttatagtattgtcattctaaatgaacaaataggctcttaaaaaaaaaaccaacttagaaataccatttgcaagtagttctattacagtgacaacccaagacattgcacattaaaacttggcaaggtttttgtgctgtggatgttaattgatgagtagctgtatgtgatacttttgatatttataaactcaatagttgtctgtatagtgcacgtacatggtattaattatgaagcaatgtggatgtacatttggtaccctgttatttggaaaattaacttgcttttatttctccatttttcaagtgagaactacctggttcgctggtccagttcaggattacctaaagacatagacagattacataatttgcgagccgtgtttactgtaagtgcacccaaagatgcttagttgaattggctaccattctaaggactacttttagccatttctgtctgccttcctgcgacactagaacatgggtccctgggatgcctgtatacaggttaatttagtattactaagtagagcgcatttccagaaatcatctgagtctctagccacccttagaatcaccgtgacaaagatttaccccattaacatggaatgtgcctcttaaatgtgtatcgtttttatttttttccttgagacggagtcttgctctgtcacccaggctggaatgcaatggcgtgatctcggctcactgcaacctacgcctcctgggttcaagcagttctcctgcctcagctcccgagtagctgggattacaggcatgcaccaccacaccttgctaattttttgtatttttagtagagatggggtttccccatgttggccaggctgctctcaaactcctgacctcgtgatccaccctcctcggccttccaaagtgctgggattacaggtgtgaggcactgcccctagcccttaaatgtgtatcttaagctcacttaacagtaattgactattgttattaaattcctttttgtcatatgaataactgattaaaatgataaaaactggtctgagaagagtctcaatccatttttttactgtccttttcattggagcttgcattgaataatgggtctccaaaataatttatggaaactaatatttctaggacctcggaagcaaagacctgaaaagggagaaaatcagttttgtctgtcagattgttcgcgtgggtcgcatggagctgagggacaacaacaccaggaaactgacctcggggttgcggcgaccttttggagtggctggtaatctatttctctgtgtttccttgagagtttcagatcttcacagtcactttcaaaagaatcactgttgaatgttgattggacaatgcacagctgtgatttataagcttttctgctggagagaaaaaatatatttattagttattttcattgtggcttcaagttgacctgctaggctcaggatgctctagtcctcaagtttcagatataaatcatatatttggttttaaagtggatcccatctttccctgggagtgatcctgacccatattctcagtctgtagggaagccagtcagtggaggttttcaggtcttggtgatggacataagaatggatatgtgcaggacggtcaaagcaacgaagaagaggaagaaaggcaaactgtgaagagaacgcggttagcttcatgttggtgctcttcatccgccatgttggtgctgtttctccgccatgttggtgttcttcctccgccatgttggtgttcttcctccgccatgttggtgcttttcctctgccatgttggtgctctttctccgccatgttggtgctcttcctccgccatgttggtgctctttatctgccatgttggtgctcttcctccaccgtgctggtgctcttcctccaccctgctgttgctctgttatttttggtgacagcacgaggaatgtgaaagaccaattatctctgttgaggaaagataaaggcatacccaggaagttctgattatttgccctagttcactgtgactctcatttttcatagttttgggaagtggttttctctcttttatggttgcagtacaatttcattacctagcactgtgatatttattttaatttttgtgatttttgggattcatatggatatttatgagggaaaagttcctgattcttgacacatagctggatttttttgtatgaacagctatggaagacattctttcccttggctaccaggaaactctgaacttagtccatcccccctgccttttaaataaacattatttttagaagagttttaggttcaagcaaaattgaacagaaaatacagacagttcctatatatttctccttccttccccctgcctccccattatcagtatccaccatagattggtacattgattacagttggtgaaccgcattgacacatcgtcgccctgtgaagtctgtagtttacattagcgttcattcttgatgttgtgccttctgtgggtttcgacaaatgaataataccgtatattcaccattgtagtctctcactgggtagcttcaccatcctaaaagtcctctgtgctccgcctggaatttttggaaaaatatttcaaatcatttaaataaatgacttactacatcataaggagtaagcaatagcagcgatatagacattatgagagcagcatattaattcaatttacttgaattcaatttacccatagagctaactaacggagtgttccaatgattttaccatttgtgagtgaaaatggtgagggtgaggtgttctttctgaagtccccacagccttgggctggggaaatccttttgcattttcatctttctgtctttttgtttttatgagacagagtctaactctgtcacccaggctgtgtgatgacagctcactgctgccccgacctcctgggctcaagtgatcctcctgcctcagcctcctgagtaactgggaccacaggcgcatgccgtgctaacattttcatgtcatgacttgaatacatacttgaaaattgcccctctatttgtcagagcctgtagcatcttttacatgtaatctagtgttatatttaaaatgcctttcattttccaggattgttttttttcttttccaccttgatggtagttttaagaaaatatttaatttttgtctcaggcataattggcttcatttgagcaatcagagacatctttgacaacacacggaagtcgctcctcttttcaacagcagagctacacattctctggttattagattacaagatggattgtgtcataagttcctacgaatgcgtagttatatttcttaaagatgaaatgtagaccacaggctgacagtttttaccttcttttgattaaaatttttggaatttaaaaatttggaatatttttcagttttcattgggttgatattccaggaaagtctaggtactaatggatggagagggtgatgggcatgggctcagctgacaccactgtggccttccactgtttcttacatgctcacttatgcttgcttggtggggtctagagttaggttgggccccccagctcctggagttctccatgaattacagaagcctgggttattcactggggcagggcgggcagcctggacatagttccttgtttctggagcccctacctgtgtagtgttggctgagacactacatctggtccctggagtttggatgcctggctgtgtggcctccagggacttctgtcccctgatatctgctgatcacatggacaccccctttggtccctggttcctcctgtctggactggtctctggttccttcccttcctgtcttgtgtctctggtacccactgatatcggggcttctgaaaacccacctggggccaagttctagccttgtcgtcttgctcgtgaattttccagagtgtggcttctcctcactgctctgctctgactggcacatggggtgtcccccctcacttaggggttgcaaagaacctgtgtgaacctgcatgaacctgtgtgaacctctataaacctgtgtgaacctgcgtgaacctttatgaacctgtgtgaacctgtgtgaacccacgtgaacctttatgaacctctgaacctgcatgaacctgtgtgaaactgcgtgaacctgtgtgaacctctaagaacatgtgtgaacctgcatgaacctgcgtgaacctgtgtgaacctttatgaacctgtgtgaacccacgtgaacctttttgaacctgtatgaacctgcgtgaacctgtgtgaacctgcgtgaacctgtgtaacctttatgaacctgtgtgaacctgtgtgaacctgcatgaacctgcgtgaacctgtgtgaacctgtgtgaagtgcttcagagatacccataggcatttgttttcctctgtgggaagatttcaggcctgcagctgttaatgttgggttgccgggtcctttgagttctctgtcccttctggtgtcacagttgcctagcagttgctggtttgcctggctccactacatgccctgggtggggatgtcctgttcatcccttggtgccaagcactgagcactgagcctttgtggcctctgtgctcactccagaggggccagccttcctagccctgctcagctggtgtgtgtctgtacattataagtaagaaactggctgggcgctgcctgtaatcccagcactgtgggaagttgaggtgggcagatcacatgagtttgggtgttcgagaccagcctggccaacatggtaaaacctcctatctacgaaaaataaaaaaattagccaggcatggtggtgcatgcctgtagtcccagctatttaggaggctgagggagaagagttgcttgaacctgggaggcggaggttgcagtgagctaagattgtgtcactgcgctccagcttggggaacagggagagactctgtctcccctcccccccaaaaaaaaggccaggtacagtggctcacacctctaatcccagaactttaggaggccgaggcaggcagataatgaggtcaggagttcgagaccagcgtggccagtgtggtgaaaccctgtctctactaaagatacaaaaaattagttgggcgtggtgctgtgtgcctgtaatcccagctactcaggagtctgaggcaggagaattgcttgaactggggaggtggaggttgcagtgagccaagatcacgccagagtgatggggcgagactccatctcaaaaaaaaaaagaaaagaaaagaaaacaaaacaaaacaaaagtaaggacctgatcgttctgcttgtggagtttccagtttcctactagaaactcttctctgagacatttcattatgtgatctggctatgtaaatttttggcacaaaaagtaaatatcttaatgcagtggttctcaatcctaactgaatatgagaaaaatcttgcgagctatcaataaaaattcttggtcaggtgctgtggttcatgcctgtaatcctagcactttgggaggctgaggaaggcagatcgcttgagcccaggcattcaagaccagcctgacaacatggcaaaacctcgtctctactaaaaaatacaaaagttagctgggcgcttggtggcttgcacctgtggtcccagctactcaagaggctgaggtggggggatcacctgagcctagggaggttgagactgcaaatgagccatgattgtgccattgtactccagcctgggctacagagtcatcctgtcccccccaacggccccctgccccgccacccccccgccccaaaaaaaagaaaaaagtcttgcacaagccccactcctgtccaggtaaaccagaatctctactttaaccaaaatcgcttgtttgtcactatgggccactcagtgactggcagtttgctgccaccagactaccttgccctccctgctctgccccgcttatcacatggtggcattcagcacatctggggaattttttttaataggacttgcttctaacttattcagtgtgttgtccaaccagatgttctctttgttactaagaaaggatacttggtcgggtgcagtggctcacacctgtaatcccagcactttgggaggccaaagtgggtggattgcttgagtccagcagttcgagaccagcctgggcaatatggtgaaaccccatccctacccaaaaaaactaaaaaacaaaaattagccggtcgtggtggcgcatgcttggggtggccaaggcaggagggattgcctgagcttgggaggttgaggttgctgtgaaccgtgattgtaccactgcacttcagcctaggcaacagagtgagacactcaaaaagaaaaaaaaaagggatagaagggatgcttcccacatctgagaaggttgatcaacattttggtaatcgtattctatctgttcataggctacttcaatttccacatgcaaatttaattttgaggctttctttagaatgacttctgcgtgtctgtgttaacagagttcagttccttaaaatgagaaagtgtccatggacctttaagtctacagttcttagtcttcggttgaaaagaatgtgtcacatttctgtcttttaacctttttataatgtaaccttttctatctttttctaaaagatagaaaattgtaaaaataatggaaattttatggaaaagtgtagttaaataaattatccatagttttacatagccagggtagtacctcatgtttattctgatatgtttgtttccaaattattttttctgtgtgtggcatatgatttttaaatacaatatcccgtcctaccatgtatttgtttatttaactgattgattttttaatgtctttttagtcccttttttgccatcttaaccatttttaggcgtgcagttcagtagtaagtatgtttgcattgcacatacttttatctttctaacaaacctagcattatcttatgaacatgtccttttattaagcattattcaaaaattcggcttctcaatggctgcagcctgtagtcctgtgattccagcagtcctttgctttgggctctgaggttatctcagccttgcggtgtagtagctacgcagtgagcatcctggggcttgaagcatcccacctgtgcctgtttgcaggccagcccctgcagcggagttgctgactcgcagggtgtcggggtccatctgccgtgagcaagtcatcctgatgcagccccaccagtgggactgagccatcagcccctctccctgcgagacgtttctcacctcctgccttctgctctcctgcctgtgctggccctgggcctctgtcactcttgtcccaacgccactgcctccttccttctcctgccctctgtcttccagcatcacgcggtgccgtctgtctacccggcctctccctcacacagctgtactgacttcagctggactctgtcttttcaccatcctcttccctgaatgtagagaccctgggctggctggctgggggaatttttcccccaagtcctttatttcctcctttggtgtcagggacatcttgtccaaactgcagggagcactccctctgcgtggggctgtgtgcggaagagcagtcaggggagtccctgggaagcgcgatgagcggtgatgactggcgacgtcaaggccttctcctcgaggctcaggatgggtgcgggactcggggtgttttccacctgtgggtgctcaggctctgattgcgtttcccgcttgtttgctgccttcctgcacatggtcctgtgttccagggctgggcactggggatgtggcaagggagtcccatggtcagctggtgagatgagtcccatggcagagcagagctctgcaggcacccagcaaggccacccaggaccagctggcatgtgagggtgggcctgctcgggtcagactcccttggttctggctcatcgtgggctgctgcctaaatgagtttattgaaggatgctgaactggtggtctcgggcatcttggaaaaaggtaaaaaggtgggtgctgcagtcagtcgcgtgtgggtcagtcacccccaagagtgctggaagctgggaaacgcttcccccaggccaggtgagggcccgtgtccagaccatgcatcctctgagcagctgtcatttgatgttgcaagttatttgggattctttgacctgtatctgcaaacacagccgtgggctcctggctctttgaggccccttggttgagtggagtgagtgtgggtgtcgtctcttacgacactgctgaggcccctggggccccaccagaccaagcaggggatgaggatgctgcttttttggttctatgtatccctcctcctttttggagggtggtgatggtgatggtagaaaggaaaattttcaatatatgattacttacatgttggacaaaatatatttagactgatcctcttacctgaacgcagagctgggctacagagagacccttctggggaaaggtcttgtgcgaagaaaataaacaaggcatcttcctctcaagtccagtgtggcggtggagcagtagcagacacagggaaagtgacccgggccatctggggttattcttggactttcttgttctgtcatgaccaagggcaaaaggaattgtttgaaaggtagacagtgtgtctgggtttacccctgaatgtcatcagggaatgtcttttaacacaagaagatggcaaaggatattagcctttcttgtgatgttagcaagcctggatctcccggggggtgtgtttgtgaaggcagtttaataggattgaaagagcttgggtcttggagactttctcgctgtagactttgagcatgcttgttcatgcctgtctttgagcctcagtttcttgtcagtatggtaggttactgaggatttgccttgaaatgtcctcttgaaagagcgtccacagataccagcatgtggtgggtgcttggtaaatggtagctacttgttggcttaattgtttgcgggaaagcaaaagtgtgaggcttcagaacagtgctggccagcgtggtaaccacttgtcacatgtgactagttaaatttaaattaaatgaatgggtggcttttccgattcgctagtagagcatatttcctaggnnnnnnnnnnnnnnnnnnnnagcgtccacagataccagcatgtggtgggtgcttggtaaatggtagctacttgttggcttaattgtttgcgggaaagcaaaagtgtgaggcttcagaacagtgctggccagcgtggtaaccacttgtcacatgtgactagttaaatttaaattaaatgaatgaaataaaagtaaattttcagttcctccatcacgctttctacattttctttttttcttttgttttgtggcagggtctcactctgtcactcaggctggagggcagtggtgtgaattctgttcactgcaacctccacctcctgggcccaagcaagtctcccatctcagcttcctgagtagctgggactacaggtgcacaccaccacgcctggataatttttgtatttcttgtagagatggggttttgtcatgttacccaggctagtctcgaactcctgggctcaagcactgtgcctgccttggtctcccaaagtgctgggattacaggtgtgagccactgcgcctggcctatgctttcacattttcgttgcttgttgttaatggaacattttccatcattacagaaagttctattggacagggcagctctagggtgacagttgggtaataggcaaaggaaattattaaatggaactctgccatttgagccccaattccatttgggccagcattttctgataacttaatttgtctttcaagcatggaaataatttagacttgactatgagaaaacagcttttgctgttgtttgccagaagatattctgatgttcctttgtttgtttgtgttctgtgattatagcatttaagccaaaacaatctctgttctctttttgtctccagtgatggatgtaacagatataataaatggaaaagtagatgatgaagataagcagcatttcattccctttcagccgtaagtatggagcaattcaagtacttagccagatataatgtggaaaacataggcttgtaataattatctttataattaaatggataaacataactaaggattgattattttgtaattatgaaaaacctctttagtcactgctgtagtacatggaattttttgtagccataagaatcctgggtcaaagtttgtttatggtcctggaagtaggagattttacttgtaatcactgaattgccttatatagaaggcacagagttacagctctgctctgagcctgaatgtttctttacataattgatttattctagtagctatttgtattttcaaagcacaatacttccaaattcatcataggaggttgctgtttttaaaataaaaaaacaaacaattatgatgaattattttaaagcgagaaataatgctttaaagcatataatcacactgctgatttttgtgtctcggtttttgcttagagtggagcctatctgtgttcgtttttaggctttctctagttctgacctgaagtctttaaagaggcacggaagctgagaaaaagctcttggaggagattcattaaattgattatctgatttgtgggtagaacccagggaactggtgggaagaactggcgtttatttccctcgtgtggaagcaagagtgtacccagatgatggtcgttggccacttaagcactcctactcctcacagaggaggagagaaaaaggaatccagatggttgaggttaattgtaagagacagcttcctcctgggcgtggggttgggtggcgatgttaggggagaaggcatggtaagggcagtggaagccacctgccatagtgctctgcagtttcacttttccctcatttttattcttaatcgacttcagacttgaaacacatttcagattttagaaattttacggttttcagctgttggctgaagggtttaggaggcgggtagtaattgggtggctgaaggagccctgtccttgggggcccggagatgtgaggttgacttccctctgccccacgcatccttggtgatggaccaccgcgctcaaccccacccgactcctctgggtcttgagtgccactggctaagacaggaagagtatggctttctttgcaggcgggcgatgtggtcacatagcaccctaaagctttttgtacagctcagtaggagattttgctatcttcttgacgtaagaataacagcaaaccctgcgttattgagctgggagtcagggttaagttatatgtatctcagcatgcacaactagaggcaaaggtctctttgtggcttaaatgctttaggtttactctcctgtccaatatggtaaccattagctccatgtggctatttaaaatacttaaaatgagctgggcgcagtggctcatgcctgtaatcccagcactttgggaggccgaggcaggaggatcacctgaggtcaggagttcgagaccagcctggccaacatggtgaaaccccataactactaaaaatacaaaaattagccgggtgtggcggcaggtgcctgtaatcccagctacttgggaggctgaggcaggagaatcgcttgaacccgggaggcagaggttgcaatgagccaagatcacgccactgcactccagcctgggcgacagagggagattctgtctcaatgataatagtaattagaatgaagtagcattaaacatttagttcttcagtcacattggtcctgtttcaagtgttcagcagcaggggaggtcagtggccccgtcctgggcagcacatacatagcacatctccagcactgcagaaagctctgctggattatgttgttttgtagtcccatccagtgaggagagtttataaagggaacacagtgctgcagaatctggaagtttccttagcaaacaaggggaacagtatcatggaacatgggcagatattgaggtcataaataaaatacacctttgtaaaattataatattaaattgcctcattctctcatgagaaataatgcagccccctgctgttttgaatgctgtattatatattagacctcagaggttcttgatgcccagatgtaacactaagttgaaattacctgttgcctgctagtgtcctctgtgaaaagtcaaaaacaaaaacaaaaacaaaaacaaacccaacctgagggattgtttgaaaggttagggaggttattagttttagattcactgattttcacagaacatgttatgagttgtttgagattgcctgtgctttgacgccatctttttctatcttgtagtggaatgtccacttgaaaaatatgttattccatgtgtaactcttatgtaatttgtgactccatgctccattaaaggaagactaatagacagatgaatatttgaagtgttggaaacaaaagaacagcatgatttttaatagcaaaataagcagtgaaaccagttctttgggaaatgtcgtgctaatgaaaccgttttttgctccattaaaactgatttattatctcacagggttggttttagagaaggaagcacattgcacatctccctccctccctgtcttttttaacttggtgaagtaaatgacaacagtcttcagttccctcgagtcatgtggctcaagtgatggatagcactgtccttgttcccaggattgattttaaacattatggccatgctgtctattttcttgctcatttcatagtgcacttcgctgtgctacatggtatttctatttgggcatatgccccccgtttgtagccagtctctcgtacagcgcagcatctgtcacaggctcctggttcatgggccctgaaaacgtgggtggtctgtgttcataacagcgccacacgtgggactaggcagtggtgttctccacacacggtaccattcttctcacatgtagtcacttgagggactattgtgtacgtagtccaggagggtagagtagaaagcctttgcaagcagttaggttccagggatttttttttttttaaatcttgattttgcttttccctttagatcaacctgccccttgacctatgctatgttcagaattaattgaaattggaggaatggccataaacattctttgggattaaatgcctttcaaccatgtggctttcagacaagctcctttttttaaacacaagagtctgatggagatgcagtggaggcctggtgcacgtttattcctggggagagggttgccctcatttgctctgttccctctcgtggttcagcattttcctgatcaatgcttttccctgtttctcttgtcacctctcccatcctttgtcgtgcgttgactcatgatgcctccctctcgcactcggtgacgatgatctcttatgttcccttgttaccgtggcccatgggtctctgtgcccctttgtctcctgtggtcttggtcgtcccgtgccctccaggctcgcgttggacgacgccattcgacacaagccgctgaacatgtcatcccgtttttcacccagggtggcaggggagaatgacttccttcagactgttataaacaaagtcatcgctgccaaagaagtcaaccacaaggggcagggtacgtattttcctattttgtttctatcagcgtgtatttgcatgcgttggggcagtgctgtctgggttggttttagtttgatgttgatcatgatggtggtgataatgatggggatgacagtgatcgtggtggagaatgtgtgtgacagttgcccctgtgtacagtgcatgatggttttcttacccgtcacctttgtgaacattgctgagagcccactcctggatggagagtggggtcagattagaagtttagaggaacatgcaggcggtaggcgtaactccctctgcccgtgttgtgtgctaatctttgcctgttctgggtcttccctgctggtctccctaagaaggtgatttcatttgtgcagacttgctcccctgagttctgtcatttaagtgatttctccgcccctacactccgcctcacactcactgtttttaatcctgcactgacacgtttctgagcagctgacctgctgctggcagaaggaatgaatcagtcacctcgggctggtgacagttggcacttggctggccaggagggctgccaggaaacaactgtgactgaggccccgcctccagcccaaggggaagtcaccttcagaacttgaccgtctcactccctgatccatgcagactgcccgtaaacgcggtagagcttaggtgaacagacctgcttcatcgtccagctaccttatgtcactagacttttaaaaaacaattatcttgattcatttccactgttctaaaggagaatgtgaattgagcctgaagaatgttttagagaatgagccttcctagggatctgcagggacctccagctttcttctggtgtgaactacccccctttctggcaaacagtagcaggacaaaaaccccaacccagaacgttaatgagatgtggcctctgcagacagagcgattttcagctgacccaggacccatcttctcctaaattaacagccctcccaatttacactttaattgaaaaccacggggaggtccaattagggctgtttagattggagtcactctcaggctgggagtgccagtgcaaaggttgccagccgatccttcagtgcttcgagctgggactgccctcggatctccagtttcttttgcagtcatcggagttttgataaacttttattagagtcattcagggaaagtggagtttggtgtcaggccagcaggaaatcactgggaaagaggaccagaagcctgcctctgccaggctcactggtgtgtggccaggatctttgaagccggcgaaccttgggctcatgtccgggggtccagttccttgaacttctgggaggagtgggcattttcaagtcacagtgaaaactgagggagaagaacagtgatagttttgtcaaggggatcacaggtgacttcctgaatcagaatggccttaggcaacatgactagtgcttgttttccttgaacctgaattttctccagggcacaatggtgggtggaattcaggtcagaggtgagtgatgtggccagtgagggcagccacacagatcggccgccgggactgcagggcgctgcccaccggcgctcattttatcaccagcagcccaggcttaacctgatccttgcttgtctgtcaagtgactgttagcggccccaggagtggaagggacatggaggagatactcatcttcagagagaaccactgggttttttcacacctctgtccacatgcgcctcctgtctcttgagctcaccacttggccttggccagtttttggtttatgccaacatgtttcctcttcacaagagacaaaaatcctgaatatttaatccaaattattctgatccctgaacccagaggtgtgggacattttatgtggacagtgaattcatgaagactccagacatctggttctgttgtttgagatagaatgtatgctaatcctctttgtttttagttattctgcttaagcaaatgtcaaccccaaatgcacttttttctcctgtgagaaaagcatttaaaacacagcataatcaggaacatttaatttccatttttaaagcgtgtggtaataaatttaatgtgtcactagtgcattagtttatgtattaagatatttgcgcaggccggcgtttctgagaaaggtgtttgaaacacaggatttctaatattaagtgttaagtgttccatcctcatgtctcaacctttgacctctgtagataatgacctcaccacatcctgcaatccttcaaagagcatctttctgtaagatttattttgtggacattcattctccagggaggcttttggactcaaactcctgagatttgagaaactcttagctgcatcctggtgtcccagggaagaccagctccctgtgagccacggtgccagttcctcaggctcttctgtcagggtctgggctttggtttgctctcccggaggccagggctgggggttagggtgaggaagtgcctggccctttgcccatctgtctgcttacctattctgcaggtctggagctgctgttagctcagggtgcttttgtgtgaattagaaaaaggggcctcatcaaccaggtgagtagggagatgcagccagcgccaggacctgtggctctgtgagcgagtagaggcagggtttagctcccacttgccttttgtggtcacttgtctagtgaaatgcacattctgggcagtggtacatgtgctcctgtctgggtgccatccccgatacctctttggggaccgctttctattggtggttcttccttcttcaaactctccctcccatgatctggaatttcatatcttaaaaagaaaggaaaaagaaaaaaaatatttttaaaaaaaaaaggaaagaaaagaaacaccaagaagcagtcctaccctgagtaatacatctgtctctgtctatgtggcctctccctctggtcttcgtctcccattcatcttcacccttctgcctcccagcatcggccctctccctgagcgcccccgccccctctgcccccgtctcccaccaggagccctgtggctgcatgggcaccatctgtcccagttttccatttcccctgttatctctgaggtctctgtccccttgtgagctctcaaagtgggcctttctcctgcctcttcggggctcttctttccttccccactctgggtgcttgcccttcaggcagctctgcctggagcgagcgggtcttcctattccaaggaacggtgcccccgggacttgctagtggttgtgcctgcaaggggcaccgtctctgtaagctgcgcctcctcctaccccaactccccgtggttctgctgacttgaccttcacgctggtccctctcccaccctccatagtggcattcacgtcctgccagccagctaggatcatgcggtggcctaccctgctgcgattccatccccactgtgctctgttctcctgcctacccattccctgnnnnnnnnnnnnnnnnnnnnacatacagatacagacacagacatacatacagatacagaaagacacagatacagaaacacagacagacacagatttagccacacgcatacagatacacagacacagatacacagagacacacacagacacacacgtgtacagacacacatggacacacagacacacacacacacatgcacagatacagatacacagacacacagtgactcacacagacatacgcacagccacaggcatgcgcgcatacccatgctagtagcagaaatgaggacagaggctttgatgttctgaggggcagatgaggccctaccaagctgagtggggggaagcaagcaggcagccccccgtgaggcctcagggacagagcacccccatgtgctggcttatagtgccagccccttcccatggggggaaaagatgccgtcgtcgtagaagacagctcaggccgagcccctgcctgccccgcctttgacttgttggaatgtgtggcttgtttccttgtactgtcacctcctatttggttgctactcagtatttatacaaaccacagttctttgtcagccttgcagggaggaagatcccgcgcacatcccgcacacacgcccttacacatagaccccaccgggtttactgccctctccccaggatacccctggcatctaggtttagaggctttgaaagtcttcatttctctcttggagaaaagagccgagagcggctggggctttgttttcttttgcggtggcactgtggtacagagggcctgggctccacaggctgcacctgtcctggctgtggagggctgtcctgctggtggccctgcagactggtgctccactgctcgcccaggttgtgtgatgctgcttagctacttgaaactttgatgggttctcgaagctacgaattcacctccagaatcctcccctgcctttgtctttcctgggagactagaaaatgacagacttctcagccacctcctagaaaaaggtggcctgctgatttatcttaaatgtctacccactcaaaagagacattggtccttggcattcctcagcagcacagtgggtgcacagcagctgctgatgtgcgttcagctgtctgtgagtcaccctagggcagggctggcatcccagctcgttggatgcatggagtccccacgacaggcaccttttgccttgcccctctctttctcatatacccaccttttctctcaagatgttgaattgtgaattaaaagtctctcattcattgaaattggtttcgtgaaaacttctaaaaatgcataggataaaatgcgacttaagagcatccattgtttttccaggtttgtgggtaacattgaaattacttcctggagatatccatcagatccgaaaagagtttccgcatttagtggacaggaccacagctgtggctcgaaaaacagggtttccggagataatcatgcctggtaagaactggcttgttcagggcttctcagcatggcatgggggtagccggccacggaggatgacgtgtgggcagcatcatgtatgagctctggcaaggaaagggctcagctcctggtaggtgaccctgtaagccccagcatggttatggatcatggggctgtgaccggagtggtagaatatgctccctggtcccctgtacccctggatggatcagctctccccagctgcaaggattgtgtgaggggggcgtgggcacccagcaaatgtctgggtagacatcaggtcaaaagaagaaagaggtcagaaagggagctgcccattgtgaagcccacttagggcaaatggcagggttggatggtcgctgaatggaaatgcctgtgcctgcgcccgctcagctagtgtacgttatactggcattcctccatgaattctaagtcatgaattctaaactgaccgataacaggatttgcgtgttaacattaatctcatatttacataatacttttcattttccaaataacgttcctaataatctgatttgatcatcaagagatctttggaagcatgttaatttgtatcctttatatccgtgtgatactttttggtttgcaagtaatgcttacgtggcttggcagggcgtagtggctcatgcctgtaatcctagcactttgggagttcgaggcggggggatcacttgaactcgggttcgagaccaccctggggaacatggcgaaaccccgtcttgacaaaaaaataaaaaaactagctgggcgtggtggcatatgcctgtcattctagttactttggggggctgaggtggaggaatcacttgaacctgggaggcagaggttgctgtgagcacagatcacgccactgcactctagcctgggcgacagattgagaccctgtctcaaaacaaaactaacttgaaccacgtgaggctcttggaagcccacaaattggtgttgagtgaattcctatccagattaaactgtagcctaaagtcgctcagctaatgagccgtggaaacggggacaaactcccccatattcaacgcggcctccttttataggcctgtgctgtatagccaggagagtggtggctattcagggtgcatgctgtaggagttactgctttgcttactttagtgcaacttcaagacacattctttctactccttttgtctttcagggctgttgtgggtcattgaatagtcggtctggtaaatccatatgaaagacatctaaattggttaggctaaataatagctaggcttacctgtacagaaagaaaagcatgacgtttagtcaattctgaagctattgcttgtgtgtgtccagtctatatgcaggaaattaatttaggtttattaatgggagtggactaatttgtatacttattatttgtatttgcatttgagatacagatttataaattaggatgaagcaattggcaatatgcatttatcttggcatccttaggatgtcctcatgttcaaagggaaactcagaagcttccagttcatgccaatagtgtttcccttatgatggatagacttaaaaactaagtctaggcccggcgtggtggtgagtgccaggtagtagctgctagtagcaggtactagggaggctgaggtgggaggatccctggagcacaggaggtcaaagccgtagtgagccatgatcacaaccactgcactccagcttgagtgacagagagagaacctgtctcaaaaaaaaaaaaaactaagtctaaacttgtagatcatctcatgatagattcatagggaaatgatacagttgaccattgttctggcaggttccatgtgctgagtcctcgggtatatatctcacaggaagtgattctagcttgggtgggtcatctgcgttctctgttggccgagtaatcactggccgcgctgtgggcaccagagagagagagagtatgggcggttatcagtctgtctcgctgtctttagcctgcagaacctgtgtatcacccggttttgtcactgtctgcagggatgcgcgtcttctttggacagcgcagagcctgtcccatcacccagcggcctgctctgctactttctcatagctcgttggactcctggaatccttatgaaggatccaggcaggcgatgccaagttttcctttgagctgggaaggtagcaggagtccactatgtctgcttctagttccttcttccccagaatgttctgtaacctggggaggcatttgatgagggtctatggtgaatgcccatttgtggggtttgcttactgtaaatgaggtcttacttctgtgctggccctggagtaacgcacttgaggtgtacttgggagtgaggctgtgggagtttcgccctgtcacccgggctggagtgcagtagcacgatctcagctcaccgcaacgtctgcctcccagtttcaagcagttctcctgcctgagcctccggagtagctgagattacaggcacgcactaccatgcctggctaatctttttattttaatagagacgggggttcactgtgttgcccaggctggtctcaaactcccgagctcaggcaattcacccacctgagcctcgcaaagcgctgggattacaggcgtgagccactgcacccggccttgaagttcttttttgatgatggtgtttgtgccttgatagaatttttaggctgagagatcatggagtttatgccttccttatcagtgaggctgtttagtggtgctggccttggaggctaagtgacttgtccaaggtcacacagcaaatgagcaacaagtcttggttgggtggccttgcacctgcccctcgtcctgtgctccacggttcttctcgtggtcagtatcagtgggcggcagccgcgcctccttccacacagctactgtggctgtggtggcaacccactgggattatgatgataatgacttttaaatgaaagcttaatttaatagttggatacattaaaagccaaaatagagcagtttaaaagaaaaaaaaaagccaaaacaagaaagcaaggagcaaagagagttattttccttaagggatccttggtcttcagccagaatgggcatttgctgctcttgacggaaccgctctttggctccttgggagagcgggtggtcagggcgtgggaggtggccaggcaggcagcagaggagcagtggctgggaacgaggcttcctctaaatcatgttactaatgaagcttgtgaagttctcccagttgggccattaccaggggcttcctatgttctcagtaggaagaagagtcttgagctcatttcttgcgttttttttaccccctacaattaaaagcccatctcactttaaaacagacaggtctgttttgttcttctctctgtggtccccattcgggatcctgatagctgcctgccagaagggaagagccatgcagaaagtttctccctagacccgtttttcctccctgattctaggctggtgatcctcattctttttttctttatttttattttattttattattttaagttttagggtacatgtgcacaacgtgcaggtttgttacatatgtatgcatgtgccatgttggcgtgctgcacccattagctcgcttttgagacggagttttgctctgttgctgaggctggagtgcagtggcaggatctcggtttgcggcaacttctgcctcccgagtagctgggattacaggcctgcaccaccacgcccagtagctaatttttgtatttttagtagagatgagggttcaccatgttggccaggctggtcttgaactcctgacctcaagtgatctacccacctcggcatcccaaagtgatgggatcacaggggtgagccacctcgcctggccggtcctcattcttaatcagcttttagttcaactcttggagtcatgcttttaagaagaatgcataggaggcaaccttgccagttacctgggagtgccagtggatactgcgatagtccttggctactgaggactcagacagccgtagccagccgtctaacaagggacaatggtgtgggctgccatgggtcatggatgccatcaatagtattggagcccctctggttgtcggctaccctgagaggggtagagtgtcctctgcccagatgataaccaagcagatcattggaaactttgagatttttcctctttctagaaaactttatcatgatgaaaattgctcttgtcatgtatttaaatggtgagactgttttgtagaaaatatttcataatcatctaatatgtatttgtaataatctatgaggataggtagacagtcttgcaaaattcacaattacgctattaataatggattgttttttaaatgtatgatttctcccccctcaggtgatgttcgaaatgatatctatgtaacattagttcaaggagattttgataaaggaagcaaaacaacagcgaagaacgtggaggtcacggtgtctgtgtacgatgaggatgggaaacgattagaggtatttattgtggcgagggctcatctgtagtgtttcagttttacttgccaagtgctcaccttggctctgctacagcatagatgtcgtcagggtggggctttggagtcccgtttcttgggattggcgttggttcttgtttccttttctccagcttgccatgcagggcctggggtcctctggtcctggcagctggcctatctcaggaggtccctgtggtcttttttttttttttttttgagatggagtctagctctgttgcccaggctggagtgctgcaggtgtgtgccaccgtgcctggctaatttttatattttttagtagagatggggtttcaccatgttgacctcaaataatccgcccgccttggcctaccaaggtgctgggattacaggcgtgagccacagtgcccgagcaggtccctgtggtcttgaccacctttgcccaaccttatcgtggagtctcatttgctgtcacaagcccaaggcctaaaggtctagcagtcacactagaagtacagataccattgttacgatttgagagatgaagaaaaatgaaggccctaagaaatcaattaaattgctcagcgttagagagctctaggggtggaactgagcacctgctcatgacagccagagctctgacctcgtgctctacctaccggcgatcatgaagatctgcttccgtggccacagcagcctgcagggtccacctgggaggtacttagaagctattgcctcctctgatgaccagaggtcaaatcagagctgctgtccctgtgaggtgcctctttgcaccagtgctggaggactgggcttttctgggcccatggggttgtgcctaaggctcagtgtcgccaagagaagcatgatgtctttctctctgggtgaaccccgtccagcatcactgcctgcctcgtctccctggaaacataggtgctgcccttgccactggtctttctggttggagtgaagcaaacagtgttcatggctggaggaaggggaggggagggttcccactttttagtctacagtccctcaccctagacctatgggacggatcaggcaacttcctgcagatcctaatgttaaagttattagggttgagggtctggggaactggaggtcagtgtcatccccatgtgtcataaccatcaagatcttcaatgtgtgagaacaggggttggagctggccgctggcttcaggtggatctgtgcttcccttgctgggaacgtgttcatttgtggtgggggtgtgttggtgttcttggagcgtacctgtccccccacatatatagtgggagatgtatatggtgtcaagctctatgaggtcttacgtgagctctttatgtcttcttttaaagcatgtgattttcccgggtgctggtgatgaagcgatttcagagtacaaatctgtgatttactaccaagtaaagcagccacgctggtttgagactgttaaggtattatttacatggtcattttatcacatggcgctgattatgaaatgctcatttgtaacccaaggaaacatcctaacatcctcctcagcccgggagctgctccaggcaggcagagtgtctcccaacaaagtcattcaaggttgctaaggaaccacactggtgtttcttagaatacatttactctcatctccttttggacgtaaaaataggacgttcatggagacaaatgacagagtctttttaagatagctattgtctttctcttcccagtactgttttatgtgtggcatgctgtctttacaccaaacaaaaaaaccgagctgccagcctgtggaggtcattgctggggagtgggatcctgttctgtagctctgatatggtgccttttcataatgcagcgtgctcacatctccacgatggagtaaacaccgtctcaccgccaagagcttgaatatttgaaaaccaggccaggggttggctctggaatacagatgtttgatgtgagaattagggacaatttttgcttagaggcagcatgtattaggtcttttttctttgagtgtaatgtgacaacaggaaagcttttttggcgcagctgtgggcaggtcaccacagctgtggaaggaatatagacccttccaggttggggctaagaagaaaaacggcaacttttctttttttgagacggagtctcactctgtcacccagactggagtgcagtggtgcaatctcggctcactgcaacctccacttcctgggttcaagcgattctcttgcctcagcttcctgagtagctgggattacaggcatgtaccatgatgcctggctaatgtttttggtatttttagtagagttggggttttatcatgttggccaggctggtctcgaactcctgacctcaagtgatccaccctcctcggcctcccagactgctgggattacaggcatgagccaccatgcccggcccaaaaacagcaacgtttaaaagtagaatcttggccggatgtggtggctcacacttgtaatcccagcactttgggaggctgaggtgggcagatcatctgaggtcaggagtttgaggccagcctaacatggaaaaaccttctctactaaatacacaaaattagctgggtgtggtggcgcatgcctgtaatcccagctactcgagaggctgaggcaggagaatcgcttgaacgcaggaggcggaggttgtggtgagccaagatcgagccattgcaccactctagcctgggcaacaagagcgaaactctgtatcaaaaaaaaaaaaaaaaaaaaaaagaaagaaaaaagaatcttaacagtaatggtcagagcattcagaaaaaaaaattcagctgtgtcacggagtcagttggcttggcagctgttacaatatgatacaaaattttgcagaggcattttgtctttggaaaaatcatataggggactaggtgtacagtattttcaccactgcagttagaaatgtttacagttgtacctgatagctccagttgaataaagctgttacgctggatgatattgataacagtgcttaaacttctttttcaattcttgaaggtggccattcccatcgaggacgttaaccgcagtcaccttcggtttaccttccgccacaggtcatcacaggactgtgagtagtcaagcactttcttcccccaagtatttttaagggagaactgggggaaagcgcgagaggccactctcagttgttctggaactcgctatcataacacaataaggctcatttcccaccggaacctattccttggaaacattcttctctcttttccttgagcagatctcaggaggagatcttaatttccttctccagttcctcctacccagtgttgctggtccccttctttcttttgctttccagtcttccgtgttgacttgccatccatccatgccatccatcagaaaagttactgagctgtaacaaatacctctcaaacatgggctcttaaggtgcctgtcttagaattggaaatcttgaaccctttttgtcttccttggtggcccttgctgtctggagctcagggatggcttttctcatagacatttttgtgaatactgaccatggtgccaagactttaggaggaaagaactgctatttgaatcactctccttcaaaaagaatttattattgatgactgaaatttgttccatcacattttgttaaattaattgtcaactaaagctgtagccctgtgctagacagtaagatatcacagaaggaaaacatgattcccatctttcagggtgtgtgtctctttggcattgggaactgagacatattcatatttgggacaataaatgacaaagagagttggctacaggcttgtgtgccgcaggcagttaaaggaaaagagtggtgtggagggcagaccgccctttgtcactgatgaccccgtgggggtcacaccgtgcagtgggcagtttcaggttctgtgtgctctggatggagcttaagcatgagcctcttctgtatcttcatttgaggataagaatacctttctggctggtgccgtggctcacacctgtaatcccagaactttgggaagccaaggtggaagattgcttgagccccggagtttgagaccagcttgggcaacacagtgagacccgatctttactaaaacagttatcctggtgtgatggtatacctgtagtctcagctgctcaggaggctgaggcaggaggattgcttgaacccgggaggcagaggttgcagtgagctgtgattgcaccactgcacttcagcctggggaacagagtgagaccctgtctcaaaaacaaaaagcaaaacaaaaaaaacataaaccttcctcctagggtattcttgaaggtcaggcaaggtggaggctggccaccttctggcacgctgcctggtatggataggggctccattgtagttgctgctgctggaataatgtgttcattcacctgactgtttctggggcctggcctgccctgggccctccatgtggggtgggtgtgcctggacaggggggctgcaggagagcagcctggagagcaaatgcacgagcacggtcatgatgttatggtgtgcagatcatcgagaagcttgggcctgctgttgttcaggggagttggagaggcctggtgtgtggtctgcagagctggggtgccggcccatgactgtcaatggcagatgtgtgtgtggtggggcccggcctgggatgtggctgactggaggggtttcaagcagcatggagtgcctggtggtgggtggtgcatggcgggggagtgcggggggtgggtggtggctggcagctgccgaaagcatcattgcattcctgtcctgtcccaacagtgcatgcaggccaggggttcagttacaagggcatcaggtttatgtctaacgggagaagcaggggcaggaaggccgccagcttggaaggcagttccctgccatctcatccttgccccaggatcagatccaggctaccagaccccagaccaagtcggatctgctaatggtgcacaacatccttggtggccgaagctgtaggataataacaactatcagcagatgttggccatcgttcactatgctcttatcatgtgcccgacacaagaagtttattgtgttatttggattcgtcctcgcaagattcccatgtggtatcagtattattacttcccacattacagatgaggaaactggggcttggaaaccccaggtcaggggctgaaaggcacccaggtagtcagtggaagagctttggttctaagccaggtccttgtgcccgagccttatgctccaatgccttgggggagtggcgaggccacttctttcctttggcttttattgagttcctgctgtatacacaacaagctgctggggtttctcctcttgcagagcttaggtttgagttgaggtttgagattagtttgcaagaaccagctggggcgtggcagcctgtgagtatcacatgaattaggcagaggtatgatgtgagcggagggtgctggtggaatgggggtggctgtgggcacaggtgtgtcctcgaccaaggcatggagggcatggtgggggccagcctagtgggctgcagtgtgccccagaccctctagggctccacgcatatatcaccttgaggcccacggaggaagcaggttaagaacggggttctggaatccacagaggactcgtctcaaaattacgctcccgtcttttaacaagctcattctctctaattaataaattacactagggcagagcgatagctcctgtagcattttaattttcaaaatccttgcttttcttgtcagttttaagtactcattatagacaagatgctatcacccaacataccaggacacatctgcataataaatgaagtctccgtggccacagcttgtgggattttggaaacatgttgagcatcgcaggtgcgatgccgatgaaagcctggatgtcggccgctgaccatggccttcggggcctccccagccagccctgcatgcagatacctggggcagaaacaggtagaaagagctgaggccacattggtccccacttgctaccctgaagaggaggctagcaaagggaacaagtgatgggatttctcacctgggatctgaccttgggattggaaagtttggtgtcgatgggttaacataatacctttccagcaacctgtcggcaactccagctgcaccagaccgtgtggtccacggagccaggcagacttgcagctctcaggcccagctggccaggagctgagttttccttgattgtagtgggcttgttgggtagggcggcctagagaatgggcagctctacccacactccagaacacacaacccctactgctgttcctaaggttctgtaaacttgtcatataaaccatccatctcatgatggctgctagtgagcatgcagtaaaaagcggtccattcctcggatgtgaagatgcagaatgttaataaaaggtgcacttactgtactacttactggtagggtcagtagaagccttctgctgaccattattgtcacacgtccttctgaaccctggctgttttcctggaggcatgtcttttttgttgccgttgtttccaagtccacccaaacttaggaggaactgttctgttctttgccatttgaacattgaaatatttcatgtgctctggtgcccttttacagagttatttttttagaatcctagggtacatatattttacttctgtttcttcctgtgttttttggctggttgattattcatggaaccatttaatttgccaggatgtattgagcacaaccaggaaggcaaaggtgataagccatgtcgtcttgggtagtgggatccgacggtaaatattttgagccgtggactcaaggcgggtggatgtgtcattctccctctctgatctctgtcctttcatctataaagagaaagctcggaatctgtaattgtagagatagtttccagctctggtcctctgtttctgtgctctgctgggattgcaacttgaggaatttctggcagatccatttcttcagtccatgttcctcatctgtcctggcttatcagtccttccccgcctttggccctcgctgtctgtcaccagccacactggacttctgtccccagatgtgccacactggtcctcgtgagggcctctgcgctaggtccccctcttcctgcagcattgacatcttggcttatgtgctgtccagcttctcagagagatgtcttctgactaataaattggattgtccccgttgtcactgtgaccccttaagaaaccacaatgttttgttttctatatcatctgaaagctcatttgtttgttgactgtctcccaaagtggcacaaatatggattgagtacctgttgggcaccaggctctatttcatgtactaggaaatggcagtaaaacaaaaggtcacttacattccagggtctagtggatgaaaccaacaataaatagcaacaagatcaacaagattctctatcaatctatctctatctctgtctctgtctctgtctctgtctctatctctatctctgtctctctgtcacacacacacataaacacaacatctggtagtgataagaattatcacgaaaataaatcaggtgagaggaaagagggtgattgggtgactaatgggctattttagacaagatatggtcactttggaggaggtgacattttggcagaaacttgaatgaagcgagtgagccccacatgcagatacctgggggatgaactttctcgccaaaggcagcacaatttcacattggggtcgttagtccattggtaattcacatgatggatattgcaaggcaggaattgattttagttttctgtattgacccgcagtttccttggtggaatggtctgccccttcccagcctctgtcgtttactgtggcctcttgtttccaggccctgttgatttccgctggtctgggcgtcttaggttgaaagcacacagtctttctcattgtcattttacagttactctcgctttctagtgttgcgggctttcctctgccttcttcaagaccatgctgctcttcttggccctttatcctggaatccgttttcacgttccaggaaaaatctcttctatgagattttgattagaatggctttgaatttatagattaatttgagaacaactgatccctttatgctaggagtcttcttacttgtaaacgtggtccatttttccatatatttattagattagctttaatacctgtttgtataattttgtaattgttttcataaaggtagcctttgtagcttcttataatgttattttgtcatgataattgaaagcaatcatcaatttttttgttttttgttttacagctaaggataaatctgagaaaatatttgcactagcatttgtcaagctgatgagatacgatggtaccaccctgcgagacggagagcacgatcttatcgtctataaggtatctggttgcattggtgcaatattgctgctatagacagtttcagtcttttctgggctccctgacctggaccaacctttcccatcattgtgaggaagctgctatctagctacatttaattatgcaaatgaacatttccaatgaccagcccttttgttgttcctaacgggaaaagatgatatacaatataacaataggtgccatctaaaaatgccgtgaacatgaattatgctgcagtaataagggaaattattaaaatgtgtatttaatatgatacaaagcaattacgatggttacaaggattagggataacaaagggtggcaaaaatggtgtgttgctgtttgtgaattgcctttgacatacggcatgactaaatccacaggccgaagcaaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacggtgcgttcgagaggagaaacacactcaccccaggagctctgccccagtcctgtcttttccatgctccttcctatgtggaggtgtgctccgtaggtgcatgaacgtcacccataaggcattcattgcatcgggctgtgatgatttatcaatgcatagaaggtggcatttgttcatttgttgtaatttaaaattcacacttctactctggtctaagggttattcttttatttttatttttattttttaagacaaggtctcagtctcgctctgttgcccaggctggagtgcagtggtgtgatctcaactcactccagccttgtcctcctaggctcaggcgatcctcccacctcagcttcccatgtagctgggaccacaggtgtgcagcatcacgcttggctaattttatttttattttttatagagatgaggtctcactttattgcccaggctattcccaaactcctgggttcaggcaaacctcccgcctcggtctcccagagtgctgggattacaggcacgagccactgtgcccagctgtattactcttaaagggagataaagcaatggatttacttcttaaaatgatttttggccaaaggaaggtagcgtgacataaaggaaagtgcacaagatttggagtcagactaaaaacctggaatcggaacatagccctgtgttaaccctggggatgcccttgaacaagtcttctgcacatttctgggtcttatcttccttgtctgtcgatacgggaatagtgcctgcctcaaagggcttagtgagggttacatgaacagtgggctgggagctcacctccctctttatgtcttccccattctcagctactctctgagataattactagttatctttatttttaaaagctggtttggatgttactttctagccctactcgtgttgtgggataagcaccccctgctgactcccacaccccaaagctcagccctaatgtggcagatcactcatccatcagctggtgccgtgcccttgtgtggggttcggccgatgctttgagtgcctgcaccaccactgcttgcagcctctccagtgacattgctgtccagccaggggtacttcttattcagagcacactgatgttgttgctgtcactccgtctggaagaggcagaaatcctacatttaaaaattgaatcttccaaatgcagccgtatcacagctgtgcagagtgactttatgctctcttgaagcagagcttgaaaatccaattttttcctcttaactgcccgatacagattttgattattactgtctgttgctatcatgagttgtgtctctgggggattgtccgtaaatcatggcagtagttttggatttgcccaagggacagtcatcgtttggactttaataggataaacacaggacaaaagtaaagccattgtctggaagtcaggacattgtagtggagcgtgcactgagtgtgctgcatgtttgggcatgcgagccctgggtcaaatgcttttggatctttccgtttctgcactttgcactctgttgttctgggctacactttcccactgctggtctgctgagtaaactgcttggtgtgggagcagtaagtctcttaagtgccttaagcctactggggcacttttatattccatttgcatgcatttctcgaaccatttatgaagggtcctagcttgtggttgtgtagtggtctccatgagcatatgaaaagccttacctgggtgtgggatctatgcagccgtgcagtggggaagggagagaatgcacagggagcctgctagtggcatgcccgaggcatgtgcagtgtatttgtccctgttcatgctgctgataaagacatacctgagactgggcaatttacaaaagagagaggtttaatgtacagttctgtgtgactggggatgcctcacaattgtggtggaaggcaaggaggagcaagtcacatcttacgtggatggccgcaggcagagagagagagaaagagagagagagagcttgtgcaggggaacttctctttttaaaaccatcagatctcatgagtcttatcactctcatgagaacagcacaggaaagacctgcccccatgattcaattacctcccaccaggtccctcccacaacacgtgggaattcaagataagatctgggtgtggacatagccaaaccatatcatgtggtcagcagtgcggggctcaacttgggacttggttatggaaaggatgctcccctgtgacatgttagtctctggatgtggccttgatagctccactcgcctgacagatgacagcatccagagcctaatttaacccaaaggtgacatctccaggtgggccacactttagcatttcagtaggtgccatgtgttgcagtgctcatggtgcaggaagccatcatctcataattgggtcatgttccgaaagcatgctcggaagtcattacttaacttgctcatctttccccattcaaagcaatgctctgagctgcggttaggtgatgaggcccatccacagaatccttcttaacccttatgaccctggagaaaggggactgtggaccaggacatccccccggggggtggggtcagtggcaatccctcctttcaccctcaagctccttaagtctcaccagctgcagagtaatcccctccccagactgagggagagggcaccctgctctcagcagcagctgttgccaggcaacaaggaaattccgatgtgatgccactcaccaggactgatgggaagtctgcctttcatttctcaccagccacggttccccttcttgggattgtggcatgtcaggtgtgtacaagatggagctgccccaaatggcgtctaagcatcgactcccacattctcatttgagggaatcatttttctgaaaccatgatttgttcctgcgaagttccattacttagggaaacgcagtggctgaattattcattgaggttggtattaaacttctctgtcctcagcattatgctagatgctgtgggggatatgaaagaagtacaagatgtgattcctcttctcaattaactgactatataattagaaaggagtcatgaatatgggctgtgagtcccggtaataagggcctggggtgggactcatctgccttgggcagcctcatgggggctggacaagccctgttttcttccagcactccctttgctccaaggtgttttactactcattagcccaattggactttgtctcaaacttacaatacagcgtgccaccaactttgaatgaaggggatccagattattactgtctattaaggaaatactggtaattcttgtgagatggaaatctcccttaaccctaggaccaagagtgtgtctgggcaggatggagccttttccattacttcactttcacttagaaatgaagacatgttgcccaggtgcagtggctcacatctgtaatcccagcactttgggaggctgaggcgtgaggttcacatgagcccaggaggttaagaccagcctgggcaacatggcgagtccctgtctctactaaaaattagctgtgcatggtggcgtgcacctgtagccccagcaacttgggaggctgtggtgggaggattgcttgagcctgggagttagaggctgcattgagctgtggttgtgctcctgcaccccagcctgtatgacagagtggggccgggtgtcagaaatgagtgaataaataaataaataaataaataaataaataaaaaagagtagagtgctcaattcgtcatcctctcctgggatgactgctgccatttgtgctttggactaggcattctgctaagtgctttctacacgtcatgtcagttaattcttacaaccaccttgtgaatcaggcaacactgtacccatggttcagatgagaacactgaggtgaagttacctccccaggccaagtggttgctgcatgctggtggttaggcccacacttgggcgtcttccacgggatctttgggtgctccttttttgtctccctatttttaactcttccctttgtcagctgtacttgttttggagcttattgcctgcatgccttttgtacaatttgatgctgaagttataatggatgtctgtatttcctgattttctacctatagtcacaattagagtttgttttttttttcttcttcagtattaactagagttttgttttttgattctttcttttatggagacagtttctgtagctgaagttggttcatgagcataacggtaaattagatgtactttgttaatggtattttttcgagtaatgggatgttaatataacttcaggtgaaacttgggtaggcatatgtactttcctagagagcttttggatcctgacttcttaccttaaagaatatcttgggccaggcatggtggctcacacttgtaatcccagcactttgggaggctgaggcaggtggatcacctgcgatcaggagttcgagatcagcctggccaacatggtgaaatcctgtctccactaaaactacaaaaaaaattagctgggtgtggtggcgggcgcctgtaatcttagctacttcggaggctgaggcaggaaaatctcttgaacccaggaggcggaggttgcagtgagctgagattgcgccattgcactccagcctgggcagcaagagcgaaacgccatctcaaggaaaaaaaaaaaaaaaaagaaaaagaatatcttgatgccttaaacaaaaacatttctggacactgtcttcttccacattgactctttaaaaaccagtatattcattccttgctttttctatataaaatgcaacaaacaaaaacacaaccataacaaccacaaacttctgtggaagcccagacatggtgagggccggaagctcactcagtgcaggcgtgaacctcagtgcaggcgtggtctcagttgtccagagctactgtagctgtggggactcttaaccttgcagtctcagtactttaatttgtgttagttattttatttatattatctataaaaaaatagcagcttgttcttgagcaggagaaacaaaccatttggtatccagtgcctgggcagcgctttctgggtgagcaggcctcttcaggccttgtggtgctctgaaactgccttcctgtagaatggaaagacaagttcttttttagaattcccaaatgcacttttaaagcttctacatggaaatcatttcatggtaaatgtcgttgggaataatgaattcaagtgtactaggtgttaagtatgttgctacaaaggaatggaatatttagcaggtgaatcttttaaaatagggttgatttctctgttcacaaaattttatagagaacctcacataatgcatgattaacagagacagaacagagtttcttgcttgtgaagatctgattgtcattttctgtttccagtggaccttctggggctcttgaaatggcgctccaacaccagcctgctgcagcagaacttgaggcagctgatgaaagtcgatggtggtgaagtagtgaaggtaacatggagcccaaagggactttttgggtctttttttttttttttttttaatgtatgttaacagaagtaggcagtgacttcaaaggtagtataggattgtggttatactccctttaaaaaatagtgacatacggattgggtgcggtggcttacgcctgtaatctcagcactttgggaggctgaggtgggtggatcacctgaggtcaggagttcaagaccaccctgaccaacatggagaaaccccgtctctactaaaaatacaaaattagccgggtgtggtggcgcatgcctgtaatcccagctactcgggaggctgaggcaggagaattgcttgaacccaggaggcggaggttgcagtgagttgagatcgcaccattgcactccagcctgggcaacaagagcaaaactccgtctcaaaaaaacaaaacaaaaaaatagtgacatacacctctaggtgcacagagtgtttcttggcttctggtttggggggactctctgggttagccgtgaaggggactggctttgcaatcaacctcatcgtgggttctgcgtcctcttcccataggtcctcactacaggactcacaacagttcagtgacctctttaagcctctctttcccctgccatgagaagtggggtaacagtagtgccttctgcagggtcgttgtggagcctcaggtctttttactgttgtcatgatccttgttactgccatcagcattcgtactagactccctgagatcccctttaagtgaccaggagaggtctgtggtgtggtagaaagatcacgacactgagaggcttgcctgggccgtcttcttcccacgggacgctctgcagcagtgtcgggtataattattcattcagacccttgtggcctcagcatctttatctgtgagagagggcagtcagattacatggccggaggtccctgggagcactcagcttctggaattctttactctgtaattgtttgtggttctgatattttctgcagtattaggctcttctctgctctcagataccccacaatttgctggggcaacttttccttgtacgtgaggaagcgaatttccatttttagtcgattctgtttttggctatgggacgataagggggtcactggcatgtggcgttctataagcatagactctccagcaaggtctgtgtgttgccgcctcagttcctcactctctaggagaggtgattgcagaaagagacgaccttatctctgtaaaaactaattacttaaaatggccttaattaaccagcagtgtgcttcacttcagtatcaattaatttggtcgcaccagtttcctgaatcgtataactcttcagacatatactcactaatcttaaaattttaatcatcttctcagtcctggtgttctcccaatggcttggacaatgttaattgcattttaaacttccctgtgttctgtaaattccctaattcaggtggaaactaggtgaatacatgaacgtagttgagaagaatccagttaatgaaattttgtcctctttcattttgaagtccctgtatcatattaggaatgagttgtatttctggcgaccagttaccacagttacctggaagaatgtagaatgatcttgtcccgtcattctcccccattcccctcatctcatagattctcacatttgattattcatccctagacgtggcctttacacctttcctttcttcctgtgcgtgctggtaccacgcaagcctgggtgacctgtccagcccttacctaccttgcctaactttgtgctttttctctgctggcgtgtctgacatgcgccgtgagcctagagagtggaactgacttgaggccacggggctgttaatggccagccaggacttgaggaattcctgcctgcacggggctccttttgctgatagggatgctgatagattgtgggtttggttccatttattcaggacctcccttctgagtattgatgactgatagcagagagatggcattgcttggtagattgaggaaggtatttgtgtatttagcaaaagatacgctgtcccattagatggaaaatggaaatggtgactttggtgcccttgaacatggtcttagagagagggtggggtgccagatgaagccctttcatggctccgtgtgaaggccctccttcaggtgctcgcccctgccccactgcagctccgcagcccaatacgtgcagctccatctccctgtggttctgtttctgtgccactgaccatgtcatgtgtctgggtgggaccaggtggtctacttcagggactttgcatgaaccgtgacaggccaggtcctgccacctgggagcctgttggcagggaaatattcggctgttagcagatggcatcaagttttgaccttcgcaaagaatctacattctgaaaatgatgggaaatggtgcaaaagtaacaaagtggtacagatccacatagttaggagttgattaatcccttgacatccagaccagcatgccttttggtcaggttggttttgtttcccactgtttgcatgtgacattttctggtataaagtaagtggtggctggcacagccaagcatggagaggattttactccttaaagggtctctgatctcatgctgggcatgctgggcgtcctctctcccaaaggaaacggatgaggctcatgctgggcatgctggacatcctctctcccgaaggaggcgggcgaggctgttgctgctgctgtggttccacagcactcctttgcgagcaggagtttgtggtttgcttctttaatcttggggctatagcagtttgagatcttccatgccatcccaaaagccccctgggtgttgggaagaggctgcacagtccaggaggaatctgaaccaaacacctgacccagcctttcctctgatgtccttgctgtgtgatcacctcacccatttatttttatttttctttaaattacagtttcattgagatataattcacataccaaaaaattcatccttttactctgaagtttttagtgtcttcatggagttgtacaactattaccactgtctaatttcagaacactttcatcatcccaaaagaaaccacatagctattagtagtcactttctcctcttcctgtaaccactaatctgcttcctgtctcgatggatttacctgttctggatattttatgtaaattgaatcatacgccctgtggccttttgtgtctggcttctctcacttagccttgtgtcttcaaggtttattcatgccgtagtgactatcagtgcttcacacctttttttgttttgagatgaagttgtgctcttgttggccaggctggagtgcaaaggcgcaatctcaggatcttggctcaccacaacctccacctcccaggttcaactgattctcctgcctcagcctcccaagtagctgggattacaagcgtgtgccaccatgcccggctagttttgtatttttagtagagatgggggtttctccatgttggtcaggctggtctcgaactcccgacctcaggtgatccggcctcctcagcctcccaaagtgctgagattacagatgtgagccactgcacctggcctgcttttatgcctttttatggccgataacattccatcacatggatagaccgcagattgtctttccattcattagttgacacacatttgtattgattctgcttttttggagatgatgaataatatttgtgtacaagttattttgtgaacatatgtttcctttcttttggagagatggccaggaatgaaactgttgactcatatggtaaatctgtgtttaagtttttgaggaattgtcaaacagtttttcatagcaattgcacaattgtacatttctaccagcagtgtgcaaggtctccaatttctctgcgttcttgcccacttcttattagtcatcttaaattgtagcccagatagtgggtgtgaagtgatagctcatgatggtttccctttgtatgtccctaatgagtaatcatgatagatcagtacttcatcatgtttatggccagtatttcgttgtgtggcgttctgcctcttcttgaccttctcttctaatacgaatcatcacttccaacaccgtgatcttcagtccgtcttacatttcctgcaggggaggatggggtgggacttgaagctgacttgtagtgtgacatgcctttgaagtctcttcctaattacatgtatgatgctttgtccttctttgcagtagtatttatttggtaaattttagtcaactgtaactgtaatttcgacattgttgttgaataaagtaagcaccttctggtctcaaaactgggatactgctgtgtattccagtttcagaatcacgatcctcttccatgcctgggcaccctggttggtagaaggtccttccttccactcagctgggtcctgtccctgtgtggcttctgcccattcactagctgaagtcctgtacccagtgtgtagaatgagtgagatgcatcttcccagagttgccattcagcgctttgtcaccagccttatgaaaaccggaaagagggttggaaaggccccctgggggaagcagtaggccctctccttgctttgaccctctccatttaacactggtggcatttctttgttctgaattcactcatccaaaatttttgtcttgtgtatctagtggctgaaaaggatcccgaatggctttataggtagtgctgggggcaaagtgggtatttggagtactgcagagatgatagttattccagtgtgtggggggagtccggtgggttcacattgtcacccgaccttctgtgtctatgcagtttcttcaggacacgttggatgccctcttcaacatcatgatggagaactcagagagtgagacttttgacacgttagtctttgatgctctggtaagagagctttccttctcatatgcttggataacacagcgttcttccatgctgcagcgtctgaggctggagtcgggggcttcgtcacagtgaccttgaacgcattttcagttgtaaatccaatcagagatgaattggggtggcagattttttttctcttttttttaaatgtaaaactgtagttaggcaaatgtcatttctagggtaagaaaaggtaaactagccaccaacttctatctgaaaatgttatggttcatatcctaacacaggggtgcagatggttctgatgaagattataaaatggcttacattatgttgctaatgaaaatattattgattaatttgacaggtatttatcattggactgattgctgatagaaaatttcagcattttaatcctgttttggaaacttacattaagaaacactttagtgcaacgttagcctacacgtaagttcctactttgttttaaaaccaatacttctttttttggtatttgtgttatttagagtctttttcatgtacttttgtctatgactgtgtatttactcctgctcaaaactctgagtttactggaataatttttagtattgtttccctcttaacatacctaaaaaccttgttgaaagagatatgtgataaatcatcgtaatattctggaataaattcttgttctccctcacaccttccatttatctttgaaatcttcactttatgttcgatgaaactgagctttggatgcggagtgtctgacaccgcggcttcctcgcgagcctttgatgaatggataaatgcatgtgttcccgtgttaaggagattggttgtttagtgtgaattagatgcagttttgtactttgcaatgtatctccttgctctttaaagagcaccttcccttttctttgacaagcttcagctgtcactgtcttggattccttctatccacccctctgcccgtctgtgccccagaggtctaggaagacaccagaggctatgcatggtgcctgggccagcttagcagtgtgcctggtattgaagagcagagccctggagtctggagtcaggctgcctgggcttgatgtgcagctctgtccctcacaagctctgtgatcttgggcaagttgcttaacctctctgtacctcagccttcttgtctgtaatcagagcatgattgtaggcttgtgtggaaattttaataagttattacgtgtagagtgcttggactaatccctggcacttagaaagcactaagcaattattgggtttcattatcattagatttattatgatgacttaccggctctttcttggtggaatttattggcatttattcagactttttattgtgtgagttacagcaaaacataaagatttacataatttctttaagaacatcccgcttagaatcagtagaaaggattctttttagtgtgagtaaatttagttaaaactcccttctgtgtcttcaacatactttgcaaaatacctgtttttcctccctgtgtgcagtcatgaactcaggtcagaggactctggcctcctgaagccagctgttaatataccctggtcctgcacctggattctttcatatctgcctcgtgtgcgtgtttactgtaaggtggtgggtggagctccaggaaggctaagagctgtgaggtcctcaagcctgcggaacaagctgtgactagttctttgcacttgcttgctaataaacgtttgtttaaaacattttgttcgctgagtggagatgcccagtgtgtgggcatgtcgagtagttccttacagaccgtggggagggtgcattgcagggcacttttcctggctcttgtgaccaaaacaggagcttgtggggtttgcggaagtggcctgtggactgcagcaaacgtagcacggcctccacgtgtgctcattttcaaaattctgccttttgattgaaatgtggccaaagaactcttctcagattaggctccgtgcttgaatttcagaagatgagaggcatgaatcagcttaccacactgcagccacatctcttcattggcgccagcctttccatgctgtgctgttggggaaggagtgatgcagccattctcataggtggagaaagaaaaatgggagattttgatgagtttcctaatgagacaaacaaaaagtaccattttttctttatgctgtgatgggactgagataagaatagtatcctcatggccgggtggagtggctcacacctgtaatcccagcactttggaaggccgaggtgggtggatcccatgaggccaggagttggagaccagtctggccaacatggagaaacccccatctctactaaaaatgcaaaaattagctgcgcgtggtggcacgtgcctgtagtcccagctacttgggaggctgaggcaggagaatcacttgaacccgggaggcggaggttgcagtgagccgagatcgtgccattgcactccagcctgggctacagatcaagactccgtctcaataaaaaaaaaaaaaaaaaaaaaaaaaaaggatcctgtcattcaatctatggaatctgctgaaaaagaaatttttattgtggaaaataagtattgttagcatgttttggtaaactggcaacctcacgtggttcctcagcagcctgaatttgcatgtctgcaccttgaaattccaaaggagtcagtggcgactgagatagctctgaccacatcatggaaggtcgcctccgcattggtgatatgcttacagtattctctgggccaggcgaaattccagtaatattatcccagagtgtccttgtcctcttctcctctagaaggctttggtaggtacaggcttactttagactcttgtccatgtagcctctctcctttggtaaatgttgagatctttagcccttcttcccaacaacaccaagagaaggaatgaaagattttggcaatggggagtcctcttccgcacctcgagctgtgtctgcggctcccctgcgtgggtagttcatggatgctggagccccactggactgaccagcactggtacaagtgagaatgaagggaggcatcggctttgggggctgctcttccataaaaccagcatgactgggctcctttttgtccaccctatggagctgctgcaggctcctcactggcaactgatgctccatctgctccgccccctctagccagtgccaaggggttgctttttgtgcaggtataagatggcctggcagatttatttttatttattttctttttgctgtctaattccaggttaagattcatttgctggttctaggtccttcttttatttattttctttctttttgctgtctaattccaggttaagatacatttgttggttctaagtccttctctttgcaaatcattattatttttctttttttaattggtttgaagaattcccaaaatgtgttctatggaatgtttattccctgggatattaatatatgtaataagaggtgcgtggtccagtaagtttgggaaaataagtaaaactgagtgaagcaggcttcatgccagggtgttgcatgctctcttgtgcagtgagcaccacccgcagaggcctatatggcaaggtgtgttttccagccaatggagatggacaccgtagcaggaggatctgcagacttcgcctcttcagaacagcgagcaggagtgtgactctgagagcatcagggctccctactagagctctggtgcctgatcggtgttagaaatggcttcacatccactcagtctcccaaaaagcttttcaggccatgcatggtggctcacacctgtaatccttgcactttgggaggctgaggtgggcggatcatttgaggtcaggagttcaataccagcctggccaacatggtgaaaccccatccctactaaaaaataaaacccaaaaagttagccttgtgtggtggcaggtgcctgtaatcccagctaatcagaaggctgaggtaggagaatcgcttgaacctgggaggcagaggttgcagtgagcagagatcacagcactgcactccagcctgggcagagcgacactacgtctcaaaaaaaaaaaaaaaaaaaaaagattttcattgtgatgtattggtaaaataggtactcttagctcatccataattgcagtgaaggttgctcttctgagtgtcttattccataacctgagtgagcagtctggcctttactggctcacaactgaaccagacatgctgtcagtaccccagcagattgcttttatgaacataaaaatctttcatgtggcttttaaaaagcctcagtgaattttgttggatgcgtaagatgttggtgactggagaagtttgggtggcggatattcttcctggtgtcttactggctgcacgcatggtgctagtttttggagagttgcagtgcagctcagtacattaaaaaatgaccgtgtgttgttgttaattcagttgttcttttattatgtgtaagctattgcttgagggtcatccttatgaacaaggattattatttgatgagtcagtaatggttgaaagtgtagaagtgtggatagaattaaaaatggcagatcctcactactgcctctatcatttaaaaataacacatgctcaacggataaaaaatagtaaagaaatctcacattactcaaatgttatagtgcagacgataaaagttcccttgtatgtaatgctacatattggagatatctactgtgccagcatttattttctatgtttatattaacattgttattaagattatgactaatatgtctgcatattttacaaaacagcattgttatttttgcttgcttaaaatttaaaaacttaaaaattgttataatttgcatacaacaaaatgctcattttaattttgtttggacggtttttgtatgcccttggaactactgcccaaaacaagacataagacattgccattccccacaaacatccctcttggcctatctgagcccatcccactcccagacaagcagccactctgtggtttctgttaggaatgtgttttgcctgttcttaaactttacaccagtggggtcatgcactctttttgtatctggcttcttcccttccacataattctcttgagattcatgcatgttgctttgtgcatcattaaatatttgattttgctcctctctatttctgagcagtattttattgtatgaatatttcatgatttgtttagccattttcttgttgatggatacatgaagtgtttctagtttttggctattccgaataaggctgcgatgaatattcttgtccaagtctttggtgaagtttgtttttgtttcccttggataagcacctagcggtagaattgccgggctaaaggatacgtgtatagttttctttgtaagatattgcgagacagttctccaaaagggttgtaccatattgcattcccaccagcaatctgtgaatgttcttttgctctgtatcctcatcaacatttagtagtgtctgactttgtagctattgtactgggggcaaaattatatctcttggtgattttaatttgcagttactggataactgatgatactgagtacctgtttattttattttgatttgccatttgtgaaatgtctgttcaaatctctttttcattttatattttgttgtctgtttcttattgatgtttatggtatgtgtgtgtatgtgtttgtgtgtttatacacataaatatatgtatttttttttgtcagacatgatttttgaacattttcttcctgcctctgtttatcccttttcttaatggtgtcttcgatgagcagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataattttactcaatttttgtgtattccaaagtgtgtaaacttttttatcatggaaaagattttaaatgttttcatattaggatgttacttgattttagatcccaatttataaataaacagactaagagtatagtagtcattgtgtttttaaaactaaatgtttttggggaatcttattaggaaatgtcaatattttaaaatcttcatgtgtccactgatagtattcttactattcttatatattgtttatagtcttctctataaggatttttacaatattattaaaaatttaagactgcttcctatttgaaagcccatttgtaaattttaattttcggtgtaagaactctagttttagaaaatcaactaaaatgaataaaagtgtctgagatgctttccaataacaaatactgtttcatgcctttaaaaaaattgttgtaaaatacacataacataaaattcaccgaatcattttattttattttatgattttttgagacaaggtttcactcttgtcgtccatgctggagtgcagtagcgcgatcttggctcactgcaacctctgcttcctggactcaagtgatatctcttgcctcagcctctcgagtagctaggactacagccatatgccatcctacccggctaatttttgtattttttctggaggcagggtttcattgtgttgtccaggctggtctcaaactcctgagttgaagtgattcacctgccttggcctcccaaagtgctgggattccaggtgtgagcaagagcacctggcccctacctaatagttttaaagtgcaatgttgagaaaatcgtcaccactatccatcagagagtatttttggtgtcatgcctttatgaaaaaaatttttgtgtctctgtttggctgtaatgaaaatctcttcgattttattgtttaaccttggggaagctagtgttttacctgtggaagtcctggtttcctcatccattaaataggataatactgcctcatagtgttgctgtgaaggctaagttagataatgcatttcacctgcttagaacaacgtctacacttagaaagggcttattaaatgctcagcctttgctctcagaggtattttatcaggcacatttactgattagaaaacgttttacaggccgtgcagtggcttacgcctatgatcctaacactttgggaggccaaggggggtggattgcctgagctcaggagtttgagaccagcccgggcaaatggtgagctgctgtctctactaaaatacaaaaaattagctgggcgaggcggcgtgtgcctataattccaactacttgggaggcggaggcaggagaatcacttgagcccggaaggcagaggttgcagtgagccgagattgcaccattgcactccatcctgggtgacagggtgaaactgtctcaaacaaaaaaaaaaaaaagagaaaacgttttacagatattcatatactgatagacggaaaccaaataaaagtaacctacttgtatatttccttagcagttaagatttgagatattttcctttcctgagcttatttgtgcgtgtttgcattgtgaataggaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcagtgcgtacctatcccctccatgcccgggctctcagaggactggcaggagatccttcacttctttccttccccttctctcgtccccttattctttcctttcttcttccccctttttcccccttgctttctaggctgagagagcactgttgatcctggggtgagctgcccactctttccttacccgcctgggtccctgccggtgctgaggcgggagccctgttcctggtctgagatgtgtgcctgtgagtcgagccttggctcctgaaagcattggcgatgacgcaggtgcaatcctgggcgtctactgagggctcagaagcccttttcaggatatctttatatggcaaaaagtcccaaaagaaaaacaacaacaaaaataggccgggcgcagtggctcacgcctgtaatcccagctacttgggaggctgaggcaggagaagggcgtgaacccgggaggcggagcttgcagcgagcggagatcgcgccactgcactccagcctgggcgacagagcgagactccatctcaaaaacaaaataaataaataaaacaacaatgaaaaggcaaaaccaagtgaaattgcctcacttgggcagactctgggatttcctcctcctcttttcctcagtagagtgatgtttcatttcgggagaactcttcctacatagggtatttccgtgaggaaggatactcaggtgctttagcctagtgacagttttcacacgctgtgtggatgaacttatgaatgatttttgagctttaaagtaaatcgaagggttaaaggggaacaaaaaatgtatttattaccattgaactgtatacttaaaatggtaaagatggtgaattatatatatgtatattttgcctcaataaaatacataaattgggatatttatggcttattttatagagagccttaatattgtatagatacagatgcaggttaagagctgcgctaaaatgaggactttctaagttggcccacgcctcttcactgtatgattcaaaagatgtgaaaagtaagtgtgttgagggtggggtgtggaatttcactccctctgcttggttttttgggggatggctattttgtgggtgacctgccatgagtgatgtcaatggatgttggtggttctacgttgttattgttcttgttgtgagttccacacacagatgggattcatgaacctgtgtccctctgaattagcgaatacatttgcctttgaaaagcatggtgcccttgtaacctattagcgagaataaggaattgaaagtgtgggcccacatcagtgccttcccgtttcctcctcactgtgttttcgtttctctgaagcagtcgtgtccagaagaaggactcaggagaagggggaagaattcaaaatctaaccatgtgtctaccatgatagtaataaggacaaagcaacaagttattgactgtgtgttgacctatcagagtcataaacagggtggtaaccactagtgatgtgttactggtcagggactggagtgtgcttctgttcactctggcgtgtccatggtcaaaaccacagtcctcgtgctgccatttttgcatacaaatatggcatgtttgagggcatcatggttttgtccttgacttagatattacactcttttattttgcttattatggatatgcatgacctttggtgtggattgaagttttccctcaaggatctaagttgtgatttattttctctttgttagggtgaaacacagcatggtaagctaggttatgttttcttgtattttaattctatttcagtaaagttaattctatgaaaatgaacttcctggccccccctgccttgctgttatattttcctcactgattttaaatctctgattatgctaaacccaagtcagtactagggtgggaggatgaacttgaaagatgttacagatttttgtcatgttttatttgaaaaatgttaattttgtgcagtttgtgatcaatatgacattgactcaggcatttgatgatctgcatattctcacccgataacactggactttccctttcattcagaggtttgtacttaaaacgatcgtgcattgataatggtgtttctgctatagtagtaaatgctatagtcttttatacaataatgctgctttagaaaagattgagttacccaggttgaccagtagcaaattatttctctgcctcgttctttaatctctttcaatttcaaaatacaaatggcacaaaatcttagattcatggtccataattttttttttcgtttgatcagtctaatagtgcttaggaatatgattggctgcatgtaatagaaaaacaccatttatgtgacttaaccatatggggttcactttttttttttagtcacataatgtgcagcccggaggaagagttccgagttcatgcacctgcgtgaggactcagcgtcctgatgtccttggctcctttgatctctctgccccaccatccttagtggggtctctttatctcctaatcctaagatggcttctgcccctcccagcatcagctctgcattccaggtggaggagaggggaaggcaaaggagaaacagctgtgccagctattcttctttgaaagagctttcctcatccctagaaagtgtcatgtgctttcatcttattggccagaaccatgtcacatgaccaccctacctgcaaggaagctggaaaggatttttagatgggctggttgatgctttctacaataccagagtgattttagtaaaggagttagggagaaatagataatggatgggcagttaacattctcttcctcataccttcaacccagatggtctgttccctgagagcttccctaactcattctgggttactaaatcctacttaactaggttttgcagagcctttcttctccattagtttgggagtcaatctctgagacttctgtcaccagtatctctttggctttaagtatctctttaggccctaagtgatccactggcatggtttagtcctaccaggctacatagaaatggactgaagtactcagctgctcctcgtgtttgggacaggaagtgtttagtgctaaagtcctctgaatgcctgcattctggtgctcaacagcatggcacagaacatgatcgctctacctgcctttgtcctggtatggacccagcaggagccaggcatggtccacaaactgagtttctttgctggtataacttgtttgttagaagagttgagactgttgaggacacaaagtggtcacaagacaagttgtagcaattgttacaacttagtgaggctccctaagcctctgaggccattgtctgggcattcctgactttagctaaccgagtactgcagtgattctggagatcctgatgctgctgctgctgctcctgatcatgatgatgatgatgatgatttgagacaggacctccctctgtcactcaggatggagtactgtgatgcagtcataggtcactgcagcctcaaacccctgggctcaagccatcctcctgccttagtctcccaagtaactaggactacaggcaggtgccagcatgcctggctaattttttgtaggacatggtctcgctatgttgcccaggctggtctcaaactcctggcctgaagccatcctcctgctgtggcctcccaaagtgccaggattccaggcatgagcccctgtaccccactgattctggggatgttgatactcatgttccttctctccctccctcttttcctcccttcttccctagcttcttccttctctcctcgcttcgttctttcctctctccttccctccttttttctctcttttgtcccttccttccttccttccatgaatacttaatgagtgtatgagccccaagtgtatcccagactttcacagtttgactttattattttttctctgaacgtttcctgaatgtggatcctggctgcctaccctcattcctgaggggagagaaggacataacgttctttgagatgtagagcacctagccgcattgtgcagagacaacaaatacttcaatttaaatctgtgttctaaaatggctgagaagatatttcatagattttatgagaggaaaaaacccatgcccttagaatattggacggtagggcagaagtcttctagtaatccctccccttctgtcctccccatcccacccctgctccccatcatcccaccacagcatgtcagttgttacttcatctgtgctatcacaggtctgaaatgtagctgaaatcgttttcctagcttgtataggctacttaaaggaaaaagagccccacgtcccacacagatatctaggatgtttgatccgtgacaagctccaaatgagtctcctgtgtggtgctgtcagaggtggggaagaaaacaaactaggactctcatcttcttacctgcagcatgtttattaccttgagagaaaaacaattgtgctcacagctggaattcatgagtgtgttttcctttttgcagctgggataaacttttgagatcttatttttctttggctttcaaaatggtctattgtgttttcctatagtgcaatagctttgttaaattccagtataattgacagtaattattcttccaaagaacaaagaggtgaaactttgaagatgaagatattgaagcttatgttgttaacttactatctttcttgctatgcagtctcatattttttgttttgtttagaaagctcattttgttttgaaatgagaacaacagtttaaaagctatggcccaaagacatttggttcctggggaacccactgaaagattcctgacagccgggggcacttctctactggtttttgtttgtctgtgttttctgtgtgggtggatcacattaactagaaagccagaaaacagatattctgcatcagaatcaaattactaaatctagttattgcctgccttctcttctgggtttcttgtgctttgtagagtttttgcctgtcatctggtgttagctttgtaaataattagttattgatcatgaataagttgtacagacctttttgctatcattccctgggtcacaaaatagaatgtagttaatagacaaagatcctgtcattccttgttaatgaacacttatttaagtagagcaaggaatgagcaggtcttattcatctgtttatttatcgataagtttctgagttgttttttctcagttttttatccacttcagggtggatcaaaaaagtggttctccctggtttatctgggaaaatgaaaagggaagattctagagactttaacagtgatcttttgttacagaaagatgcttcaaaaggatcacggcaaaatgctatgttctaaacatgttggttggcacaagagaaactgttttacatttttactcatgagaggttctggtagaatttaaaaaatattaaagattcattaatcatgccttatagattttgaagctgtgttattgggggcatacagatttataatcatgatgtctttcctgttggtctattccttaatcaatatgaaaagtttctcttaatcttttggctagtatttgcatggaatacctatttccatcttttattttcatgctttctgtgtctttatacttaaggtgtgcctcttataatacaacatatagttgtatttttctttcatccagtctgacaagcttcttaattgagcatttcatccatttatatatagtgtaattaagtaatgttagatttatatattatttttgcattaattttcccttctccatctgtattattttccccttttcctccttttttgccttcttttataccagttacactttttttaagcatctcattttctgatttttaaacatattatttgaatattcttttactattatttttaacaattattctagagatggtaacatccatgttggacttattttagggtatttcaaatgattactcttaccaatccactgataatgctagatatggccagaaaaatagcacgctggaattgccattttcttctcctctgttttatattattattgtatttcaattctatgttttatattccataagacattactgttattttatacagttagtattcatttgatgtgttttatgtttgtaattgtttttcatccttcaatttcacttttcctttgggatcattttctttctgtccaaagaactcacttgtattatttcttttagtgttggccagttatgggactctgtttgtatgaaaatgatttatttcatctttgtgtttgaaagatattttcactcactatagcattctaggttggaagttattttcttcttccatgtattctattctattttgatttccttcatttatagtaagtcattagctttcagacttactgttacatctttgaatttaaatggtattattttctttcttgctgcttttagtttgtctccttttctgtggttattgacaatcttactatgggttgcataggattgtttttgctttttatttatcctgcattgaatttctgaattttttgattgatatctttgatcagttttggaagatttgtggccattgtctgttctaatgttacttttgtctcattatcttcctccttttctcctggcacttcaattacatgtatgttagatctcctcaatatgcctgcacattcctagccctcttctgtattctcttcctcagtacttctgtttagttattttctgtggattgtcttccattttactaattctgcctcttgctgtgtctactctctattttgttaatccatctaataaatttttaattttagagagtatattttgtagttttagaatttccagttgattttttcatagattcatttctctactgaaatttttctcttaccttctatttgtcatttttttatcttattttccctgttctcaaatatgattatagttgttttgatgttctaggaaattgtaatatctagattatctgtggggctgtttctgctctctttttcctctttcacttggactgtggtctggttttctgctgagtttaataatttttgtttgaagtcaagactgtttgtatgtaaaactgtagaagcttcagatgatgtgatcttcttccagagataattcatcctgccttcttctagacaaagtggggctgaccatcttattttaatcagagactgtgctcagtttcgaggctacactggacctttagtatgcctcagtctccatttactgtgcctctggctttctaggattttcatctgagagtcggctctgttacctggggactctctccctggcgttttccaaactgcgagtcattttctctgatgattggtgcaaattccactttgctttatagaggttttcgttttggtttttagtcttctatcccatacaggtctaggaattacagatgtcctgaggggaaaaatgattgcagcttgatggctcccgaagggttgcaccagtctaccaggtgttcttcatgccacttgcaagcagaagttcatgattccatcattttaattgtttggtacatcatttaagcaaaccccatttgaaaacccttatttacaaaacagatccactaggttgcaatttcccattttacacagaatttgttgctttacagtggaattcatttaaatatcagactacctctagggtaattaattatcacttagtttacaaaattttccattgtacacaagttttcaggtatcgtatatttttaattaggcagcaaactagtattagtaaacactgtattaataaaacatctgagtcacaatattttaaaatgcaaatgtgttgctttttagtaacacagcaacttgaagtaactgctaataaataatttacaaacgagacttattttcaattagtaacatatattagcatacatgtaaccaatgcacaacttccttattacctatttattgaatatgtcccacctcttgaatacttttcagttaccactgatgttgaaatgaatgcgtttgtaaagcaccattactctggaataaaaaagcaactcttgtgatatcattttaaaggattagaagatcatggtaaatttaggcaatggagtgtgttgttgattttcaatttgtgacataatgggtttaaaaacattggtagtggccgcctggcggctcacgcctgtaatcccagcactttgggaggccgaggcaagtggatcaccttaggtcaggagttcaagaccagcctggccaacatggtgtaacttcttccctactaaaatataaaaattagctgggcatggtggtggccacctgtaatcccacctacttgggaggttgaggcaggataattgcttgaacccaggaagcggtggttgcagtgagccgagatcatgccattgcactccagcctgggtgacaagagcaagactccattacaaaaataaataaataaaataaaaataaaaacactggtagaaaacacaactgcatcttaatagtgtaatttttgtggggtagaaataaagctgaatttccccatcctctttccctccttctcttcctcggccctttccaccctccctttctgtatattttctgtgtttttcagatttataagatgtagtatgttacaatgaaaaatgcagtgagtggtagcattaagggtcagcctctgtatgtggaggcacgctgccttggctgagtggtctgcatgagtctcactgccaagttaccttccttgcttcatagatgttgaggatgtggtctctcattctaacttgtcacccaagtgattcccttcatggctatagacatggattcaaaaaatgttgaggtgtttctgccaggcccccacagtttgtgtgtttctttgcagactgtatgaaaacaagggagaggctgacttcgtggaatctttgctgcagctcttcaggtccatcaatgacatgatgagcagcatgtcagaccagaccgtccgggtgaaggtgagtgccggccactgccaaggcagacttctccttctttttttctttcattatctcttttggaggtaggtattttgattacagttaattaacttgccccaaataccatagttgttaatgtcagagatctcaatttgatttcaagagctgtgctttttttttttttttttttttttttgagacagaatcctgctctgttgcccatgctggagtgcagtggtgtgatctcagctcactgcaacctctgcctcccagcttgaagcaattctcctgtctcagcctcccgaattgctgggactacaggcgcatgccaccatgcctggcaaatttttttgtatttttagtagagatggggtttcaccatattggtcaggctggtctccaattcctgacctcaggtgacccacccacctcagcctcccaaagtgctgggattataggcgtgagccactgtgcccggcctttttttaattttaattttatttttagatgacacataaaaactgtacatatttatgggacatacgctgatatttcagtacaggtatacgatgtgatcaaatcagggtaattagcatagcatcaccttgaacatttttcatttctttttgctgtgaacattcagaatcctttctacttgctttttgaacatatacactaaattattgttgaccgtcttcactctgcattgctacagaacactggactttattcttcttatctagctgtagctttgtatcaaagtggacttgtagatgaagggcttcctgtggctgagctaaggggctgtgggccctgccaagcctgaactcgagggaaaggccccggagcctcttttgtagtgaacataatcatgctccatgtgtagtgaaatcccttcttcctcctccctaggtgctcttaaatattttcattgcttctctctttgctgtttggcaagacagattctgaattcactttatttaaatttgggggaattgatgagaatcatgttttacacctaatttctcagggtgtccatgccctggaaagggtggtgaaccttcatgcttcagtggatctttgcctgtgcagaagagcgagccttccagtgcccctgtccttctgtccttcttccctcttttgatgacctggtctcaccctgttgtcctttggaagaaagatcccttccactcacatgaggcctgagtgttctttaggatgctcactggtgtggaagtgcctgggaggcccatggagcagccgcaggacccccacactcttggttatcctagttatggcggttttcactgggctgacttattgcagaaggagctgtacaacttgcaatttgctgcctgcactaattccttcaaagaacaagaatcttccaaatgattagcttacatctttcactcgactgatcatggtagacgcctctgttcttcctcttttaatgtttgtttaacgtataattttagaaggcattcttatggctagtgtcttaaaaatattttggtcaagtcgcttcccagccttaaagctttgccatatgccctggaacaaagatgtatgtgtgctgagacgtggctgatggttgctgtgaccaaggaaaccagcataagtagacatgaatcaagtcggagcctacctttcatctcagaggtggtgcagctgtttggtggagccatttggactcttcactacgatttcttgattttttttttacatgatttactataaaaattggtgatttatacagaaagaaatgtaggtggtgcatacattaaaattttaggttatttgggcaacttgatattgcccaaagctgtcttattgtcccaaggttaaaattagcaatgtgtttggtacatttactactgaattcagtggcattttagaaaaacagacgtgtgtagtgtaagaatagataaaaattacaggaagttttgagcccagcagtaattttagattgctaaatatatccttacattattaaatttgattgggcttgatttgtgtctgcctccctcccttgaagtcagattacttagtgactagggaccgggaagaccgtgcttcagtgggtgttttattataagacacaagtgaattgagtgacgtgtgtgcattgatgcaaaccttacatctgcaagacagacgcacggcgttttattaggcatgtcacctcccttctggtaattggtatcgtattatttcacaataggtgctttctcgatgacgttggaaatttaaagattcccatcgtgggagcctgacttttgtgttgttttaactctttcagttttgctgtgtctaaatggaaggaaataccttgtgaaccatcttccacagacaaagtatattttcagactgtgacatttaaaggttaaacattgtttccccaagtgtggccctcgttggtaccaaacggttggtaccttcccggttcaagtgattctcctgcctcatcctcccagtagttgggattacaggcacccgccagcatgcctggctaatttttttgaatttttagcagagaaaggctccatccccttcttggtaccaaacctgccactggcatcaactttgcggattagagtcagccacggggttttacgcctcattgaagagggagggcaggaggaacttcagaagtcatttattgcaggataagcatggtctccagctagaattttcaacaggactgttttcattgatttagtgacaaaatttttccaaggtcatttaagtgagaaaacacaaatggaggacgcgtgggccagtttttatgttaagtcaaatgtccaggaaactccactgagtgtgtggatgctgcctgccttcactccccttcccagcggccgtctcccgtcacccccgctccccaggcgcccgccgtgcccagatgtttcagtaccgcctcaccgtccctcagtgaatggccctcagccctggggctgcagccaaatactttttgaaaacatactgccgtggccaaataacatgaaattccccatttctaagtgtcccgttcagtggcattaagtacagtcacactgttgtgcaaccatcatcaccatccctctttagaacttttacgtctttccaaactgaatggaactccagccccatcaaacaccaactccctgcagcccctggcagccaccggtccactttctgggtctaagaatttaatggctctgggaacctcatggaagtggactcataccacatttgtccttttgtgtctggctttttttcttttttttgagacggagactcgctcagtctcccatgctggagggcagtggcacagtctcggctcacagcaacctctgccttcccggttcaagtgattctcctgcctcatcctcccagcagctgggattacaggcacctgccaccatgcccggctaatttttttgaatttttagtagagacggggtttcaccatgttagccaggctggtctcgaacacctgacctcaaataattcacccgcctcggcctcccaaagtgctgggattacaggcatgagccactgtgcccggccgtgtttggcttcttttatatggcataatgtctgcaaggttctaccaggtggtggcatgtgtcagaatcttcttcctttttaaggttgtcatgttgctgtgtgtctcgtgcacattttgcctccgcacctgtccctggatagaggctcggcctgttcccacctcatggtggttgtggttcatgctgctgggaactggggtgtacaggtgcctcttgaagaccctgctgccagtgctccagaagtggaattgctgtttctcgtggtaattatgcttgaattttttgaagaatcatcctgtttttcccagcaccccaccatgctaccgaaacctcacttgaaattccatattgactttccctcagcagccctttccgcagctcctccagctccaggcatatcctctgccgcacatcacctaccttgagtgaatgatgcggctccgactgctgcattgaaaaggcctggggtcagaggcggaggttgcagtgagccgagatcgcgccattgcactccagcctgggcaacaagagcaaaactccatctcgaaaaaaaatgataaaagaaaagacctggggtctctcggtatcacctcttcctgtctgttttcctctgaagaggagaagcccacctgctgtgcagtgctgaccgtccccctccctgagacccgctccacccctagctgtttcctcaccatctcagatcttctgtcttcaccttgagctgccccttcacccggcccagatgttctggaaattcaacccgtgccttctggattcttctttgccctcggcgtttctctctcctacctgacaagagggtccttggccccattgcctctgccctctagtcgtgttctgtgttctgccccaagagattgtggctgctgttcctcccaggtgcccccgccgcccccagctgcggtgtctccagtcagcctcggaattcccttctgctgtcttctcttctctgtgctactgtgactgtggtttcatgaaccactgggcttgctaggtccccagttcttcgtcttgaaattagggcagaaaagtcttggaaccgtttcctgcatgctgatgctggacctgccccttttttcctcggcatctcttttggtgttttcctgaaactcccatctggtgatgacttgctgtttctcagaaaactgtgctgttcttcagctgccaggagaaatgggtcagattccagtgtgtgacatccagacagcttcataggcagcccacctggctctccaagcctttttccctcgtggagacccaagtagaaccagtgcgttccccaggaaacaccaaacatctgggtgtgaggagcctcctgagggttagctcccccaatcagtggttgatagaaatagcatgagcgcctagtgccagagtaactggagctgatacttattgatcgcctgctgttcaacgtgctttgtatttctcaactgatttagtctttacaatagccctattaagtagatactttgattgctttctgatgaagacactgaggcctagagaccttaattaacctacccaaggccacaagagctgggatggggtaacgcgctggtttaaaccctggttggctagttccagaaccactctctttcccatttggctcctagagacagtgttgctaagtcctggctatcccgtggtgtttggaaacagggcccatgcctgccatccacatcaatggagaacaggctggatgctttgggctggaaagatgccgacattatccctggtggagctttccatcgaagtggacatgcataaagcaacttaaaaactctggtgaaatgccacaagaattgggtgagtgtgaaggggagggaggagagttagaaggggctggtcacgaaggcttgtgggaggagaccttggcgatggccccactgtgttggcagcaggtggctgtatcttggccactcgtggattgcagtgctggattgaggcgtttggggctttgcagtcagttcttacaggcattgacatcatttcaagtccacaaatgttactaccttcccttaggatgaccctgggaaaagactactgcatgcaggaccttggcatagtctgttccatctggggctgagaatgccagaattttctatagaaggaaactttgaccatgatccacagtaggaaattgatgcttacttggtatatgtgtgtgagtgtgtctgtgtgcattgtatgtgtgtgtgtgtatgtgtgcgtgtgtgttgtgcatatgaagctggaaaatgctcatgaagaagttctacactgattccctgtgatgcattctggcattttctagtctagtctcctttagtctattctagactaatgtatttcagttaaaaaaaaattgctggttgacaggcactaaatttatttcatgagcactaatggatctcaacctgcactggaaaaacactcctctttattcatctcaggactctgcccctctgtctcctgcttagtttattatgaaaatattgtcagctttctgcatttcttccattgtcgtgtagagccccaggcccctgacgctcaggcaactttcctgaccagcatgcggattgaactggggtgaagattaattgaatttgaggccccccaagctgaggttggcacacagatgcagaaggtttgtcttccttctggggcactgtccccagggagcaggcttccccatctctttccattctaaccatcacatggcgccatttccatctggctttcttagagaggagctgtgttgaaataagctattctgtaatctcagtaaatacagctgatgggtgagttctgccctccaagaggcacattttttgattcccttaaaaataatttcctgatttgaaatgaactgtattttcttgccttaaatcttacccagaattcttccttatgaggagtttttgctgctttttgtgtatttatttccgggctagcatctgggatccacacggctactcacagatttgtacacatagaactttactgtcctcagaacaaatgatctgaatgtgttagggatgatgataatttaagatcagatggaataggatttgctggcaggtgaggaagtcacgtttcactgagtaactttgggcctgtctggcacctctcctacagcagctcctgccttcgccccttcgtctttatatgtgtgttccagattttcataaaggtatcaagtcctggtagttgcattaaacaaagcagccatttattgtgtccttgccctcagtttaaaagtaatatgtgatctggttagaaaaatgccaaaaagttaattaagaaaaataagaatcatttatcaccctaccttccagagattacactgttagcatttttgtttttacagtgatgagctctttttgcttatttagcattatcctatatatatacacacacatatgtatacacccacacctatatatacacacatataaatgtaacatatgtatagtataaattctcatgtgtatacacacacacacacacttttacagtgttgcatttttctgtatatatctacctgtgtccttcagtatttttcaagcacacattttgaaaggttacacattgcctcatggctgtatgataacttacttaaccagttttccatttgagggcacatagctggtttctagttgtcagttttcatgaacagtgcttggctgacctctctgtctatggcaaaggccttgctccatctggtttgctctgaggcatccagattttcaaatgctctaaagtccgatgaaagtcatgatcaaggcgattagggcttgattcctgggtgatgactctgtgcttctttcattggcgccgtgtgtctgccctgccttggtttccactagagctcccgtctgtttcttttccacttccttctatgcttcttgtcattgggctatgcagctgccatggtggatgagtcgggagccacttccctctctcagaagccacctgcttctgtgacctttgtgtttcttggtacaggattgttggccaagttaggtaaggagacgagaactccggtgcgttccactccctctgacctgacgaatcagggtctggagcaaaccaaccaatgagatgttggcaccgtcatagaccagcaagcagcttaaagaaatttgggagtattttgagtcagaagggtttcccaagagcaagtaataaaatattttcaccttcttgattttgagtggaggagggggtgcactgatggtgttaattgatctgaggatgtcatgggcatgagtcaggagtctatttgagagtctctcatcattcgtggggacacagatgcggtggtttggatgaggaccgtctaggtcacattgtctgtatggagacagacttgttgaattagaatattgggcagctgaggctggcaactcaggtgaagccaaccatgacaggaaggactacacttgttgagaatcagcaacaggccaggccttctggagagttctcctgcaacaaagagaagagagggaggtcccagagtcgaggaggtgagtaggccaagtttggaagttgctctaacaaaatactacaaacttggtagcttaaaacagtggtttttttcttctctcagagccttggagattagaaacttgaaatcagggtggcggcagggcaggttccttttggctgctccaagagatgatgtgttctgtgcctttctctaggtttctggtgatccttggtatttcctgacttgcagatgccttgctccagtctctgcccccgtcttcacgcagcactctccctgtgtgtctgtctttgtgtctcttctcttcttatgaggttgttaaattcagggccaactctactgtggcgtggcctcaggtcaacttgattatatctgaaaaaagactgtttccaaaacattcacaggtcccaagggttggaacttgaatttagcccttttttttttttttttttttttgagatggagtctcgccctgtcacccaggctggagagcagtggtgtgatctcggctcactgcaacctccacctcccgggttcaaacgattctcctgcctcagcctcccgagtagctgggattataggcacccactaccacgccaagctaatttttgtatttttagtagagacagggtttcaccacatttgccaggccggtctcgaactcctgaccttgtgatctgcccgcctcggcctcccaaagtgctgggattataggtgtgacccactgcacctggcctgaacgtaaccttttgaaggacacagtttcacccacggtagacgtcatcgtggacgtcagtgtagagttcactggcaggtcagtggtgaacaaaggactggagaggaagtgggtccttagccaggcacccacagtcagtttgacatgggagctgcaggactggaaacttcttagaatctagtgtgcacatgagtcacctggaggtcttgttaaaatgtgattccgactctgtagggagggggcctcaagatgtttcattataatcaactcccagctgatgctaaggttgtgggtccctggccatatattgagtcagaagtggccacgcctcgccttgcacagacagctgctgtgtgagcagtagtgtttgtgggtagggcacctggtctcagttcttgcagccttcaaggctggcttcattcaggctgcctgccctcagctgtctgacgttctggactattttgatttgataagtttgccctacacacagatgatgacacacttgcaagtgtgtcatgttaagaaagactcagcagaagaaggaacgagggaagtgaagaaaatattttatggcttgctcttagaggacctgtgggtccaaatgctccccatttcactatactgcttgctggtctgtggccctgcagagggttgggtagtctggctgagatctgaactcaccaggtgctgcagcattccagtcttcttggttgcttcctaggattcttcctgcccgctctggagggaacaataccactcacataggcaagaattaatcaggagaggtctggataaatacacttgtttccttgagcacctctccacccacatttatactgtgcacagtactttgcaacagtagcagaaatgcagcagtagcactaccttgcagaaatgcaacagtagctgaaatgaaaatcatctctcttccaccgtttcttcagcaaaccaagtatttctattggttttcttccaattctagtgcatgcccatcaaaatgtttatgcttgcaacctgcgtagtttttggtttactgatttttttatcattttatcacaacacctttccattattaatgtgtagttgtaattgtaatggctgtatgccagttcagaacatgtgcctgaattgatgtgcaatcatttgcttaatcaaatgatttttcctcaaattaatttttctattgttgaatactaccgtgttgcttttagcattttaagcctgcaacaaattatttcattgataagtagtgtgtgtttatgttttctttaattttatgatccatttttccatgttgattccttcacattgccacttgttagaggacaatgctttaatttgagattgcagaattctaggcacttgcttgccatccctcctgccttgtccccagtaatgatgctcactggtggaaaatctctcctttggccatggtggcttcagtgctcaggaacctgaacttattttcttctcccacccctgatcttgttcagagatctctcttgttaggtgctcctcccacatctgtgccctcggtcttggattctgcctgctgccaacatgcaaggtgccagtgagcccctttctccttcctccatcatggtcaggatttattcagcatttctctgaaagtgagcaggtctcagagttatgcttagtacctcattgttgagttatgtattcacctgtttaaaaaattccttcaatcatatgttcattctcctgtgtgccaggcactgtgctaggcactgaggagttacagcaccaatcacacagatacgctctgtattctcatggtggttccattggagtgagcaaggcaggcgtgaactcagtaaccatcccctatgtgtatagttgcatagttgcaatatgtgattttaagcaaatcacagacataaaattatcattgtggattgtagtcactcattttaagaaaaagtaaaggtcagggtgacaaggtatatcggggcattggaagtagtttaggggttcaaagaaggtgctgatacaaaggtagtcaccatgaggtgcttggatatgtaatacagcagaggaaaatgccaaacccagactctcgtatggtttggagagaactgtgctgccacttttgtccagaggggttgtggagcatgaagtaatcctaatcccttctgttcgtgcagtactctcaggcaccaaagactttgatgcgtgttatctcttaggatcctcccagcactgccatggtggttgttaaaaataatgagaaagctttctaaagggacgggcagagaacatcatcatgcaaagtctgtgcgtcttaatagctgactcattgatggaaacatttatatcccacatccactggctcttgtctggcttcttcaaatgcacctgtccctaggaccccttcctagagataccagcatttagaacagaccagtctaaacaaggtcttctcaagtgaactgaagatactaggcctgcaaacgctcatctgcacctcacttacgatgtggcatttataaatgcattcaccgtaggtgtttgtagattctttttatgttttaagttttaagtttgcagcattgaggcctattttgattgcaaattgcataaacctcaaataagatctaaatcaaaggaaaggtattgcatgcttataggtgactcaacattaagaattcagttcttcccaacttgatctacagattcactgcagtcccaatcaaaatcccagcaagtttttttgtggctattgaccaactgattccgaagttcatgtggaaaggcaaaagacccagaataatcaacacaatatttatggagaacaaagtcagaggactggcactactcgacttcaagtctgctggaaagctccagtagtctaattacagaaacccaactccaattcacattagaaagaaggaaattaattgattcatgtagtttgggagtccaagtgttaagcatgagtgagtttaggatttagaaggtatcctcctcttggcttagtatttatttctctccatttgagggaaaagtggctgccagtagccagaggcttgcaattttcttttttgtctaatagtcttcgaggacacagagtgaccgtctccctctttaaggcaatgttaatcttcagacagaaccatcgttaaccttcttttaagcaggaggctatccctgaaaggaaaagactgtgaagttgaaacagaagtagagcttcataatgcagaaaatggagaaagagggatgagaggactcacaggaaggctgaagggacatttgtaaatgcagctgaagccagtgcaaattggcgactttgtgaaatgggttttgcagctattctttggagctgtctgctgaggtgatggaaagggtagttaaaagcttcatttaggattggtgttctgccagcatgccaagtagcccaaaccaaggcctgggaggagagcagactttaaatatgtcccaggaaacgttttattgagaaacatgtcaactaccactatagcattatcaagagggaaaaaggaatatttcatatgtgagcttaaaaaatcattagctctgttatattgaatacttgcaaaatttcattaaaattgtttttgcagaattttatgatagaataaattacttttgtgtatgtattgatgaaatcatggagttatatgagtttggatttctcaagcacccaaatagtcaacatcaagaatcagggaattaggaggttagaaagtcacatctttagtttttttcaggaacttgcccaggaacagaggggtcctaggtgggatgaccagaccccagttctctgttcttcagcccagtgcttttttcatgacatcactcaagtcagattttaaatttgtgcattacactggctttatttagaatcctgtgccaggcaatatagttttgattagaagctgaacagtattattctccatgaactgtgaatgtgacacttttataattcaagtagaattatttttcccttgggaaatcctatacattcaatatggtacattgaattagcaaagaggtagaagaaaaaaggggctataaaaagtgtatcttattaaaacaaagtaggttttcttcttgcctgtgtcacctttagatagtaattcttagcatcactattttttaaatcacaaattgtcttctatctagtgaaatgattaagaaagaacagtagtcctcatttgattaggtgaaacgtgacacaagtctcgttgatttttgaaaaggacattttcatataattccaagaaatacacattctgacattaaacattttatatgatccctattgaagattaaaaggagaggtgtttggccgggtgcggtggctcacacctgtagtcccagcactctgggatgctgaggcaggtggatcacctgaggttgggagttcgagactagcctgaccaactgaccaacatgaagaaatcctgtctctactaaaaatacggaattagctgggcttggtggtgcatgcctgtagtcccagctacttgggaggctgaggcaggagaatcgcctgaacacaggaggtggaggttgcggtgagctgagattgcaccattgcactccagcctgggcaacaagagcgaaactctgtctcaaaaaaaaaaaaaaaaaaaaaaaaaaaaaaggagagttgttatgtctgggaaattaggtggccatcaagttttttcatggtttttgtttcattgattgattgattgatttgattgacgtactgagaccgagtctcactgtcacttacgctgtagtgcagtggtgcaatcttggctcactgtagccttgacctcctgggctcaagtgacccttccgcctcagcttccaaagtagctgggactataggccagcaccaccacagatggctaatttttgtaatttttgtagagatatggtttcgtcatatattagtctattttcacactgctataaagaactacctgagactgggtaatttataaagaaaagaggtttacttgactcacagttccacaggtttaacggaagcatgattaggagacctcaggaaacttacagtcatggaggaagacgaaggggaagcaaggaccttcttcacatggcggcaggagagagagcggagggggaagtgacacacactttaaaccatcagatctcatgagaactcactgtcatgagaacggcaagggggaggtctgcccccgtgatttagtcacttcccaccatgccgctcacccgacacgtggggattacaatttgagatgagatttgggtggggacacagaaccaaaccatatcactccatgttgcccaggctgagtgctagattcctgtgtgttattttagggcactttatacttttattatttaccagtgtttgagaagtttatgatggttcacaaaactttctcttcctacgtgggtcttatgtgtgtttttgagtgagctgatgatacactcgtggccagcactgttctgtgctgtgtttctccacccagtgtgtggacatcttgctatgtgcacaggtaatatgtccttcttacacagaggggtgcaaaggttgagtcaaatcagcatccaaggagttgctgataaattgagaacttcctgacagcaagtgacaccaaaacctcaactaaaatgatcagcaaagatccattaagaaaatatcggccaggcacggtggctcgtgcctgtaatcccggcactttgggaggccgaggtgggcggatcacaaggtcagtagatcaagaccatcctggctaacacggtgaaaccccgtctctactaaaaatacaaaaaattagctaggcgtggtggctggcgcctgtagtccctgctaatcaggagactgaggcaggagaatcgcttgaacccgggaggtagaggttgcagtgagccaagatcacgccactgcactccagcctggatgacagagcaagattctgtctcaaaaaagaaaagaaaataccaagaaccagaaaacgggtcgtggcgtaaaccttggtgaggaccttggaattcaaggtgaaaggcagagtgtgccccagggagtggtgagggttcctgcagcatatgcagctgcatcccccaccccagcaccctgatttctcctcactgctcagctcctctggaatccttgccttcccacctcattggtggagctgctccattgaaacccaagactccattccaggcctggcctcagccccatctctgcccagggctgacaggggggctccgtcatctaccccagggcctgtgccttccttcttcctcctggtggcatttccatgttgggggcccctgcttgtccctggggtgcaggaattcttaagcacctttggcattttgctcctgccttcttgcctggagtttcactgctgtctgcaggcctttgagaacagaggcagggaggtgccagaagcccttgagagtgtggtgattaggggttggatgccctgtgcgaatggcaaggaggatgattcttgaaagaaaatgtcagggtaacttaaatttctctgaggtcagcttgcttgttgttaattaagttcttactacgagggccgagcgcggtggcttatgcctgtaatcgcagcactttgggaggctgaggtgggtggatcacttgaggtcaggagtttgagaccaacctggccaacatggtgaagctccatatctactaaatatacaaaaattagctgggcgtggtggtgggctcctgtaatcctggctactcaggagaccgaggtgggagaatcacttgaacccaggaggcagaggttgcagtcagccgagattgcaccactgcactccagcctaggtgacagagcgagactgtgtctcaaaataaaaataaaaaaagttcttaccaagaaagcagtgctaagtacttctccagcactgcttcatgtcggttggcttctccagacatgggcctctttgtggatgttattggaaagggtagtgttttaatatacgtgcgcttttcacatggattcaaggatggcatgggtgggtgggattactcgactttatagcatattaagtgcttatttggtgccagttatggactcgtactgggcagatgccatgaggaatgtacagtggaagatgttggattctgactgcaggagaggaaaccaggtattcgaccccccaaatagatgacagattgtgtggtacatcactgcatcattgggtgtccagacgagagattgcaggcaagacaaggacctaaagaaagtggcaagtgcactgaaaccaccagttaaggcctcctcagagcaggttggactgccctgagctttgaggggtgggtgtgagttgagatgggggagcattccatggaggggcaggagggtatggatgggagggagaaggacagtggaaggaggtggtggggatgggttgttctcttgggagcccaggggcaggagtggaggcaggcagcctcgttccacccctggtattcagagccgagaaaaggaatttggacgaggaggtgctgtgctaatgagaggcagtattagagatcctgagctgacacactggaaattgacatatgggcttatttatttatttattttatttatgttttaaataaaggttaagatcttccagagaagacataggaggagaaatgggcattatttttccaggggtctcttagtatgtaaataacctgagttcttaaaagttttatcttatagaatttttttattagttcttttatttttgtcatgggaaaaattcagaagctttcctggaaacttgcatgtctgctttcagagttttgtggctcttacaaggagcccctttgggggtgtggggcaaccttgcatcccaggaagccgcctgggagattctagggctggtacctcctttccactcagctgcctgggagattctggggttggtacctcctctgcattcaggctgcctccatcagctgaagaggcgagagtgtcataacatgacattctgtgtatgcgcaatgtatttgtagaagatactgatctttggatccggcaatcccattcctgggtatctacccagaggaaaagaagtcattatatgaaaaagatacttgtacatgcatgtttacagcagcacaattcacaattacaaaaattgtggaaccagcccaaatgcccatcagtcaacaagtagataaagaacatgatggagtactacttagccataaaaaggaatgaattaagggcatttacagcaacctggatggagttggagaccattattctaagcgaagtaactcaggaatggaaaaccaaacatggaatctcctcttcatcctttttctgtctgcctttccttgttctcatacttaaagacagcgtgttgggagcggtatattgctgttgtttttgtcttctccaatctgaccacctatgtcttttatttggagtatttaatcccttgctttttgtttgtttaataatccctttataaaacagctgaattataaattgatggataaatttatagatgttgaaaggcacaaatctgaagtatgcagcttaatcaggtttgacaaatgctgacactcatgtaacccacactggcatgtttgcaccagattaaagaacatctccatcaccagtctctgaacattggatgcatttaccggtggtgttgggtatatttcttccatactcccgtctggaatctgaacctcttgatcccatttgcctcagcaactctgactccttcagactgaaactttctatcccacagtattttcttgtttccatcaagaaaggaagagatttaaactctgttctgcaattctgtctgcatttcctctctggaatccttctctctctccaaacaaagtggttacctctttaaaataggcagtgaacatcaaggaaaaccttgcataggctgaaaagggcaaagtgctcacctttgcttgcattgggaagtaatttcttttaagtgtgcatagagacagactaataaaaaaatctgttgagtgtgtcatgtggcagtcagtctttagaagtgttgttcctttgtcttttaatcattctcagaattagcacaccagttgtgtgatatgtaaaagtctattcctggcagggtgaggtggctcatgcttataatcccagcactttgggaggccgaggagggcggatcacctgaggtcaggagttcgagatcagcctgaccaatgtggtgaaaccctttctcttctaaaaatacaaaaattagctgggcgtgtaggtgcatgcctgtaatcccagctactcgggaggctgaggcaggagaattgcttgaagctgggaagcggaggttgcagtgagccaacattgcgccactgcactccagcctgggcgacaagaatgaaactctgtcccaataaaaaataaataaataaatcttttccctagctcatttttttttgactgtgttaaattcagtggagcaaggtctcatttatatcctccttattcataatttggggtaattagcatagtggttgggctgccattcacctcttacagctaggaaaatgaggctttgcgagaggaatgcaaaaatataaacaggattaagtcattgatggcatgctcatacttcctaggagaattaagtcttttcaggtaccacagtatgtatgagtccttcttaactctcatttccaccagatctccaccaaggagtttagaactgatggactccaagtctccctctggatgagacattctgagttcttgccaatatcatgctaagctgggttgataatttcctttgaaaaatttcctttgaaaatgagtagcatttcatcttttggaaatttatcattcttcagacttttcactgacctgtcccctcccatagccgaccccctcctgtaccccagggtttgattgatatttgcttttgtattgtaattactatttaatatccagccctcctgaggtttgcttcactgcagtcacattgtattgcaagcagaaaatgtcacgtcgcctggagctgttggggtagtgtggttgtggtcctttgggtatttcctggcacacctggctcatgacatcgtgcagagctgaacaggctctaggaggaggaaggaaaccttgcctgggtacttaaaattatctatcacagtggatcctgagtctgcctctcagcctgtcttgaatgccaggctattataaatcagctttatttattttgtgtttgaattttgactttcctgttcaataatttaatattttaaaatgacacctttggtcttttatttgtcataagcgagggccgagttagccaccctgcaatttgcctctgtactctccgccccccagtgtgtagtcgttagctcataattgttttcttaacctcctcagagcctggtgtgatcttgctctcaaccttcttgaccttccaaggtagttaaatgaggttttgctttctctatgaattaattatgtcatctctatttgaaatgttcctgaacccatggtgctgtattttggcaaaataaatactattttcagagactgtaagacccatccattttatttccttttattagaagatagaacgattttcttagatgagcagttatcagctgatgttcaccttcttggaggaagggactgctggcggttttacttcaaatgcagccatttgaagtatctgatttggaacattccatacctggtgcagaggccacttgtttctacaggtttgtcctggtggtctgtcctctgtgccattgaactcccagagtcctctgcagaggacatgtaataattcttgcctattaatttgtggaccctgtatgtggggctttttttttttttgcctgtttgagacttcctgcctttaggagtagacaatgacctttcatacgtttaatgcttctgttgttctcaagtttgagaatgtggtgtgtcccctgggtcccctccttacatgaaatccaacccaaagggtcagtgtgtttcttgtgtgtttctgtcttcactcctctgtccgctttcatctctttcctggtgagtctctgccctgtcataagcaaataaccttagttgtttcctccccagtaatggtggcttcaattgctgtggatttcctggcctgatttcaaggctaggggaaaatgcctgtgtcctggttcagaacaggcagtctctttatttcttctgtcttgccgtggacaaatagaatcgtggcccttacgagttctttctaaaaaaatcacctttattgaggtaaaatttatatgaacaaaaaaatagaaccatttgaagtatctgattttggatcattttgaaaatgtcccaaatgtcctctcgtcaccaccgtaatcaagagctggaacatttcgccaccccagtgatctccctttgctggcccctggcgatgctcatacatgtggtggttcttcacgcgaaagcagctgacctcaaagagggtgaacatgagccctgctttcctttcctctttgacttcctctctgatccatccctaaactacaggattttgtcatgttagttcctattttctattaccatgaatgactgttggcgcctcaggctggggaaggttaattgtagtaacaaagaagaggttttcctggcaggaaccatttccttactcaggaaacaaacgctttcctttctcacagtcatcttctccttcttatgtaagtagaaatattaagccatactcagtctgtccaggtcctgagaattggtgtctgcccgggtctgggtttgtattagtctattctcacgctgccaataaagacacaccttagactgggtcatgtataaagaaaaagaggcttaatttaagggactcacagttccacatggctggggaggcctcacaatcatggcggaaggtgaaggagtagccaaggcatgtcttacatggcggcaggcaagagagcgtgtgcaggagaactgccctttataaaaccgtcagatcacatgagacttattcactatcatactgtcatgagaacagcatgggaaaaacccatccccatgattcagttacctcccaccgagtccctcccacaatacatggggatgatgggagctacaattaaagatgcaatttgggtggggagacagcccaaaccatatcagggttgcagaggcttatgtgggaggatcaagagtgacagcaactgtctggctggaggggaaggagacagaacctgtccctgggccttcgtctcctttccccgtgccccacacctagccctggggagcccgattccctcctcacactcccttggctcccttcttgtctctgtacacagccccaagcacaaaacgactgctcattttcctggccatgctgtgctttgctgtctccatgtctttgtgagcagggatctttctccttggaaggcctgttctcttcctgtcttccaggacatctgcctgtcagcagtcagccttctatatccactgcagaggccatttgtttctgcagatttgtcctggtggcctgtcctctgtgccattggactcccagagtcctctgcaaaggacaccatgttttcattaaacacatagaggaggcatgttggcaaatgtcatttgcagatctgtcttctctagcagggcaatgctcttggccattgaacattttgcctggcatgccacaggttccaacactttctggacaaatgaataagtgaactggagatcagtaagttattttgaaaatgcacctgctgtggcatttgaggagatgtaaaatacctggtgccctcccttcccaggacccctccaagctggacgagcagtcctggctccttggtggggcattgtctggtgagccttgagggcgtgcttgggtgccagcgatctccccaccctttgctttgttagtttttgctcctgacctactgctttgatttgagaaacccttcggctattaaaatatgagttaatcatctaagaaactcactaactgaacttcatagtgaggaagtatgcttcctgttgatagataataaaacagagtggaataatttgaattctttataatggatgtgattataaatgatttccccatttactcatataaaaggctaaatggaagatgattagtgagttctgttttctgtttttcctaaggtgattttttaatcttcccaacaaattcctgcgatacagggaagaaaaagaaaaacccattaaaatttgcttaaaatctttaagaagccatttaaagcttcagaactgagtaatctttctgcccccttagtatattatggcacaggagagaaaacaaattacaggcaaccactctaccttgctttaacgtagggttaggattgcttgacatcttctgatcacattattgtgctgctgatacttgtcataaatgtagtgatgagattctggatgtaaaaatatttataatttcccatctcttgttatccctaaaaaattaatatttgtaatgggtctaaatccttctaaatcccattatttaatattgttctgcaatttgatgattaaagaattgttatttttttacctcctttatccttaaatccttcacccataatctcctgtttataattgcaggtgtctaatgattcataattagttaattcttggttggtgagtgattgtttcatattgcaattaggaagatcatgcataaagccatttctagttaaatgtgtgtatgttctttaccaggcttgtgttcaagagttctgtagttaccacgttatagtaatctctgaccttatttttgttaagcaaagacatctggttcaaagaccctctctcaccagcaagcggttctcattcaatctaagcatgttgaaaaaggccctttccctaaatgggcttgggagcaatactggggtcgtggctgtcctcagggtgtctgagcgcttctttggtagtctgcaggggaaaataccaacactggtaatgccccattcagatgcagtattctgtccaacaaggcacaattgcctgcctgggaataggaggctgagataccattgattgtttcctatgtcacttgtcaagtggaacacaacacaagtgaatgtctgcacaaaatgtactttgctatacctttctaacgggtttacatgagggaatggagctcaaacttcacaggatattctatgcagagtaggtcttaccctagggatgctcctgctgctctcactccacctgtcctccacccaccaaggcacagagactccagcaaatgtgaggaagagggtggggattggttgatgggcagagctggctctgtgaaagggggttaatctgaggcatcttacctcctgaagacttgggtgatgggagggagatgtttctggagcccagggcagctactgtggcattgagaccaccttagcctgggttggcatggaagactggaaatcttgcctttattcctgtcttgttcgttgtcctctgattgaatctctgcgttttagcccattgtcttcccaaagcttgattctcacctcttcctctcaactcctggcctctgtaataatggagaagccttgggcctggaatttggaggggaagaaagggaggttaagaatccttatctttttgctttcttcattatgtggcttcctcgatctttttgtacaacagtaagcaggcttttatgaactagtagatattaaaaaccacatcagtgccaactaaacaaattatatccaccagatacttttgagccctctggtgtgtgccaggcaatattctaggcatggagctctatcagtgggcagggggtacaggtggcagtaatatacagctgaccttatgttctcatcatggcaaagagacagtagagaattgcattatccatcagttagggataaaacaacaaatacccactgctgtttattatctctgtcctcttatttaagaaaggaactcttggccgggcgcggtggctcatgcctgtaatcccagcactttgggaggccgaggcaggcggatcacgaggtcaggagattgagaccatcctggctaacatagtgaaaccccatctctgctgaaaatacagaaattaccagggcatggtggtgggtgcctgtagtctcagctactggggcggctgaggcaggagaattgcttgaacccaggaggcggaggttgcagtgagccgagattgcgccactgcactccagcctggcaacagagtgagaccccatctaaaaaaaaagaaaaagaaaggaactctttgccttcttagagcaggagggaactgagttcttcatagagaacagatctaaattatagaagccattattattatttttcaccatttttcttattgtatcacagtccagttgtgggacattgtggatcactgcaggctgcacacaggcatttgggaggcatgacttctttctgggtactgtgcctttttaaagcctttggtgattttattcatacttgctttcattcaacaaatgttttccagcaccaactgaaggccagatgctatgggaggtgctggaaaggtattagagcctcatctcttcaggagttcgtgactcggtgcggggatgcaagagggattcagtgagggagacacaccccccgccccttacagtcctgttctgtgctgctgttggatgaaactgctctgcaggtcttaggaaccagccctggaaaccccacctcccatccccccacccccggtgcaggaagggaacttagtcttcattatgtgaccacccacttatgtagacttcccacatttccccccaaattagtccccaggagctgagtaaccttctctttgagtccttataacatttttatctgaaatgcaaaaacacatttgcttgaaacctccatgctagtttggcatgattttagaagttacctggcagaatgaatacaaaagaagcaaagaaatttaacatgaacttggcattttcttgctggcatgaacataattattggatgtcattataaataaaccttttaaaagtcactttaaaaatagaataattggctacattgcagagatcatgaaagatcatgaatatgtatataacagttaattaaaaaaaactgctaatattatttaaatgggtgattgtggcttgggaaaaatttttctgtggttcttaaaaagtcccgtgtcttaagcacttcagattgacgtaaaatgatgacgaaaatgggtcttggtgatgatggagacactcacgtcaaagggacatgtaaaaagttagtgtaaaatagttttatgaaatggagagtggacgaaactactttaatattcctatacatgaatattagataggcatgcataattaaattaataacgtgttttagtaggcacttggcttttatctgtatctataaaagtgtaaatacttgaggtggccaaaacttgacattttctcattgtaatgcaattcttatttaatccagagtcacctcactcatagggacagaaagcatttctatagagcgggattggtagaagaggggttcatggactacataagcctccagaaggccaggggatgtggtcaggctggtggaaggaaaagcactctgcagcttgttcttagagcaccaggtttattaaatatctaagtgggcatttttctaaacgagtgactttcttcatgatatgtgtgtgctgaattcaaactatacttggcaaagtaatgtgagttttcaggagatgggcttataatttttcatgcagcagagggagcatcagcttctcaagtggatgctgagaagttctgtgatgtttagagaatccagttagatggctcactgttttatgacattgaacctagttttgactgagtcacagaaattcatgccgggctcagacgctgatgctaacaggggcaggggagtggagtagaggggtgctgctttgtggacctatcttggggagaatattgggtagagtgttggtccccggagcctttagggtagattgtggtcctgcgggcacttccagaaaacagtcagcggctaacctggggtgggcgagggagactccttaaagttagaccacagtccccattctcaagaaacatcccccactcttgctgaagtgtccctgtgcagtttagggtagtagccaagccttgatgaggttactctgatgaaatgtaagtagcattgtagaactaggaattggcatcatttaggaccatttacccgaagtagaaccaaaataatttggtattaattggtcattaaatagataaggaaactttggctacaaatacacatcttggaattacatggggactctcaccctggacttcctttgtcatagctttatttttatacacaattgtattgatcaaattctagaccttacaagctccacagctgaattatttaattctctctgatgatcgtctcaattcattttccaataaatgtaattattttcttgccagcgttcgtatttaattgctaagttttctctgatttgctctaaatcatcttttacaaatgcgtagtgaaaggcagcaggttttctcttctgatggtggcaattataaatgtaattttatttaacttgataaccagttcgctgccaccaagggcctcatatttttctttatcatatgtttgggcacactgtgaaatcatcaaacaccaaaccttttataaattggatgtgcatgcttttgtccttttcgcttattattgtactgtttaccgtcgtcttctgtgacattttctcttgccttcagtcaattttggaagcaggcacattcttctgcaacaaaacaccatttttttcttgattgtaagcagagatgtcattcccgtgcttgtgttagatatacccttagaaattattaaaagctgtccagctgcctagtggttatgtgcatggtagatacctcaactgtgtttgtttcgtttgtcctggatatatgtctctgaactcttgcttttattgaaattaatctcttgtttctgttactgtctctgaaaataacaatgattatggtgctttttaagtaactcacaatgtgtttaaactatgtgggaaagagaatgtgaaaggtatgttatatttattttaatgttgcccctcaaaatgaactggaagccgggttttgggaggattccatttaaatgcatttatgctgaccttttcatgattctcatgtttaattgtattgcacttcagagtcacccagcctgaaagggacttagaatcccatggttgccagttggtgtatgactgcgcctccctcagtggtcaaaactgagattaaaaagaaagggaaagccctgtatttggaaggttatatccagaggagttcagcacccctcagagtctaaggggcttcctggtgatacggccccaccgctgcagagaaatgcccccagcctccctacttagtgcaccaggggtctggaaccctctctccctaacacccaagaccatccatagctcggtcactccccacagacttcacccgcagccatgccgcagccaccagcacctaacctccagactcctgaggaagctaggcggctcccctgtgtcacctcggctctgccatccttttccctgcccatacacatggagccctggacacggtggcccgcactgcccttgatggagtgccttgtccctggacccctcccgtgactcagctctgctcctgttggccttcttgtcttctgtctctggtcagcctcttttggtctctcctgtggactttgcttcttgcccctgttctctgtgtgtttcttgatgctctttcccatggccactccctggaggcccccacatctggattcagaccccctacccctcgggcctcttgcgcctcctccacctagccccttccttctttttttccttggcttctcctgtgcacccactttgtttccttccattctgctgttcactccagcctcaatctccactctcagtgacttactgcttccttctcctggggacctcaggaaaacggaggattctgacccccacacctaagataataggaaagagcctccctcccccaggagagggggctgcccctgcccactgcccctggccaagtccaggcttcaggctggctctgcctttccaggccatggatgatgtttgaatgaggccctgggcagggcgtggagatggagtgagccctcgagtcctgggtggtggatgctcttgtctccaggagagatgctgcccagtgctggcgtgtggacaccgtgccatttagtcttccccaactagcttttcctttggaggagaaaagattgtctgacttgtggcaatacttttagttccataactgtaaacttttctttctcttttttggtggcatttataaaaattccctgtcctacatatctgaccacatttttaaaacatttattagtttggatgttcatgtttaaatcacatgatgtaaaatgtttgttgagacacagctgaaggattgttgaaaagcaactgtagagaagcagcaggagcttgtttaaggggtgggaggtgtgggcggcagttctggacagtgattgctgttcgggacactgggatgcttctcctttctggcttcctgggattttttttcctgggcaggttctattaaaccttgcttaatgaaggcactggcactgatagtggcttgcatttggcaagacatggctgttcctgggtaccaggcagtggcaccggaactcattaagaaggtgactaatttcagggccgtgttaacatagactgaggctccatcatggttcccaggtgtttgtcggtcgccgctggagaccattgtgtggatcagtcacatggtctgctgcagtgtgagtgacagacggtgacttgctatcagtatgcaaaggtcacccggtgactattccaagaagtgtcattttccagtggagaatgggactttttttttttcctgttaataatttatttcttaattgcggtaaaatacatataacataaagttaatccttttaaccatcttaacacgaacaattcagtggcatggggtacatttacagtacatcaccactaggtagttctagatcatttccgtcaccccagaaggaaaccccacagccgttacagtcactctgtttcccccttcacactgcctggcaaccacgaatttgttttctgtctctacgattagcttcttctgcgtatttcatataaatggcactatagaatatgtggctttttttggtatatggcttcttttacttagtatattctcagggttcatccatgtgttggcaccccattactgttcatggctcggtagtattccattgtatggacagaccacaggtgtttatccatttatctctggatgcacacctggcttacttcaccttttggctgtagcgtatagagctgctatgagcattcctgtacaggcttctgtttgaacgtctatttggttttttttttttttttgagacggagtctcattctgttgcccaggctggagtgcagtagtgtgatctcggctcactgcaagctctgcctcctgggttcacaccattctcctgcctcagcctcccgagtagctgggactacaggtgcccgccaccgcacctggctaattttttttgcatttttagtagagacggggtttcaccatgttagccaggatggtctcgatctcctgacctcgcgatccgcccgacttggcctcccaaagtgctgggattacaggcgtgagccactgcgcccagcctgaacgtctatttttaattcttttgggtatacatcgaggagtgaaactgctgggtctgtttctgttgagttgactgaagaaaggatattcgttttattgctctatctacatggacctctcctgcattacttcagtgagttgtgaaggttggtctggatcgctttccctctttcctttttgaattgtgcctttagctgtaggttgaacacaggtgctatctttcacgttttcagatctctgagatcttcactggggatcaaggtccaaggaatcaaagctcatgctgtgtttgctcctgagcaggagagagcgttgtttagagggagggagaaggggaatgcttgaggtcagaatcacaggacagcaaatccgtcttgagatttcagaaatcaccataaatctgtgtcccttcccagagaagagcgtgtcaaaatgcagcattcgtaattgaagaaagcaaaatcagctgactaagtcgtaagacctaggatggtgaagagtctcagagtgaccaaaaacacacagaccctgttctcagggaagctcctgtgcaccgactgcatgctctatagacccctgccctgtgggggcccattcatgcttacagggtacatcctctgggagaaagcatgacaagttggtaccggggaacctgagggccgggatgaatttcaggataaaaagagcagacttagggatgctgccatagtatatcgtctagatttgtactgccctattgaaattcaaataaaatacagctaaatgttccatttctcagtcaccctacctgtatttcaagtgcctgatggacacctgtgcccagtggtgactgtactggccagagctgctgtagaatagtcccatcactgcggaaagttctgctggtcaggtctggctggaccgtagacacaggagtggccatagcagtagtgctgggagctgagaaggtgcccagtgcacagaggaggatgagctggatcggggaggagaggtcaggatttgatcctggaaaggtgtcattgtagtcctggctctgtcatcgctcagcaaggcatcgctcccgccacagggccccagcctccctgtgtgcccaccacgggcctggcactggccgccctctgtgccactcagggcaggagagtgagggttgtgccacacatgggtccgattgcttctccatggcgagaagaggacagacactgggaggaaaagttgaggaaccttgacatcccatgctgctctgtcatccaagtggctttttggttttctaggcattcttttttttttgagactgaggatcgagcagttctcctacctcagcctcccaagtagctgggacttggtacccaccaccacgcctggataatttttttgtatttttaatagagacagggtttcaccatgttgccaggctagtcttgaactcctgacttcaagtgatccgcctgcctcagtctcccaaggtgctgggattacaggcgtgagccaccgcgcccggcagacattcatttttattacaatttacaaaggtattggtcagaaacagaatgaaaatggaaggaaatcctagtctttccccaggtcatgggagaatccttgctttaagtgtctcatggggtggggtgatgtattcgtccctcagggctgctgtcacaatacaaacgaggggcttcaaacaacatcagtgtgttctctcattgttctggaggccagaagtccaagagcaaggcatcaccagggccgtgccctctctgaaggctctagaaggctgtagggcagaatccttcctggtctcttccagcgtccagggctgctggcagtcctcgatgtgctgtggtttgtggctacatcatgctcgtgtctgcctctgccttcctgtggtgtgtgcagctttgcatctgaatctccctctccttttttctttctttctttctttcttttctttctttctttctttcttcttttttttttttttttttttggagacagggtctcgctctgtcatcccggctaaagtgcagtggcgtgatctcggctcactgcaacttccaccttccaggctcaagtaatcctcctacctcagcctcccgagtagctgggaccacaggcatccaggctggagtgcagtggcatgatctcagcttactgcaaacctccaccttccagggtcaagtaatcgtcctacctcagcctcccaagtagctgggatcacagacgcgtgccattgcgcccacctaatattttgtatttttggtagagactgggtttcgctatgttgccttggctggtcttgaactcctgagctcaagcgatcctcctgcctcagccttccaaagtgctgggattacaggtgtgagccatcgcacccatggcctttttttttttcttataaagatagtcatcattggatttagggcccactgtaattctaattggagtttatctgcaaagattctgtttctaagttcatttgtattcacaggcaccagaatgtcctagtccattttgtgctgctataacaaaatacctgagactcggtaaaatacctgagtaatttataatgaacagcagtttactggcttgcagttctggaggctggcaagtccaaggtcaaggtgctagcattaagggccttcttgcctggtcatcccatggcagaaggtgagagtgtgagagaggatgagagggtgccaaactctcccttttacaatgacccagtcctccctatgtggctgagtcctcatggcctaatcacattattcctaaagttcctacctctttgcctgcctgtagtcccagctacatgggaggctgaggtgggagtatcacttgtccccaggaggtagaggctgcagtgagttgtgatcattccgcagcactccagcctgggcgacggagtgagaacctgtctcaaaaacagaaaaacaaacaaaaaatcccacatcttaataactgttacaatgtcaatgtcgattaaatttcaacttgaattttggaggggacagatatttaaatgatattacacaggttaggtcttgaaatttttttggcagggtcacaattccatgcactgcatatgggagtggaaggggtatgcctgcgggtggggagccaggggcttgagctccactctgcattcactttttgctctaccccaaagccttcccttcccctgtcctgctccctctacctgtgagtgtctgtgtaccctggccatcctcgatggcagtgagtctgagtattggtagggtgggctagagcctgggacagcgaggcagctggagggtggttgagggtggacgggtgcacgctggacaggcagaatattctgcgccattttgcctcgttcctgcatctttcttcctctgctgtcctgcacacacttatcttctacccacttctgttcccgaagggctccattttgtcagattattcagaccatgaataaaacacaagtgtgatgtgcttcattccccactcactgtttgcaaaactattttcctgcagttcagacccttaagatactgtggaactggaccgttttcctgtctgtcgacttctgaattttaagtgtttttcagaaagtctccatcatttggaagtcacgctttgcctcctggaagctgtctagacaggtgaccagttttcaccaatttgggggctatggaggcctcttccaaggctctctgccctctccatgagccactttagctagatgactgtgctggtatcaagtgaaaaaacaaaaagaatacttcagtaatttaattcaaatttgttcttgcctagattacggtaatgctcctatttagaatgacttaattcctggcaagtggattgtgggaggttaaggagagcaccctggctccagagcagagagcagaagagggtgttcttgctgtctgtgctgaggttggctaagtctttctctttttcacgcctcgtgctttttgctacgtggtttctgctgcctagctagtcatctgcaaggcatcactgtagccctatcctgatgccctgagtcctggtagcttctactctgacccttcctgttcttttatagattattccatccttgaccacattttcttctgttctcctgtgtgcctagctttggggaaataaggatgagtcaggtgcaggcttcggttgctcatttgaacagtgattctgactactgttagagaagggatatgggagagaagtgcaggggatttacttagccaaggctgaaggcagagaaaacggtcattgctgcatggcacagctacctgtggccagagaggagccatggcccagctcttgctgggctgacccaaaggccgaggaattttgtgtgccaggcacccatctgtgacacaaccacgtgggccaggaagctgtgtgtgtgtgtgtgtgtgtgtgtgtgtgagcaattaatggacaggatccagagatgctgagagcagtcctgcacagtgaagacagtatcaatatccctctccctgagaaacccaggagacccgttcctcatcatcgatatgcttcaaggaaggcataacaaattgatttgtgtaggaacttgaactggattcactgaagaatctcaggaagtttgtacttttttcagtttgggctttgtgatacagaaacacgcagatacttgtgggaacaacgtccctcaggcgttaaattgacatttgggattgagtgaaccgaagcattggtggtagagatggggaatgctatctgaaaaaccagaatcagctttaaggaagctgattacaaagagaattgattacaaaaagtatttttggatttaaaatacataagatgtaggcagtcctaatttaataagatataagggattgaagcaattgttgccatcgtctttctttttgttctggactgctgtcacacacaccatagagatgcctccttgagtgtcttcaaagtgctgtggatttcctttcttcagccgcctccgaccatcacgtccagccatctgtcctgtttgatcaagtccgcagagtgggtcgaggggcaccaattggcagaactggtcttggtgcattttcccctatcaagtttatctgtttttccggaggctgtttggctcttccccaaatcttccaaagacagaacacttaagtctaaaaggaggatttgtggaccatatatattttagctcaaaacctccaagtggaatcattttaatgtgcgttttcttgagaaatatgtaaattaataattgcttcatacattattcaagaaaaacttattttgtatcacccataactcttctaatcttatataaagatatgctaatggatttaattaaaataattatactgaataatgtagcctgaactttattctaaaatagcatctattaatcatcatcatcagtaatatttttagccagagagacacttacaaccttaagctgatactagatggaaagtgcatttattgttttatttttcagtttggattaagttggcattctcatgagatctgggacaattacatttgcttagagacgagtataaaatttatttctgggccgggcatggtggctcacccctgtaatctcagcactttgggaggccaagacaggtggatcacgaggtcaggagttcaacaccagcctggccaacatggtgaaaccccgtctctactaaaaatacaaaaattagctgggcatggtggcacacacctgtaattctagctactcaggaggctgagacaggagaattgcttgaacctgggaggtggaggttgcagtgagccaagattacaccattacactccagcctgggcaacagagtgagactctatctcagaaaggagaaaaaaaaaattattttatttctttaacctgaagtatttcagcaattagaaaacttttagcctcttctgccctttcctgtttcttcttttccctctaaagctttggtttcagtgtgttcttgtccttttggttcagttttgacctcagtttccctcccaagagttgtgattgctgaatacgatgagttcctgattgcctggatattaagaggtgaaccaaatcttaagagggacactcagcagcctgcctgtcttaatataaatagaaatagttttaccactggctgtgattctctctgattttgtttgtgttatctttctgtggcttgctggctttccatcagtgctcaatgaatggttgggagcccttatgcatttggtggtaatttcagtttctccttaggcctctctcatgcctgagtgtgcatgggacccaggtatgtgttcttggtgtgtcagtgggtcctgcacacgtgttgattggtccgaggactaaatgcaggtagaatcagaccgtccccccactggtggacagacgaaagctttaccaagttgatagaataacataagccaggacttaaactgccattaagttattttacctaagtttaaaataaaatctgaagaaattacttgcttaaatagcaaacatttatttggtaagttcacttataacttaatgaacaggcgaagagtaaagaaagctaaaatcagtgacttcctctaaattgtgtatagagtactcttctctgttcttggctgggccaggccataatggtgtattcgtacagtttcatggtccatggttcatacctctggggttggggagcataagtgggcctcactccaaacgcagctctgtcttttggggacatcccacggactttgtcctccttcccactttcgtccctcacccccagtgaactgattagtgattatcccgctctgctgcagggaaccttgccagtgcctgggaggcaccgtggagcagatacctgctgagggactggcatcctggcctctcacccacaattcaaaacagctttgcacattctgagcacagttttatttaaataaagatcttcactgatttacaaaaataacaaaaggcaaacaaaaacaggaaaaatcttcaatgtcctcaatttctatcaccctgatcttttttgtgatttgggaactgattctactcagtatttgccacaatgaagatggcactttacaaatggaagtttgcaccgaatgaagattcaggtttgagagatgtgcacgctgaggaggttttccatgtcaacacgtgcatgggtccacacgctgtcctgccgccactgctgctggtagctgtggccaacgtctgttgagcaggagcaatgagtcgagcttatcacatgcacaacacgtcattccattctcccacagccccttgaggcaggccctgttgatcaccactgttttgcccatgagaagcccgataggaaatgctaccttcccaaattcacatagcgagtgatggaggagcccggacagcaccccagagccctgaccttgtctaccatggtgctgccttcctttgatggtgctggttagggtcccccacatgcattcatagatttttatttttggaggtgtctttcggcagataagattccacgcagcaccatctatccacagggcagatgtcccctgcttcgtctgttgggtgctctgtgtcttgacaagctattgaggcaggagctgtttccactcgaaagagacctgaatttagtgaagcagccagactccacagaggaaactgaaggtttttcctgcaagcacaagcagaatccaaaacacttgaaactctgacaaataaccaatattagaaatgaatcaagctaggtgtggctcttacaatagtgggtaatggaaccctcctgccaaggaaagccagagcctgtggtaggaaggaatctgagttccctttgcatcttgtccttgtctggctaatcaaactggatggggaagacaactttttcccttagttaaggaggtgatttctgtggctgaatgcagagagaggaatgcttcttgaaaataaagaggtcacgactatatatgaagtttgcagtcagtttgggagtcatggagggtcgacttcccaatgtcctctgtgaggacagaaggagacaaagcagactgaaatagtctctgtccttacctgtgaggagcttattgtctatggggaatacggacaaattgaccttccattgcagtccaaataggaatgtctctagatgctgtattcatctcttttgcgttgctataaaggatacccaagcctgggtaacttatagagaaaagaggtttattttggccccggttctgcagggtgcacaggaagcatagtgcagtcatctgcttctggtgagggcttccagaagcttctgctcatgacagaaggtgaagggggagcaggcgtgtcacatggcaagagagggaacaagagagagcgcagggaggtgccattgtcttaaaccgccagctctcacgtgaactaatagagcgggaactcactggttactgcgaggaaggtatcaagccattcatctgaaaccctcccctatgacccagacacctcccactgtccccacctccaacactggggatcacgtttcagcatgagagatggagaggacacacatccaaaccatatctgattcctaacctggcacctgtgtgtcctggacgaaatgatgtctaagctaaggactgaggggtaccagagtctaactgtgtgtttggggtggacttgggtggggcggcagagcagtgactccagaagagggaatagcatgtgctcaagcctctgagctggcagaggggcctggcccacctgggaaactggaagaggctcggcttggtgggagagagtcctgcaggtaccaagggtgagtctggggtggtggggccagagcccatggccctccatgggtgtgggataggttccctgtgtcccatgagcaggggacgttgccacagtatctaaattccatttgcattttcagaaggctgctctggctgcccagtgaggagtgtccttgaggggtcagcgtggaggcagggagggcgggtaggaggctgtggcagcaaagccaatgggaggcagtagccgtgcggcccaggtgctgtttgttccggggggagttaacagcctgaaccgagggctctgtcgctgcctagaagggggctgtgaggaagagagaacacccggtgtgatgcccaggcctgtggcatgcagctggggcttggcggtgcagcgcctggcactggaatccctagggaaggcgaggcagcggtggcttccaccaaggcagggggagtttgcaatgtctagggtcagccagggtggaccccggtgggtgtggggtgtgggtgttgggctcaggaggaaggggagccctggagatggatcagaattgggagtcattggcatggcaggaggtgaggtcccttgtgggatatgtggagggaccccgaggaacccacaggcaaggggctgggggagcagggccctgcgcagggagctggaaggagggtggagaggcaggtggccaccctgggagtgagggccacgcgtgccccagaggtgaggtggccaaagtgtcatcagaaaggccacttgagaacagcctgaagtcatcgtggccttggcaggaacagagctgtggtgcgggccggagtcaggctgcagtgggagtgaggaggggtcgtgtgggaagtggacgcaggccttgcccacactgtggggtattgtccgatggagcagaggctcgcagggcctggggctgcttttccgggtgagaggctggtgtgggcttcatgatagaaagcaggaggcagaggggtgagaactgaaggctctgaggagagagagaggacaaagggcaggagggccttgagcagacagcaggggaagaggttggagccccacagggcaggcaggtgccccgaaaacccaaggcaggggcagaggttgggagctggagtcttgtgtttggtttgggtggttggaagcttagcgagttcctttcttgtgggggcttttgtttttctctgaaggaggtggtgacatgagatgggaggggtgggggtcaggcttgagaagagcaaagaaagactgagtcagccacaggggagagtggagaaggagaggaaacccggcccttcaggagaacaggtggacccacagtgtaagacgtgcctctcctcatgtttcttctgaattccgttctctctgtcctgtctttgttctgtcacccaggactgatagcagatgcgggttcctcccagttcttgctaaacctcatttaccgaaagacacaaaatcatcttggtcggttaagcagaattctggtttaatcagcattttgggatcactggcattccatgtccccgcctcagggggcacaaccccttctctgagggtgtcatcatgacatttttgatgctaggagctcgggaagaccacggcagggaagactttgggagccctcgccccgcttggcggtctgtcggtcccgattcacacagtgtccggcagcccaaggggagccagcagcaggtgggccataaaggcctgtcttgtttgtggccgattcaccctggtgaaatggtatttatgaacttgctacaggcggttgatgctttgctgggcacagtataaaatgcatgaagccagttcgtgcctcaccctctgggcgttcgcaagcgaaacgagagaccgggagactgagcaatcagcctgtgtgaacgctggctattaaatgtcacaataaatgttttctgttttttttcaaagcaacactgaggttgtggaagcagaacatttgaaatcagaatgaaattattacgatttagtgctcttttgaaaagttgcatcccaaagcagacggttgggatctggtgggccttgaaggacagggcaaacactgaggtgaacaacagcatggatcgttctggagtggagatttatggggctaaagttgctttatcctctactctatttttggtgaagttgaagtgtggcggttttgcaaaattagctttggggctgcacagaccaaccccaaatcccagcagtgctgacctgggccaaagacttcactttcacatgtctccactgtctcctccgtgaaaggggatagtaataggcctccttcatcaggttgccatggggatgtaatgtgtccatagagcccagcacctagaaacttgtctgacaggtgcagaatacttacgtcatagatgaggcaacatgaactcacttgaaatgacttgacctgtgcaccagagttgagacaccagcctgccattctttcagtcatttcccatcccagatagctatggaaatattcccaggtaatatattcttagtcacttaaaaaattaaggtataggctggacacagtggctcacacctgtaatcccagcactttgggaggccgaggtgggtggatcacttgaggtcaggagtttggtttgggtgttgaccagcctggccaacatggcgaaacctcgtctctactaaaaatacaaaaattagccgggtgtggtggcgggcacctgtactcccagctattcaggagactgaggcagaagaatcacgtgaacccggggggtggaagttgtagtgagccaagattgtgccactgcactccagcccaggcggaagagtgaaactcagtctcaaaaaaaaaggtacaatttacatacagtaaaatttattcttttttaatgtacagctctgccagttttgacaaaggcataatgcattcatcccacgggagggcccctgagccccctgtattcccctgcccgcttccccaccagccactgacatgctctccatttctgtagttttgccttttccagaatgttatgaaaattgagtcacatgggatgcagcctcttgcatatgtcttgttttatttatcactgtgtcgttcacgtgcatctgtgttctaggtaacagtggttggtgcttcttgttactgcgtcgagttccattgtatgaattcccctcttgaagggacatttgggttgtttctagtgtttggagattacaaataaagctgctagagacgtccacataagggttttgtaaccgtcataggtttcctgtcccatgtacgtgccaagtcaatgtgctgcgactctgggttgcagcagagaaagagttttaatcgtaggaccgccaaaacaggagaaggaggaaacctcatattgtctgctgcaggagtttggggctaggtattgttaaggttttcggagcaggcctaagtgggttgaagagcgtggggtgaagggacagggagatgaagaaactgcattgcattgctgattcctttcctctgtcgggggttttcaaaccagttggcagcagcagtttccctggaattcaggatctgagaaacaccttaagcaattcttaaacaaaagacttatgattctaatgtcagaaatcctatctgcaggaacgttggggatgcagatgaccagtatctagtgctgcgtgactttggattacgagtaagtgggctgaagtgcagcctgttccgtgcttaattatcactgtattgctgtccagagttcttgttaaccttatgaggatgccttcagtttttgtgaatgtaggttttcacttcatttgaggaggtggccaggagtacaatggctgggtgctacggattatgaatgtttacctatgagaaactgctgaactctcttctaaagttgctgaactatttttgcattcagactagcagtgttatacaaagagcatgttgtaggaattctgttttgttttcatgattcttatagatgttgcttgtatcttattgtcattttaatttgcatttccctgatgagtaatggtgctgagtgtcttttcaagtacttatttgccatccatctatcttctatggagaattgcctcttcatctcttttgcccattttgcagggaggggaagattgttttctcattattgagttttaagggttctttgtgtattctgtgtactaatctttagcagatatatgatctccagtcattttctccctgtgtagttcatcttctgttatctcagtagtacctttcaaagagcagaaattctttattttgatgaagtccaatttatcaattttttcttttacacattgtgctatttgtatcatatctaagaaatctttgcttagcccaaactcacacgtattttcttccaaaagttttacagtttttgaagttctacatttaagatcggtgatctatttaaagttgagttttgtacagtgtgagagaggagggcatgaagtttatttatttgctcatggtactgtgtacctttgttacaaatccatcaaccgtctgtatatgttcaggggaatacttttgaagtgagtttctgcctacttgcttttggagaacaattgtaaaaattgtttctgtaattgcgtagtattttccagtgttcaaagtgttaccctattcattttccaatttgattttgagctttattgcaattccttgaagtatctggcgtgaatgttattttccctcttacttaaagacacaggtagaaggtggcagagccagagtcagatcacttaaaatctggcaacttttcccaacagaagagagcaaagggactcagggtctgactttcccccgactgaatttaattctagcttagttcagtactagctttgtgaacagggacaaagtaattaatgtctccattgttggttttttcctccttcctactcagctaccttctaataggaggtgatatggtttggctgtgtccccacccaaatctcatcttgaattgtagctctgataatccccatgtgctgtgggaggggacctgtgggaggtaattgaatcatgagcagcaggtttttcctgtgccgttctcatgatggtgaataagcctcctgagatctgatggttttataaggcgcaattcccttgcacaaactttgttgcctgctgccatgtaagatgtgcttttgctcctccttcaccttccaccatgattatgaggccttcccagccatgtggaactgtgagcccattaaacctctttcctttataaattacccagtctcaggtatttcttcatagtaggatgaaaatggactaatacaggaggtctgtaagaattaaagatcaaatatacaagggtcctagcacagtgtgcagcatgacaggatctatcattaatatcattactctgttttttgagggtgtttgttttctagaagatacattactaaagaacaaaatgattcataattaaaatatatgcagatatacaggaaaacatttttggaatggaacaaagacagttgactttaatcattgaatgtagaagagttgaagtgaatttaatggaagaggattattctgagggggacaggtcttcattttgctttatcctcacagagctctgcaggggtaaaaggagaaaatcacatgcatgcttagcacacagtataggcacttaggccacaggtgataagtgttggcttctgttaataataattttattatgtgtcaggacaacctgtgagaagttagcattgtttgagcattctttgtaggttagagattcattttcttttttgagacaggatcttgctttgttgccggggctggattgccatgctgtgaacacggctcactgcaacctctacttcctgggctcaggtgattctcctgcctcagcctcctgaatagctgggactacaggtgcaagccaccaatgcctggctaattttttttgtatatttttgtaaaggtggaatttcgccatgttacccaggctggtctcgaactcctgagctgaagcgatctgcctgcctcagcctcccaaagtgctgggattacaggtgtgagccactgcgcctgatgacttttgttctttgctctattttcatcgtgttagccgtcagcccctcatctggaagtgatctttctcttctcagtatttctgcggttcttctcataaggattacaaattggtatgaacactccctaacctgcatgctgctcagccttcttgtttcttgatttgcagggggcagcactgaaatacttaccaacgatcgtcaacgatgtgaaattggtgtttgatcccaaagagctcaggtaagtatgcagcccaggcgaatgcttgtcacgtgccgtgtgtgacctccttctcagtgtgcttagtttatgggatgctcagggttctgcctcatgtctccatatgtcagtgccctggatcattctggaacatgtgttgctggtggtgtctgtgactctttgataatcatgacattatgtggaaaaggtatcaccagtcaactatgacaacattttttaagaagattgtttacagtctaattggtatataatgtccatttggcattttgcatactttgaggtttgaatttcagtatgtggttgttggttttgctcttgttttcagcacctaaaaatcctgacataggagctttaatattcctgcgccggcttctgcttctgtaatagaggcaactcctctttgggaggggccctgagcctcaagcagaagactcagaagttactaagaaaataatttttagaaaaccccacaaacaaactttgagaaagctggtcactgggctttcagaccaaggagtgagattggacaccaaatccttccttttctctccctaacttgccgcctctcagtggccaggtgtgctgtttgtttcctaatctgttggtatcactgcattctgaaagtgccattgtgagcaaatgggatacacagcctttttaatttattttttaagagataggggtctcactctgttgcccaggctgtagtgcagtggcgcgatcatagctcactgcagcttcaaactcctggcctcaagcacccctcccgcctctgccttcaaagcactggaattaccgacgtgcgccaccgctcccaccccagggatgcacagtcgtttaaaccccagacattcaatagcacagtcctcaactactttttgttttggttttgatttgacacaataaactacctgtgggtgaagacaccattttttaccggccaatgaagccctcctaaatattagtaaagggccatctgtccactgagcggtgaaacggaataaaaaatgattatccttcctgtactttatgtctaccataggtcactcgtgccctggaattgaagggcgaggggctctctgggaggcgctgtcccccacgaatcattgtgaatctgatgttccctaggatttagtgtcctgcagggaaacatttattttctgctcccagggcaccaacagtgctggtcataagcttagcaggtcctacatgagaaaaggagaaacacacaggctcacgggcggtgtctgcccacctggcgcgctgtagagtcctctccttggcacatgcttctccaagagcgggccccaaaatggcagctccggtagcccttgggaacttgttagagaaagccaaactttggcttcctccccagaccttctgaattagaaactgcacagtggggcctggtcatttgattttaacaacctccctccccgtgcaggtgcttccagggctctctcatattttagtagctcaggtcttgaaaaactgagaggaagcagagaaagctgcaactggtgtgggctgtggccatactctaggcctgtctcatggtgcacacagatcagctccgcacccgcggaggggtatcgtcgatactctcagtttgcgcttgagccgggcctgtcctcactgtacgcacaaattagcccctcaccgatggagggtatcattgacgctcacagtttgtggttgagccgtgtgcttggaggtcctaggaagacctgcttggccagggccgatgcaggctgctgctggcctctctcagatttgtgcatccctgtgttcctcctcaatgcctgttacactgatttttaaaaatgacattgaaaatcacatacatatttgtttctatttagaaaattggttcatgttttaataaacagaagagatgacagaagagggtaactcaaacttaagtccactacccaaaagaatcagaaagtgctggatcccttacacacatacgtacacacacacttaaaaaagtcaccattttttggttaggcatggtgactcacgcctgtaatcccagcactttgggaggccgagggggacagatcatgaggtcaggaattcgagaccaacctggccagcatggtgaaactccatctccactaaagatacaaaaaattagctgggcatgatggcgggtgcctgtaatcccagctactcaggaggctgaggcaggagaattgtttgaacccagaggcagaaattgcagtgagcctggatcgcggcattgtactccagcctgggtgacagggcaagactctgtctcaaaaataaaaaaaagaaaagtcaccattctttgtgatcagctcctgcacttaagacatcttcctctcccatgccacgagggcatcttctgcatcatcattgttagtaactttcatgccgatccatcccatgctggcctatctttaagcagcaacaatagacgcagcatctattatgtgctttcaccatgtaaaataggttttgcacaaagcacttgtattagtccattaatctttacaacaatggtatgacataggttctattgttagccgaattttatcctcaataacttgtccatgataattcagctggtaaatggcagtggttcaaggccaacccgggctttttgaatacaaagaacaggcctctagctactgtgctacctgatggctgttgagttgtattcaagtttttttaaaaaaaatatattataaaatgctaggataaaatttcctgtagcttaattgtagtttctgctcctattttatatcattaggataaaaagagaaatggcattacttggttttgcattttcttaaaggattttcagtagattttatctactcgtccccctccagaaggtaaaaccaacattctaccagtatacgttggtgtctgttttcccaaaatattgctggtactgggaattaccattttatagaaccttgccagtatgactggtgaaaccgtatctgcccattttaatttgtgtttatgtagttactaacaagagctcttctaaaatttcttcataggtctgttagccttttgtaaaagtgtatttttaaaaaattgctttattgtggtattatttacaaacgataaagtcacctattgtagacggttcaattcagtggtttttagtatatttacgaagatgtgcagtgatcaccagagtccaattttagaacatttttataaccccagcaagatcccagtgtccatttctggtcatttttccttcctagcccaggtaaccccgaatctcttttctctctctacacatttgtgttttctgggcattttacagagctggaatcatacaacgtgtggcctctgtactggcttcttctacttagcataaagttttcaaggtttctccatgttttagcatcagtgcctccttgtttttggaaatgaattgtgtggctatactgcattttgttcatccattcattaactgatggacttcgtgttttttttactttttcagtataatgaacaatgccacttggattcatggacaaattgttgtgtggatatatgttttcattttttctcggggaggtggtatatgcctggaagtggatggtgactatgtttgacattttgaggaaatgcctaactgttttccaaagtggctgtgctgtgttaccttcccaccagcttggtgtgactgttctcatttcattatatctttaccaacacttgttattgtctgtcttttggattataggcacgttagtgattgtgaagtgaaaacgaacactttcaaaacatcatttcttggaatgagttattgaccccatagtgcatgagaggctgtgttgaacatactggtgacattaatgaccatgtgatgacctatatctcagtattgtaacaacattggatccttttgctatgtgtctcaaaattatttcccttgtgtttttcctcacagcaaaatgtttactgaattcatcctcaatgttcccatgggcttgctgaccatccagaaactctactgcttgatcgaaatcgtccacagtgacctcttcacacagcatggtgagtggaaccccaagaattattcacttgtcctgttatttattttctgaagacattgaccctctgaattgcctcttcttgacaaaaggagtagaggctgcaaccaattaaaactgctgtattacaagacaggaagatttagcccttacaagagaagggtaattgacatgtaatgcaggtaatagatcattgagaaatgaaggcaaaagctcgtagtttgtaatttaggtatacaccaaagtcctagggtaatcagcatacattgtagcctttaagatatgtggttgtctgtcctggggaggcaatcacttcgctccattgtgatgattgcaaggaaaagaattcgagttttctttaaatctgaaagtaatggttttatcttattctgaactttgcattctttgacagcatttcttcaaatcctactcaaagtaataagaatttcaatgattcttcaactcatttatcctgcagaacactttatatttccctatgttatctccctgccctttttagtaatcattttttttctatttggacagattaaattaatattttacccttgtcaagcagttttattgaaagcttaaaacctctgcataattccacaaacttcctcatttattggaggcaaatgtgaagtctgttgagtgacattctgactgagaagcatggatttattcgattccatttgtgcctggacatttggctgctccattcattttctgttgtcctcattcttggtgttgttctcagttcccctgtgctttcacggatcccagacttgggatgtccctgttaagttacgggctgggtttggaacacactctgtgcttggcttggtcctttgtgccttctgggatgcgaattttaatcttctttcttggcttaaccttataaaatgcaccagagtgtacacgtgttgctaaggctaatattgaaagaaaatgttgacttcatttaggtgagagtgttcttctctagaaaaaaacacatcaaaccaagaagtgggtgactttctgcagcccctccatgtagacctctctctttagtcagaaaccacttcttactttcataaaagaaagtcagttctcaccatggtctgggactcaaagcacatgacgctccattgagctattattcctgactgtccatatttcagtttctcactggaaactgaattgcccactcaccaggtgttttccaagacttgggtactctagggggcttaaggaaaggctgatgatagaggtgatggccaggcaccctgcttcagggtttcctcctacagtgaataagctttgtaccacagcaagtaaaatcctccgaaaattttatatctgggtcttattaggtgggttactgatgctcctaaccattcaatgccaagacacacacagcgacatactgcatcaccagcactaccgtcatcagtatcttcatcaaattaacagctgtcaatgagtgtcaaccgtccatgaataacaattgttgtaaattgtcgatgaattgtgcttgatttttcttaagtgttgatttaacgaagatcttcttcaggatatatttacatatatttttaaatttctgttgcaaaactttgttctgtatgtcatttagtttctttgaataaggatgtaagccatgaaagattcaattagatttttttttttttttcgagacatagtcctgcgctgttgccgaggctggagtgcaatggcacaatctcagctccctgcaacctccgcctcccgggttcaaatgattctcctgcctcagcctcctgagtagctgggattataggcacccaccaccatgcctagctaatttctgtatttttagtagagatggggtttcaccatgttggtcaggctggtctcaaactaccgacctcaaatgatccacccgcctcggcctcccagagtgctgggattacaggcgtgagccaccgagcctgaccccagatattttttcctctattaaaacttgctcatttctttaggtcgtagaaagcttgaaggaaacttactgtttatattcgacgattttgttagcttaggtgtttgtaattgtgttctgtccctctttcctatgccccatttctgtttcattcttgttctctaagccttttatcttagacagcctgaagtcctgttttggaagtatgcaggatgtgaataactgcttagctttgtttaatatggaattaccaggtcatgtaatattttgaaataattaacctgctgtcatctttttaagtacggaattaggattttgatcttagtataagcaagttgtacccaatgtagtaaatgaggttgtatgaaatatatgaatcccaaattattgtgggctaaatgaaccaaaattagcccgaagcttcgtgtcttacaagcagccccagaattgccccatcagtagaagttgtctaagctgtaactggcagctcaaatgtacttctaaatgcttagtggttgcctagaagcatttcggaatgctttggccaacgtgaaaatggtcccatttactgtctttgagttttaagcgtttttcttaaaacaacctgtttttctcatctgcaagctctctgcttgttcaaagcagccaacagacatcttacctcctggtcaggagagatttatcaccagaaatcttccagttggtccattcttacaaaagatgtcattacttttgcaaaatattctgtgccacctttggtataacaatttaaagccaaactgttttctgatgagacatgttgaatctgattttcatgcttttttcctgtttcttgttaatttgtacaaatgtggttgtttttgtcctgtttcctgatcccagtggaatcagtcaaatgaactctctttgtgttcagatttctagaacttggtataactggatttagctgcatgtgccactgaatgcacttgcccttagtaaacatcctctggaggatgtgttcagaatgtgtcactgtatgtgtcctccaggctccttcgtgggggctccctgggtgaagtgagattcccaagtctttgcttctcagcttgtgtgttgccttactcactgaaagagacccactggttgctttgcactaaaacatttctttttatctccgcctgatataatgacaagtggatctgtttgcaagaggctggcagtgaattctgaaactggtgttgttcctctgcagaaaagcctttcgttgccaggtctgggtcccagtaggccaggccttacagtgccttggttgtttctggccttgttttccccatttctctctcttggagaacatggaaaccgtaggtgcatcctgagtttgttgggcttcataggaggcacgtctttgggcttgtcaaagcaagacaactctgtgtggtccagtccatgtgggactggcctgaatgaggacaccaggcctgcgtcactgcggccatttgctcacagagcattcagccttcctctgcccttctgttctatccaggccctcaaggattagatgatggccacccacactctgcaggatggacatgcttgactcagtcccccaatcccaatgctaatctctgctggaaacatccttacagacacactcagaaataatgttcagccagctctctgggcatccgtggtgcagtcatttggcatttaaaattaaccatcacagagtatttcttccaagaggcctgtgattgccctgcttaaaaagccccctacatgccacctcatggctcctcatggcacgccccccatgtggaatcattgtatttcttacttgcttatttgtaggccttccataggatgagaactttccaagctgggccttgttcatctagattttgctcttctgctggtacctagcgcatgcctggcttcagcatgcctgtaatggatatttattgaatgaatgaaatgcttatgggtattcctaaccaggaggcagtacagagaaagaagcaggaccagctacacacatgtgtagttgacttgattgaagggaggtaaaggtttggattcacatggggaaattggcaatctttccttgtcttagcattgaatgaattgatcataggggagaaaggagaggtcttagaggaggagtaacatcaggagcaaagggagagggagaagagtgagagacttgaggtgtgaagagtcttctctgagcagttttataaaatcaagatgctcttctatttgcatctgatctaatcattcctgttttctggaaataggaggggggtgcagttcagatctgtgcattcaagataccttttggctataccttttggctaaaactatggaaaatttcaaatatacaggagggcagagagaagagagtaatgcatgccagtgtactcatcactcagctccacaaattatcaactcatgatccttttttttctttcttttttttttttttttgagatggagtcttgctttgttgtcaggctggagtgcagtggcacgaacttggctcactgcaacctgtgcctcccgggttcaatcgattctcctgcctcagcctcctgagtagctggtactacaggcgcatgccactacactcagctaatttttgtattttcagtagagacgcggtttcaccgtgttggctgggatggtcttgatctcttgacctcgtgatccaccctcctcagcctcccatagtgctggggttacaggcatgagccaccacgcccggccagtccatcttttcttatctatatgcccgtcccccagatattttgaggcaaatctctgccatcacagcattccattttttgtcattttaaatgtatggtggtaatacagagggcaaacagtgttcctaagaagaggttgtgcagaggagctgatccccatgctgataaggcatccaccttggatgttcccacccctggccctttgctgaggtagagggcctgtgatgcattagcatactgtgtgtgagtcagtgaatgggcagtgtgtgtgagagtcaataggctgtgatggctttaagctttgtctcgccatgtgacttgactacttgaaagctggttgatagattacatgcttcaccaaaagatgactcttgcatataatctgtggtgtggagtgagcagattttcaaagcaagatagatacaaagagaaggaaaagtcaaagcttcatcatttgtgcatttgtagctttgtttccatgtgattatattgttgcccacatagctgacaaaagctgtgaaaattaaagcttaaatcttatagaaatgaaaagttttagtgtaattaaacactagaacactgacgtttaggatttaagctcacaaaattgtgtaacattaatgttatagaaattggaataaaatgaatcaagctgagctaacattgacttttaagttagtaaagagcattggctatacttgtaagaagcctttgagtggaggtgagagtcctcctggaacatgttctctcacccactggcccctttctgaatctgacagctttgggaagcttgtttcaatgaacactgggtcacttatttgctttgcaaggtataatttttccatattcccatttctatagtggccaaagcagtggacaggttttctttggagcttactgtgtacttatcattttgtcctcacttagtttgttttggatgggagtatgagactttgagagtaaattttagtggtaaggctacccctttttggtcttgcaaatagttggatactctagatagattgcttttctgtaagcctgctctgtgtagttttctgtttgtctgtttgttgtttttctggtggttggactctggcagtgagtaggaatgggaaagaggccattccctcataccctggctctcctggggctcctcccttcactatagcaaacaggctccttgtagacagtgttcatgagtcttttcaaacttcatttgctttcatttttgagcttcttgaaagtgtaagcctgttaagtttaaattattttccttattcttattttcaaggtgaatgattcttctagttatcaagcagagtaaaactctcctttttaatggtggaaacattagttacagcagccctttgaaatctgagggcaaaatcccagacacttactgggactagctattaggaaatattgaagtcagatttctacactattatcattgtgatttgatccatgatagaaatttatatctcaaaaattaccctattaataaacttattatgccttaaattatagaaaagttgcgtgtttaaaacaaacccataatataccttcttaatgttttgataaaagcatttttgattaaaaaaaccaaaataaaatctcttgagctttactattgtggaaaatagaaatatatcgaaagggatcttaaacctggagctactctgcagtagttttgttaacttgatagatgttgtgcagaaggaaaaattggggttggggtcaattttgccacattcacttaatgtaccactcatatagcattctgcagtactttaattagatagttgtgctgatgacttctgatgaacggtaccagctgtgaaccctgaagactgattcttttaaataatggtggaatgtaaacatcattttctcttctgtttctttcatgccttgagaaaactttttatctgtaatactgcacctttttcatccctcattctgtatatcattctctgtctttcattatatatgtttttgaaaagaccatttgttataacactgcaggattttagaaatgacttattgaatgtaggagggtgaactcaatttcaggtttttaattgtttctgtttcaattccatcataattcattgaatatcttccgtgtgctcaggaccattgattagcgagtttgcttcctttgagagtcttcagagtcatctacttaaaaatgtagaattggaaaagagtgattatctcaatgctcagataaggacaccagagttcagccagaagcctggcagggagctgtccaccgccgtggtgctgattgaggaggtggcttcttacaaatctatcagcccactcttttcttaaactgtttcacacccaccatatgagtaatgcattctgaaaactgaatttacttcaaatgccatatggagcaagacaaaatacaaataagtgaataaataaacatacaaataaattaaatgtataaagtatacagtgttgtgcttatatgttcatggagttttaatagtttttctcttctttctgtgtgggacctttatctgtgatcaaattggtggtgccaacagtttatggtatagttggtgtaaactttatcatcgtctgttgagttctgctgtcacttctgggtgggcttctgttcctgttgctggatgttgaatgcaagaagaacgatctgagaagagactgtgttggttgtgctgtatttagtcatgtgcacactgggcaccaggaaagcaagtccctgagtctctttagtacatgatttcttctagctcctggtagctgatttctgtaactgcatgatgtgttgtctacagtaactagcctgggacagtggaaagagccccaggtcagcatgcagtctcctaggttctgctttaggacctctgtcttttcttgggcataaactcctccctgggtgcacagtccttccgctaagatgaactgcaacacaatatagggttttgacatatgtattttattgtcagagcaaccaggaggggagtttgtgcaggaccacatgggccaagacctatgtttttttgctacctttattctcctggtttaaaaaatacccaccattccacagccctgtatattctctctcagttttctcatcctccatgtggtgagatcctgcctgcagactgacagccctgtaaattctttctgaacttaacacaagccacatccttgatgtacccccttccacctagaaaacagacttcctgcctgaccaattcttctcacacagtgttttctgcatttttcttgcatcttgccaattttttcatctactgataaatgggactcatttgcaatttttctccattggctcttctttaatttctttcctctgacaacttgttactaacagagtaatggaagtttaatccttagttttccagagtaaaagatacaaaatatctgctcccccactgccttcctttaaaggatggctcgcttttttacaaagccttgtgccgatgtccagaaaacatatatttgacaaacttctttttcctgttgttcaatagtccacgtgctactgtgccccctccttccaatttccaacacccttttacttgctctgtcaccttttcatttcaaattccatgatactgaatacctcaagagtgaagtgcagattaccgcatttctaacaatttcagccctctgcccagtggccctgttccagtcagaacacgtaaaaggtactgtcgggcagcttggaacagaaacactgtacaggccatttgtgtttactccattttacagactaggaaactaaggtgcagaaaggaaaagtgacctaccaagggtaacttgatgttgatttattctctggtactgctaactttcatgacttgttaggttagaatgattcttgaaaaatttgctttgcgtctgttatgtaaaaatgcctgaatcatacagatttacacacacgtgtacctgcatgggtcctttactctgggggctccagctgaggaatcaggctttttttttttttgagacggagtctcgctctgtcacccaggctggagtgcagtggcgcaatctcggcttactgcaagctccgtctcccaggttcacgccattcttctgcctcagcctcctgagtagctgggactacaggcgcctgccaccgtggccgactaattttgtttttgtatttttagtagagatggggtttcactgtgtcagccaggatggtctctatctcctgacctcatggtcctcctgactcagcctcccaagtgctgggattacaggcgtgagccaccgcgcccggccggaatagacatctaataattctgactccgatggtgcgtagaggtgcagtcctgaaggtcccttcactcagctcccagctcccacatctgtgaagtgtggggctaaggagatggctctgcgattccttccagtgtcggcaccgtcttctgtatttctgttgtttgaagacttgaatggagggaggaaagcacgtgaacatgttgaaacctgtgggtccaggattcttagatggttggaaaataagacaattgactatacaagatgaatagcaaacaccccccatgtatatgattcttactgtttaattcttaggaaaagtgttattctggatctcagttctatgtaacacagagttattaaatgcactttatggatcatttatttaatgtgaccaaactaaaaattaagaagtacattactctgttcataaaaatgaatgttttcaatggacaaattcattcttgtatttgcatcttgctttaatgtagagctgtaatggggttatggtcagatattctgcttgggcatttataagctgataatgcttattgaataccttttataaagattaatattttttactctgtcctcattaccagagcattaatcatcctggcttcggcccttgcagctgaggatgaacagatgttgaattattgctgtctgtaatcattgtggatcacactggggaagggccgtgaaagggtggctggtgtgatcttcacagctgatttgcatggagcctggctacctttatagctctgtgcatggcagaggaaaccaggatagctgtgccagctgattctagcttcctcgtaggtcaccgtagcctaagtcagcactgacaagcactggcggtcctggagtcacgtacgtgtgacagggtgtctgataagagagagctgtggccatgactctgcttacaataaatgccagttcataaaaatgagaagtcacatacaaggtctttaacatcggctttctagcattctctgagactgtgctgtccagcagaaatagaatgtgagccgtgtatgtaattaaaaatattctagttgccacattttaaaaaatgaggcaattgatgaaatgaattttagcaatgtattttgtctaaaacatcactgcaacgtgaattctctctaaatattactaatgatacatattttacattctttttatgatatgaagtctctgaagtccagtattttacacttacagcacatctctgtttggatgtgaaattttcaccagacacttgatctttattttcatcattgaatataatttacctttgaaaaatgagattcacataccccaattgttccaaacattggtttctaacaagtaaatcaagtagcactttttacatttgagtttatattaattacaattaaataacattaaaaattcctttcctccatggcactaattagatttcacatgctcagaggtttccatgttgggtatcacagctctgaggtattagttttcttttgtgtccttttagttgaacagctgactttgtataatactataccttctgttaaccaccatttgttgtaggctcatatttgctaaatacacacatcgtatcatttagttctcagtcaacctgggagacgaccaacagcatccccattttgcacattagaaaaattaagacctagagagtttaagtaactcttaaacgctctagatacaaagcaaagagccagcaggggggattgcattatttctttatacgtgtgggtaaactgattaaaaggctttccccaaatcccataaagtgacccaggttcctggacttctggtcaagtgtttgttccagagtattcaaaagatgatgtgtttttctttaaaatataagacccctcctccttttttttttttttctcctggtggattatttgttggcttcccaggccatctgttttggaactaatgggactatcagtgccaaacctgtagaaatgacattttgtccatgggaaaagtattcaggacatttaggtgtgttgtccataggaagataggagattcctcttccttggctgccagagacagctgttcatgctttaaaataggtcattgtagggtatatgtatatgtgtgtgtgtgtgtgtgtgtgtgtgtgtgtgtgtctatctgtccgtctgtctgtccatctgtctgtttttgtagtatacgttcctcagtgctcttgatttgctatcttaagacaaaattcaagagtcttactgttacttaaaacgtgtactcccaccacttcttgaaaaaacctatctgtagacagaaatatagagtaagagaagtcccttaaaaaatgaggttttaagaaatttatgtttttgcttttggggaaggcagctgagtggctactgtactggatagtgcagctgtaaggctttagttttctttgtatatttttagttgaaaaggctgactttgtatactgatatttgtattattgttattaacagctaccatttcttgagggttgagagtggcagacctgcttttaactgcagactttagtttgataccacatgtgcgtaattgcaagttaatccaagacacacacactcataccaccactatcatcaggccttggtttatgtgcttggatatgccatttaagaaaaataggaaggcttctgctcttatggagattgcatatcagcaaggaggaacagataattaaagcaatcagtatttcagtgttccgataacggggcattggaggccttcctgtacctgggtccagtgggggctgtgctgaggccagcagatcacaggtcaccagggaggtgcactccttggctttgctgccttcagcttcggtcctcccaccctctcctagtggctctggggaattgcctttctttgggggcctgggatgggttgctgtggaccaggtgacggacggtactgtaaggtgccatagcccgtgtgaccctctgcctggaggcatggttgaaatccctggcatgggcagactgacctttggcctttagggaaagagcctcgttgccagcctggtcctcctcagtgacctggttctgttttggggtcggggtggagtttcctgatgctgatggtgccgggggagacctctcactgaggcatgttggatggctttttacacagtccttcctcaagcagcatctcattttgtctcgacagttaaagtagacatcgccccacctccccacttgatcttgactggccatggatggctgggtcatgaaggctgaggtgcagttggattctggtctatcaggatggttataacaattttttttttttttttacatcttcttgggggcttagtgaatgaaatgtctgtattgggacaaaatgacagtgacatttctaaaagttttgttgtttctcatcaggagaggctggatagcaaacaggtgaaggtagcgcagtcctccaggtggggtggatggtgaacgttaccaccaggtaaccaaagatggttgatagcatcccccagccaaagatgaacagacagacacctctttcttctcaccagagtaattctaacaaatgagaccagcacactcaattagctctgagaatagcacagaccacaactgcctacccagcatgacagataaatggtgcggtgagggatgaatttaggccaggacatctgggtaccagagcctacagggccagctctgctgtttctgagcccagtgctatgttcctctgattttctggaatcacttatggacacaccctccttccagcctgtactggctggtccgttagaccttttccctctcttgggtccatcctaagcttgcttcagaagacggcttctaagcttatgtagtcatttttttccttagtcacattgtcaggggctgtcattacctgctcaggttttagtggttctaactgctgcctctgaggtttcttggaaattcagcttgttttccagaatggtggcagtgctagggatgaccaagtgacagggttgggccagggctctccccatgttgaggttggcacagtgtgtgatgtgtttccagccaaagggcaagaggactcatttgggagatattatggtgggcaccacgaggaagagtgctggcagggcggggctcagataagggtgtgctgaggaagcattccagccagctgggctagagcatttggagttaaaccctacgtcggatgctgtgttgtggttaaggtcagcagctcaagagtcactaaagttggatgtagtttgtaaacatcgaggttctataggaaaggcattgagatttgggggtatttgtggaaatagtgtgtcccatgtgttagcgtttccaggctggattcactcccatgaggtcattttcttgttcatttctcttagactggctttgttctcgggtggctctaacactagggcagtctcctacacgggcagcccatcttggcactgtgctctccctcactgacctcctgtgggattccagacaccacagccttcgaggctgacctggcctctttccagaagatgtgcagctcttagcacgtcatacatttcttctgcctaagtgttgactactggcattgtgaaattaacaggtacattcttattttcctttattaattggacaaaacttcttgtaaaaatggagttgctctcactcctttcttggcgaatcaacaaaaaatggaattggggaaggccttggccatgagccgcccacatgtgatccgctggagacaggggagtagaggggtttgtgtttcttctcagtctttgtttctctctgcctgctccccagtccttcattacagtgtagttcttgggaaagttctaagtgtgctctgtgtacttagaggaaccattccaatgttgcatgcttatagttttcttatataaaagaaacattaatgcaaaacatgttttaatgtatctttaatgttgtaagtcttaaaatataaaatcctgaaaaccggctaagtctgtttaaggttttagagcactgctgtctcctcttgtgctctgcgtttaaaggaaacaagaatggctgggctagtgtcaaaacacagaactggtgttgtaaatagatagtccatgctggagagtggatgatgctccagctaagctggatttcccaactggaagagacaattagggattgcatttcacctttcattgtatttgtatctgtttccctgttgctctgttattttctgaacatccttcctctgtgcttattgaaagaacaaatggaaacccaaacctgctttgcctctgatccttacaccatggcatcccttcattttatagccatgcgtcccagagtggggcctctgcacctgcttttcatttcctgttcctcctcagcccactccaggaagctgtcttgagaaggattctgtgtgccttaaattgccacattccaagattggcatcttctacctaggagaaggaaatcatactttggctcaccttggcatagatgagaaaagctgcaattcaaataatttgtgttgtaggaagtatttcttttaatgttgcaaattagtgaatttgtagttagagaaaattcattaaaaaacccgtgtgtggctaacatggtgaaaccccatgtctactaaaaataaaaaaaaaaaattagctgggcgtggtggcaggcacctgtagtcccagctactcaggaggctgaggcgggagaatggcgtgaacctgggaggcggagcttgcagtgagccgagatcacaccacggcactccagcctgggcgacagagcaagactccgtctcaaaaacaaaacaacaacaaaaaacaaaaaacccatgtgtgtttgtgtctgcatttatgtgcacacagtgggatataagtgtgtgtgtgtttatatatatcatgtatgcttgcaaattattatctgtttacctgggatacacacatagatgcatggaagtgtgtttgtatgtgaattatttacaataacagcagacacggtgttctcacagtcaagtaattgacccccctccagatgtcagttccacgtgttgcacaacgtgaatgcaaactgcttgaaagggcagacaagcttatagcaaacacgagttgcgtcttggtgggtttcacactgactggcaatgctgtgtcctgtgtagactgcagagagatcctgcttcccatgatgaccgatcagctcaagtaccatctggagagacaggaggacctggaggcctgctgtcagctgctcagccacatcctggaggtgctgtacaggaaggacgtggtgagtgttggctctgtgcgtgacgtcctgccatttgcctgaacctgccatttgccttgcagtacaactttattcagttaaaaatgaacggtcttgattttaaggtctagcctctctttttgtctcggtagagttgcacccttaaattatttttatttatgtatatatggtgattattacaacatttatccttttgcattgaaaattgttctttatttcctgtgtcttctcgacgaaatgtctctcaggacctaaattttcatccttaaggtcagacaaaaaggctttgatgcttaaagttggctaattatctgcattctttcttcttatttttattaaagtaatacatgcacaaagttaaaaataaataaataaataaagccaggcatgctgagggagtcgtaaggagaagagcagctcttttcctcccctcaggctctcttcccctaggtcagtgctttgcttttgtagctctaccctattcctttttttttttttcttttttcttttgagacagagtcttacactgtcgcccaggctagagtgcagtggcacaatctcagctcatggcaacctctgcctcccgggttcaagtgattctcctgcctcagcttcccaagtagctgggattataggtgcctgccaccatgcccagctaatttttttgtatttttagtacagacggggtttcactatgttggccaggctggtctcaaactcctgacttcgtgatccacttgccttggcctcccagtgagccactgcacctggcctaccctattccttttgcatttctaaattgtatgcttctttcagggacttttttaaaaatcagaagttggtgccagcccagcgaagtagctcacgcctgtaatcccagcggtttgggaagccaaggcaggaggatcgcttgagcccaggagtttaagaccagcctgggcaacatagtgagagcctgtctctagaaaatgaaagaaaaaataaaaagcaagtttgtgccagcacatatggaaaagtctgaccctgtgcctttcactcccaacataccattcctgttggagcacacacatgatgctattgatcttccaggtgtgcctggaaaggtgaaagcagggctttgtctgtccttgcccctagccctggacagagtggccaggatttctaagtagataaggcttgtccctggccgtttcctgcgtgaccttgaaaatccctcctagtcaccacgcccatatacctggccacccactcccctgtagccctggctcattctctcagagcctgattagtgatctggaagaaaaagatcggattaaatctgttcttggtgatgctggaaacctcacctcttacaggggcattgcctttggagaggtcttggaggccttcacccaaaggccagcctccagtggtcccacttcaggctcttccctgtttttattggagaaaagcttggggtaagagcttgtatggccaaagctcacagaggaggtggtgatgctgggaagggcctagagcatgtgtttaagcagattcatagttcacgaagaagaatcaacaatcgcatcccacactaataaaagagttaatttttactgaatgccacagcagtgtgaattttagatagtttgctaaatgctgtttaaacattctatcctgtgtgactgtttaagttatttgcatttgacgtgcagaaccatctaggactgttatctgcctgccttccatttacagatggccaaatatctttagaaaactaattggtgggctaatcagggatcataaacattatattgtttaaacagattttcttttatttttaaggtttgcttaaattaaattactatgattatatatgtaacaaattatcattaatggactataattaataaaatcccctgagtttttttgtgagagcttttgcctttgacaagggccatttttcatctcattaagggttataattgatttactctttacagggtaaatggattcaatgacaaccactggggcttgcatgttaatgtttctctggtgttggtgttcattggtgtgtccttccccaggggccaacccagaggcacgtccagattatcatggagaaacttctccggaccgtgaaccgaaccgtcatttccatgggacgggattctgaactcattgtaagtgcttggtgacatatgtttggatatttaactggggctgacagcatccttctccaactgctgtttgaacatagcttattatactgcaatgtagtgagcagttgagatacagcttggtatataaaatgtcctcattttccaaatgaatgtcaaagttgaagggtaagcaaaccaactttaaagatggaaacatttggctcttgttttctcattacttacttatagcaaaagacatgtattttctgctgagtcgtcattcttctggcagtttctccatagtgtttacacttaaggtgccattaataaaattttatgaaggaccctaaaaagtaattgagattcttcaccttagttattttattgtctactctaatgtattgtaggtgtttttcttaaacagtaattaggcaggagcctattcatttttttcaagaatattttactaatttagacagtccatcaagtttctgatcatggtgccttttcccagggttcactgctgtcctccgcacccccttaccttaagtctgtttccttcagcaaaaaatgcatgagtagatctcgtttaatttttttttttttgaggttcaaggggttataatttctttcctttttttttttttctttaatttctgggatacatgtgcagaacatacaggtttgttacgtaggtatgcgtgtgccatggtggtctgctgcacctatcaacccatcatctaggttttaagccctgcatgcattcggtatttgtcctaatgctctccctccatttgccccccactccccagcaggccccggtgtgtgtggttctcctccctgtgtgcatgtattttcattgttcacctcccacttatgagtgagaacatgtggtgtttggtgttctggtcctgtgttagtttgctgagaatgatggcttccagcttcatccatgtccctgcaaaggacatgaactcattcttttttatggctgcatactattccatggtgtataggtgccacattttctttattcagacacatgtacacgtatgtttattgcagcactgtttacaatagcaaagacttggaaccaacctgaatgcccatcaaagatagactggataatgtttaaaatatttagcacatgttatcatttaagtcatcttggtggatcctttccaaaaaatgacttgaaaggagaaaacgtccttttggagttttcccttgacatcagagaaggcaccctggtccttcctggtgcgtgaccgttgttcttgttgcatatctggggtgtgaacagggaggtgatgtgcgtcttcttggacagcatagtcagaacggagcactggggtcctttgcgtttttatgtctggtgtcaccacagaggactccgtgtcgtgtgcgtcacagacaggtcgcacagatggacaaatgctgccttagtgtgtttccatccagtgaaacagttcatgtcttagagcttcagcacatgtgaggttcagattttcctttttaaagtgtttaaacttaaagtttaaacttaaactcacattttcctttttaaagtgtttaaacttaaagtttaaacttaaacacttttaagtttggattacaacatgtatgaatcaggaaataaaatgtttccatgtaaattggctttatttacagtagacttttccattattacataaacgtaaatttgcctgccttttcttattctccatgataattattcatagtcttgaaacacatttggaacacattaatatggaatgggcactgagcccatggagaaggatttgcagtgactccacgagccacctgttgacccctgaggtctggcgttgacccctgatgtccagcgttgacccctgacgtctgacgttcctgtcttcttggagtcgtgccgcaggtgcactctgcacagtctcaggagtggaactggaaagggccttatgtagagcaaagagcatgtggcttgaacttgaaccaagtgtggttctgccaagaccctcttgggatgggcggacttagagaggctggggatgacatgatggcatgcaggggtggtggcagatgagggagagggtagaagtggaggcaggtggtctcatgagactgttttgtctctgtttaggggagcatggttctgcctgtgcttagggaaacatggttctgtctctggttagtgggtcttggtcctctctctccgattaggaggtcctgtctctggtcaggggggcacagtccagtctctggttagggggtgtggtcctgtctctagttggggcacaatcctgcctccagttagggtcttcttttttttttttttttcccctgagatagagtcttgctctgtcacccaggctggagtgcagtggtgcaatcttgactcactgcaacctctgtctcctgggttcaagtgattcttgtgcctcggactcccgagaagctgggattacaggtgcacatcaccacactcaagataatttttgtattttttagtaccgatggggtttcaccatgttggctaggctggtctcaaattcctgacctcaggtgatccatccgcttcggcctcccaaagtgctgggattacaggcatgagccaccatgcccagccttatttagggtctttatgctaggtgtgtgttcacttgacttgtagcccactggtcaacagttaaactggagggaagagggcacagaaaaagctcataaagtttggatgggaagctgggaatgtggagagattataagatgtgctcacagcttcatcaaagggtagaatagaccctgcagggaatgatatctcctctcagaccatgtggtccaggatgtctttgagaaatttctcctatctcaggcatgataataagtgtggtagtaataatggcacctcttcactgagcatgcatttacgtgctatgcactctataatgaacaggaagattctcatttaattctcacagtgccctgcagacagacaagaaacagttcaagatcccacagctagcatggcagcacttgtttccagcctggatttggttcccatgtatgctgtcagtcccttctataagacacaggcacacgatgctgatggccgtggtccacttcagaagtcatcgaaaggactgagctgctcctagatccctgtcctgcttagggagacagctgttcagggaaataagcacctttctattttctgtcatgtcgtatccatggtccaactctaggatctccttgctagaagggccagaccacaagctaggtgcccatttcctgaagggcttgggatgctccagcttggaagaacccctgtgttctaaggaaccctgaggagttcctccggaagaagccttgcatgttctaagaagggggtgtgacagcgaggacccatgcttggtcttatccagagccacattgatatcaagcatttggcataggggtctaagcactgtccgggaatggaagaggtagaacaaacttcccacctccagaaccatcctccacagccctgatcttcccaaacagaagcctcaaagtgggaagaggagagaggtcttaaacggactcctcccaattccaccatctctaagatctgtaaagaagtaaaaaaaatccttggagtttcttttataaaatgcagctgtcttgaaaggactctcaaaaaaattctgaataagctataatcatttaatgagtgatgacaacatcaagatgttttcaagaagggtgttcgccactgaaaattcgagttgtttagtgggaccttgtaatccccaaccagccacgagccccctctctggagtcaacagagcagtgtgagtgaaatgctaccctgtttaggatgcctgcccttgctcttccaatttgcatcaaatgtagatttgtgcattaactttttaaagtcgttgttgctctgtgaatttagattagaggaagatcaaggcaaaaagtatccctgacaaggtggacaaaaaccttaatcagtagaccttctagagtggaaaaagagtagaaaatagttcataggtctgttttgggtaggctgttccattccattatatcttagagatttcagcctttatgtgttactcatttttgctaaatatagtggaaattatgtaactatgaatcagcttaaaaattctaagtaatcactgaaaatgagtttttaaaaattaaagtgattaaaaagaactctgaaattaatatactttacttaatgatttattccatgatgttgtcaacaacagtactagaaatgtggcctctttccatcggaataaggtattaactgggaatgtgattatgccctgacagcttccccctattaatgtaaggaatagaaaactggggaacttcacacttaattagataaattgggatatgcaatataaggcttttctttatctgtgggattttacaaaaactcgactttgcagtcagttgtatattgtttgctttagttgattatatttgaaatgggtgattggaatgcgtctcgtgcctaggataataatgtgctatgatccgaagtattacatccttaagaaaaaaccaaaacaactctatttggcagttgcagaattgtagaccatgtgaatacctagcacatgcccagagacagaagcgttgcaataaccttgccacagaacaaaaaggtcattttatctttactctgatgtagtctgatgctgtagaagcatggagtgaaatacttatttttatattaagtcagacttcaggatttatttcagccttcctttttgagaagctttctaagccctcagcattaagcagcatttttcctcatcacacacggatctgagcaggtgaccgcggctgggataggtgctgttgtgttgtgtgcaggtgggctggccagccattgggtgtgtgtttttcctagagtaagaagcactccaggctgagatgagagctgttgaaatgagtaacatttccgtctcctgtgatacgcgctgctgttgcttctttcaaatgatcagatttacattcttttaatgggtcctttaaaaatgtaatcgagtgagaaggacttctaaagatttttctttggcctggatacacacgaggggattggaaattactaattcatgaaaatgaaaatgtgggcttcttttaaggaaaaattccctttgaacattgacagaagtgggcgtagggaaggggaagattttgcctggattctccacttaactcttgtcaccactggagcatcctgactccctagacacaagtgatggaagttattttgtttccactctaaacactgtctcagggggacattgatgggatggtggagggtgtgtttcattgtgacaacagcatctttggtggggaatttgctgttggtgaaaacccagtgctttctctgagcatgggtgattgataagggcctgacatgctccttcatttggaaaatggtattaatagaattggtttcccagtgaatagtgccttttacccaagactcataaccaaatattttcacaaagatgttatatccccatgcatgagcattcattttgagatgttcattataatagagtttaagtatgaatgtgttttaaaaatgattttaaaatcatctgcaaaaaaatgttgtgtttcaaatggacagtgtctgggttttgtatagtcatcataaaaatgtctataattgtactgtttgctaataaacctacctgctttcagaaaatcatcctaacgtgtgtgtgtgcaccaatggttttataagttcatttttctttggggcagctacagcaattttaggtttgttttcatattcctgtgaccctggtattttttcaaggttggttactagctatgggtttactgcagaagaagtaaaaaccacattgttgaatgggcacaatatgctctgcaatccttacatattcataccaaacagcaaagatatttgcaaaaccagactgccttaagttaatttttgcgcaacttaaaatgaccttgtcattgaccaaaatgtataggatccactgtagcatgatgactttatgccagttcatgaaatggatgttctttctgatctttgtaccacagagttgtttactttcagtaaataaagtggctgcacatgcagtgcctgcaaatatgctagtgatagagtttctgtaggtcaaagaagacgtgctggtgtgggaagcagctgctgtgatctttaggtgacactgctgcagccaaactgccctgattcataatgaaatcaactttcacttgctgataaaaatgctaaggaatgagtccaccagtgacaggttttctaaacaggccatggtgttactaacaccatgacatagaaaagttcatgcctctttcttgtttccttttcttgctgtcttctaggaaaggccagtatttgatggtctgtcttcacagttttaattaagagttgtgtatcttggttctgatatgcccatgtggtttccaaggaaaacagtgttgcaggccatcctccttgtgactgtttataggttggagttggtctgcctgaggctgggccatgactgtgacaccatttacacccagtagtccagccacatctcagatctctgtggctgtagataactaactgcctctcagggtacatgggaaatgctgccaactgcctaagttgtttccaaggtagcaaggttttcccatactttgagcccctccccatttatcttctgctggagggtcggagattgaaggagcagatgcaggactacaggacttctgcttcttggaagtgagttgcacacttgtagagtgactggtgggcacccttcattgtatctgggtgtctgtagaacaggacctttgaggcagcaccaatagttggctcagaaatgattatagaatgagacagaaccctccctctgtctgctctgggctgtgcattgggccttccttccctttctgcatgtgtcagaagaggaatccccttcttctccctgaagaacatgcgatggtagcaggagccttgagtgtcggtctgcagtgccctctcccttgcacatggactctgtggttgcagatactgggaaaaagcattgtggcctctcctctcctaggccgtccaggtgaggcaaacaccagcccacgtgtgcagatgggttagtattaggctagtgtcagcaggagaggtaggcgctcagcctatctcccactagggaggggaagaagaaaggaaggaggcggctgatcccttgaggctggggatgtgctcaatggaagatctagagagaagctacctcccctgggccatggaggcaagatttacatgccacagtgtactgtggcaacactcaatgtatttagccatttcttctgaggttaagaattaaacctcatatacctcctgctatgagcctgtgtgcatcctaaaatgccaccatgtgttccggtggtgaaactccatgccagggtgcataggtgggcaagcgtcagtcccttccctccccaagccaggccagctctggctggtgggtcaggcccaggccttacgatgctcttgtcttctgcagaccggatgaaatgcctatcggcccaaacattcttcctttattattattttcttagattacttttatgttccccaatttttgaggccatgaaataagtttaatagccacataaaacatctttgatttttttatttaaaaattaataaagaacttaacgacaagtataataatttaatctctatatgcaatgccatgtgtacatctacataagggaaccctgtgcgttttaccttgcttttgtatcagagtttttacttgaatctttccaagagaagaatcaccatctgttagtgacgtgttgcaattaaactatgaaatgattttgacaatagtttttctattttgaacacactttaatttttagggatgaattaatttatcttcagaagttcctttttgactctgaacatttcaattttatttttttttggtctagactggtgtgaaacagtgacattattttgtgtactaggatgtcctcttgtttagacagatttgtgttactaattagaaaactgctaatacccttatttcaatttactgagatagttgggattcttaaaacataaggagagagaacttgttggaaacatttttataactttagttaaaaacagtataaaaaacatgaaacccatttttaaatatttagtctacgtgaaacagttacacttccttcatgttacaggatcaacttcctcattgttcttgcaccaaaatatttctcagttccttttattgatattcagggattcgaacttcatatagtgtttccgcagaggatgtgtgtgtgcacatgtgtgttttaaattaaagcatacaactgcagtgttgtttggcccccgaagaatgtttacacgacatactcttcatttttttttcaaggcccgatctggttactgatcactaggtccttgtagaatcaaaacacttagaactaaaacagatttgctgttgagtcaggaggaaaatacatggcaagaagcagctccaatctgacaaaagcaggtgagatccttttaccaaggttagccactgtgtgtttggcatctagtcaatgaggtgtgcatgtcagcactccactagatgtgaaactgctggacagaaacttcaagactaggttttcctgtatgctcacaaactattcaaaatttaagttgtacaaaaaaaaaaaaaaaggcaaagtaagatccctacttcctattgtgaaaatcaaaaaattgatagacaaagtcattaatagactaggggatttgatttctataaaaagatacttgcaaaggtgcaaagaaatgagtgaaaaaataaaggaactaagatttacattgcaatgtgtaatcaagagagaactctaagtgttactgttgatttaaaaaatacctaaaaacatttgattcacagctttcccctaagtatgttgtttagtacaacttactaataggttaaatgtaggcgacattgtcccttggtagcagctaaactaaacgcactgtttctctttgagatggtcagggcttccaccattaatacaaagcataacgaattgtacataacgtctggctgcacttaccatggctaacagtgtctcggaggatcgatccacaaaaacactgtctgccatggcacagaatgcctgtgatttattggtgggtggattatccatcgtgtatctctatgtatgttctcagattcttgccagaatgtattatttggcctttgggtaccaaaagattaaaaatgagatctaagaaaacttagtgtccaatagctctgaccctgtctacttgcagtgattaaaggcatatcctgactttgggggactcctggctgctggccatttggaaaatgagcagtaaacatgtcgtaagtctggagatgaagaggatgctaaatttgaggtgtcgttgtgacactgagatgtggtcacttggcttagcgctatagcacatgaaggcaaatatacatatagtcacattttagagattattcatggtctccgaccacttgaaaaaattgtgctttctccggaatttgatgtgctgaaaattgcactcgccccctgcttatttgcaaaatgaaacataaaaatgaagtccttcgcaaacataaggcttgctttttcttctcattatttaaaaaaaaaatcaaggcttgaaaataattatgagttatagctgtgtacagggtgacagcctgccatctcgcaggttgataatgtattacttgcagatcgggggtgggggaaaatttttacttatcatctttgactacgtaagtttcatttcagattttacatcccacatcagtgaactgcaaagaacagctggcaaggagtgacacagaataccttgcttctgttaattatctattggtacaaaggcctttttggtacgcagggcgagaagtgggaggtgcctgaatgggcaccacagttccctcgatcctattcattttggaaaagtattgacttaaactccagtgggttctaaagacggcctcgagactccagacaccgtgagtgttaaaggaaccagagtttccatcttccgtgctttttagattcagttttggatttttgcttgggagttgaggagtaagtctcctgagagtaaggcgaaggtatgacctgagtttcctcaatagggtggagttttcttagaaccggctggagtttgtcttcttgctgcttaaaatccagctccacactagaaaagagagagagtgaagactttagcatttgatcttttccatatgaagatccctcttagtgtcagcaagatttgggcatgatcagtgtgtgtttgtaatgtaattttatggtttaataatagcaattcgatatactatgttttagctctgtgctcccgtgaaatagttcaaggaggctcacttcctttggaaaataacttacttgcttctgtaggtgaatctttaatattgtgttaatgtgcacagttggtgtatgtatttgtggaaatgaaaaatgtgaaatatgaataaccccattgtttgtccacagtctgttcacatgggcctcatggagtaaaacagaaaaccaaaagtatgagtgggcaggggtcaccttagtacatctataccaagtgcacgcaaggtccgttcctgtgcaatgtatcacaagatcagagaaatctatttctctgatctcccacctaaaacaattctggaaggaaatgaccttggctgacattctccttgtaaaagcttatctgtctgaaaatctgataagggccatagtgcccaacgctggggaaaatagtgtgttcatggagtcaacaccattgaatggtactctgccattactaaccacagtttctttgggagaagcgtggggagtgttcagtaaagacaacacagaagtaaaattccatcactcaagccatggcgtgcaagcacagagccaatgtggaagcacatttgccaagcagtgataatgtttgcattagaagatggtgttaaagatgatttttgaactatgttatttcttacagcatttctccgaaaattgctgtcaacttgtctagagccctctcgtctccatgtctttgaaaaggaccacatttgatcttctaacttggagtcctaacaggtctgcttggcagctgggataggacccccggtccatgcatcgtttttctgtgatgatctctgcattgaggagttctgcttcccttcccactcaccctgtccctccttgggacctctgcgttctgggccaggccttgggaggattccgctctgtcctccttccatgtctggtctggatgccagactaaatgtcagtagatttcagtaaaggctcagcgttgatgataatgcatgagctcataacattttataaccagtggaaccgtaaaccatttataaacatgaaatcctattgatttagagaaccattaatcctagacaaattttgacattttggaaagacagaaacagccaagctatattatctggagttttaaaacaagttcaggacccatctaatgggccatttcatgttttaaatccactgttccatttttctcattgtcagtgactctaatattactcaaaaaattaaaaaaaaaaattgccagagaagtttatggctagtgacctcctgctcccaaaacaagttatccttttcccttttttcgaagagcctctttgagttatgctctaatttataggaagtagaataaaatctcatgaatttaagtcttgctaatccagactacgtgatgatggaggcatagtctcttctaaggacagttgtgaaaagtgcagtctaaggctgtgctgcattaatgaaatccgggcctcagttccgtgatgtggtgcactagaaggacatggggtttccaccctgcctcttccacctgatgctggtttgggagtcgggggctccttaaacttcaattctttcacttcaagggggagaaaatagttccttcccaggctgtcgtaattactgaattgtggtgacaatctctccccactgaaaaatgcccatgaacgagcctcctaaactgtaagatgcaatttaaatattattgtaccattattatctattgatcactaatcttataatggaaacaagagctaagtaataaagatatctattagggatctcttcaacttggacatttaacaaggaaaacaagagcctgtcaatcgagtctgtgaatatacggtatgttaggtatagaagcgtaattctaccaaggtgctttggtaatattgaaggtgtgttctccagatcgtaaccgtttcaacagccccagattggttttgggttattagaacagagagaaggcgctagcatctcctaggctaacagtacaatttcggctacctgtaattattgaattcccattaagcaactacactgggaatcctgttattaaccaatttatcacaccaaggaaccatgtaatcacagagtaatctaatctgagttcttgttaacaaaatgactcgactttatctgtcgagttgattcctgtttgcactccccattatgctgccctgggaatctgcaaccagaggcaggttccttggtagagggcacttatgagtctgtgagtgcccacttggaaacgcctgccagcaagttgaccctgaggtccgccccccagcccatctccccatctgtcacatgtgagttgcagtggatctgcgtgtgggatgacgcccgtgcaccagccaggcaacgtgtgcagaggtgtgaaggaataatgtgcattgttctggacactgcttcctgctcaaggacttttcttggggaagcacaccaagtctctcggttgagtttgacacaccaagtctctgggttgagtttgacacaccgagtctctgggttgagtttgacacaccgagtctctgggttgagtctgaagcagaaacctgactggaggaggcagcatcagaaggttaacggtctggccaactctggctgacatcgaacaaaggtccctttagtcttaatagctaaatggatcaaaaggcagcaacacctgctcttctggttagagtagtggacttggagaaaagctgccggtagatgttccagggcactgggactgccctgcacacagacctccctctgtatttgagacagcggcttgtccagatagtgcctgggggcctgcctggtggagggcccatggctcttgcttcagcttccccttcctgctgcccggcagacctgtggtgggagtgttggttgccctacctggggccacatctttgtccggtgctgccagcttcatgattatcactttctccccacctgaaacgcctttctgggctcatggcatggctggcattccttggcccactgtttctcaggtccacataacctccttgttgtctgaccaccttcccaaatgttgcccaatccatcctgtcttatttgtttttgcactaaccacagataattattcgttcccatattacttgccttcatcttcctaaatgcatcttctcgaatgcaggcaccataatcagagatgccatgcggtcatcctctttctgtttccagcaactatagcaggggctgggtcctagcagttgcctacgtaatattgctagaattaatgaatgagaacagagtcttaaaaggcaaattctggccaggcacggtggctcatgcctgtaatcctagcactttgggaggccgaggtgggcggatcacttgagatcaggagttcaagaccagtctggccaacatggtgaaaccccatctgtactaaaaatataaagtttagctgggtgtgatggtgcatgtctgtaatcccagctactcgggaggtggaggttgcagtgagttgagatcgtgccactgcactccaccctgggtgacagagtgagactttgtctttaaaacaaaaaaaaaaaaaaagcaaattctacctcacttttagtcccagttgccctggactgctttgttttggccaaaaattatgttgtgtcctcccctgtgtcctcccacaatgagaccccttccttgccacagacaaatagggctctgcctggaggcattgtcagaaccactccagatggagtctgtggcctggttctattctatcagaacttatcgaagatcctgaaacattttctgcaagacatactccaggatctttttggagcctggctcccatgccacggtcccctcctttccgtcttctaggattctacagtaagatcttggatagaatgggtggggccagcagggtctgcttgtgagtgaccggctaccacagtcgctgtgctaaggggagcgtgagagttactttgtccccttttcacttgcctgtggacagcaggtggaggtctagctggatgttttctgggtgatgtttgttctgagcaccatcacggtcccaggccaccagacgtgctgtgtgcacctgctttcccagggcggctccagtgcaggggctcattctacagccacacgggcacgtgggaagccggggctccaaaccttgttgtggtttctgaggactctggctgtggctttgcacagtccccttgcaacctcccaggcctcactctccagcagctcaggaggcaggaggctgcaggtggtgctgctgccctcctgctggagggatctggtgtttgtaaagcatgggcaggggagtgtccatgtcatgaggaattcttactcctggggaggagcagcagcctggaaaaagtcctgattcttgagattcaaagcatgagtctgaagcagctggagccaggccagccttacctgtgcggggtgttctgtcctataaacacctgagtcaaacacaggctgtagattttgctgggtgagaagggaagatccctggatggctggggatattgacaagacacgaattcctggggactgtagggatttacctttgtagccctctcgctgcctgcacctccattctccctccagataagggaaccatccacccaaacactctgtgccctggggctgtgtcgccctcgctgtgctcttggcaagtccctgtgatgcatgattaaagcaactgagagtagatttaatttcttggttggtctttcccttttcaaaatgaaagttttaagtgtggggactttcttacaacatgattattctgtacatttccaaagaaagaagaatctgccctacatctcaggctgctctccagcctgcacctaagctttattttcttcccagagactgtgctaggctttgtagtaacacttctccccgctgccgcatgtgattttgcagagcggcatccttcttgcttctccagcttattctctgtttgtctcatgctcctataaatactcaggccctgccacagtttctttagcaagctgtcactgaatcctcaagataatttaagaggaacacatttttaaagttgccttctgcagtcgtccatgtgtaacagttaagagttaaaagcaggacaatctggtgccccggagcttgctttctggaagggaagaaaaccctttgtctttggggtctctagcctcgacagggccatgtggctcggtggccagcaggtcagaggcctctgcctttaattctctttgaattagatctcagagtcttccccagtgctaaccgtggctctgtgctgactcaggctctaccactgtggataaatcacctcaccttggggacctgagcttgcttggctgtgaagtgatggctgagatgtgctcccacttctcacagcagtctcctggaacaaggcctgggcccaggagggcaggtgcaccaggatgtgggctggcttttattgtgtagctttgggtaggaccagccatgtccccaaagcgcaacaatttatgtcaactgacattggcgccaacttggccggttttatgtgagtgccatgggcaacaccagcattgtccagaggaaactaaaagttgggatccggatcccaggcctggctctcccccttgcatgggaggtgaattcaggcaagtcctttctgggccttggtttatggatgtgaccctggccacctctccaggcaatagaagaaccaggaccccaaatatttgttgttctcttctgaacacatctccgtgtgcatatctgaggggcactggaaatccagcatgtccagaaccagatctttcccccagcctgcatctctgtccttccagactcagcctgcagcccccattcatctccctggatgactgcagaccctggaatcaagctcaacttgctcctcctgcctcagcatccctgggtcgagtggatttaccctcagaacacccggtgtccttcctctccgcccaccttccactgctctagtccagaactccagcagtttcctccttggccattgaaacagcttagtctccctcactctctgtattctctccctctccagttaccagagtcaccttaggaaaactggcaaactccttctcaaatccctgcttatccttcaaaacctaggtcacacgtcactccttctttctgtggattttctagaataacaaagtccaccctcccccctgcctcatccacacacctctgggatgagttactgctctggcagcattgtctctaggtttccatgagagcctgtctcctgtgggatcgtagctgtcttcccccaggtctgtgaactcattgaaggatggaccatgtttaattcatcttttgtctgcagtgcatttagcacagtgctggctccgaacctgctctatttgtttgttgaattacaataaactgatgaactgaaccaaatcccctcacttctaatctcagcaaagtgctgccgccctattttctgttttcatttaaaatttatacatttgtataattctatttattctgtctatagaatttgttatatactatttctatattatatacctacattaaatatatatggatctcatcctaatagtttaaaatatcagtggtttgtagttaactagcttttcaacactttaaacatagaaatgattcaccgtgactttgtatccttcctttaccactattttacatggtaggtgcattaatcaatgtttatggtatcactgtagggcttcaaataccagaataaatggctaatccatgatagtaacactcaaactgtaagatctgtccccttttcctggtatactatgaacaagaaattatgattatagtttttttaaaaaagcattagccagatatcctagctgtatattttactatgaaggatccaaagttagagttagacgatgagctgagctttccaaatgcatcttggatgttttccgtgaccatactggagaacttgcttgactgaagctcatcctaggtgcccatcttacctgtggcactctctggagtgcacctgcggctctgggtcctgagcctcatctaggtgcctgggtctgagggcaggtcagatgcacaggggtcagagaacctggcatcccataaaatagtgccaccgaggagcagaggcagacccaagtcatttggattgcctctgcccatcgtaagttctccatgaggaaagacaccccatgactaacagcaccgccacatgtctatgaagcatatcttatgccatccccctaggaagccaggaagacgagtcatgataatcagaggagtcagtcctttctgagacgtagcctgcagaacactgctgttcctgacctcagtgaagaacagccagttttccaacttttgacagaaactgtgttataactgccttgaaaaggagatgacacagggctgttgtcctcctgttctaagctggttgctgtgagtccctcgtggccaacccaaccctgagtgggatcccatgacccagggccatcaccttgcctgcctgtctccttttgaagatgggagtgcgtctgtctagagacatgggtgacgtcccgggctcccagtgttggtgtgaaggctacaaagccaccctgcctccctgggccaccagcccggaaccctggtttctagatgtggtcaggagctcccactccatcctgatacccattgagagcatcatctccactaaatgtagcagtgatagttctcatcacacacggaaaccattagctgcttgtgtgtgtcatctggtgtcaccagtgaccggtctaaacgtcagcctgtgcattcctgcaggaggtcccttctcaaacaggttctttcaagacgcctatctgtgaggaagaacctgccctggggaccccgcaccctgaattccctagtcactctattccccatggaatttcatacgacccagccctagacatcgtggccaggactgcgtcccgtatttacccccagaaaaatctccatactcatctaaacatgaattatctttatcttcccatgaaactgacagcgtagtcccctcatgctgttttggacattggtaaatgcctccttaactttgaccttggggtataaccaaaggctgggactatcagtataattagcctttctctgctaataaattttaactaattgtttcacaaataatatgttgagatgggtaatcagttttagttacagttaatggctgtaacaagtttcctagcatctaaataagagaattaaggcattgctaaacattagtaaaaatgactaaacctaaatccgtacatattcgagggacataaataatatatttttggatttcaaatagaaaagaaaaaacttggattattagctttgggaattttcaagaagaatttagagatctgtcagaatcattcttttttcctgacttcattaaacaaaagtatttccttaccccagaataacattgtgtatgtaaggtgttatccagggattcctttctctcatcttcctaccctgtcactcaccataaatactaagaacagagcactaaacattaggcaaaaggcgaatttcccccacctcagttcatgctgctaaagaacttaatatgcacaagtggtggtcattgaagcagggctggaaagggcacttccatgaagagataatcgctgaatgacaaaggctgcagagactccactccaagtgggctccggacaggctggaattggcacggattctgcatacaaatgcaattaccactcttaacaataggtctccattagtcaggaggtgcccggttctgccggctgtcttgatcgtgcactatcctgaccagctttctttttgcaatacactcggaatcagtgaagtgccagtgtgcgtgattttatctagaactctttgcaccctctgttttgtggtcttattggtgttgtaatacattaccaagaatgatgtgagaaaatacaacccatcacttttgtgaattcttcattcagtctcataatgttagatattttcctcatctttcctgaaatcctccagtcatttggggaaggaacttgccttcttttggagcttcctacttgagaagccgtcaaggattgtggtggactgggatgttctccagcctgtctaagggggagtgttcacgggtcgcgaggtttcccatccatccttgggggtgccctggctgtttgtcctcctagttcctgccagttgttcctaacgccgtagcctggagggctctagagaggccatccaaatcctccctaacctggcctccctccacgattatcttgttttctttggagtctgctttgccaggtcgggcaccctggcttccttcacctcctcctcgcctgccttttacgtccttgcacctgtggctctcaccttccgtacagagggctctctctcgccagagctctgtccttaccctcatcccggggtcccagggtaaggggcatgcatggaggtgtcttcagcagcttcacactcctcccagtctcccagggcctggtgcagaacttgtccttaggaggtcccttgaaaaacacctgttcaattaataccctttaggaccccaaatggaaagggctaaggcatttttatcaaagtggttgtttaaaattccacctgtccttgtctgggcacggtggctcatgcctgtaatcctagcactttgggaagtcgaggcgggtggatcatgaggtcaggagtttgagaacagcctggccaatatggtgaaaccccatctctactaaaaatacaaaaattagccaggattggcggtgcgcgcacgtagtcccagctactcgggaggctgaggcagaagaattgcttcaacccaggaggaggagggtgcagtgagccgagattgcaccactgcactccagcctgggcaacagagtgagactctgtctcaaaaaaaaaaaaaaaaaaaaaaaaaaaattccacctgtccttgaccatcatggatcatatcaaacagtgaaagcatggagtacacagcaatgcgtttcacaagctccccctctctgatgtcagacaagtggtgtggagccttgtggcgttcccatccagtcaggttccaagcccactcattgatccactgcagaattattagtgtcacttgaggccactttgtgtggtggctgtgatgatccagaaatgaagcagacacagcgtgctccgggaggatgtggtcactcagggcttgcaactgatggtaggaattctaccacttgacgagaagattctaaattctgggagagatgctgtttaatgaatctgagtcagaattcctgttatgttttaaatcttgctttcatctccaaaagcccttggattgcagttggtccatgttattttcatgaaaatgtacacattagaattcaggccattttgtcgcagtactatgttacaaattaaccatttcagcgaaggagagaatggctggtttgccgatgatgtttcattgttcctttctgaaaccacatccgaacaaaagctgaatcatccgtggtgtgactcatcagattagtccgacaaaagaattaccaaaatagggctggagagaagaaatttcagctgcttatgagcaaagattatattagtaatttatccacaaaacattttctgaaataattacggcatattttgacaagaaatatggaagataagccagaaaagttttcctaaagaaaacggaaactggaatctcttttaatcttctttcatgctgagatggttttaattagagtagcacagtcggtctgcatcacaaccgaagggatgtctgtcatcttagaaaaagatgtagctgtgtcaaccatctcaaaatttgtcagaaagatcacgtttggtacttggggtttcagtggtctaggaggaagcccatcaatcctctgccgaagaagtgttactcagctctgagtcaatagatttgccaataagggagaggtgtttttcagctgaggaatgccttgtgactctccacacttttacccttctgtgcagtctcttgaaacccatagttacatcccttgcataattgtaaaaagcagctcctgggatttcagatctggaagggaccttgatgatcccttagtgcaaccccagaggacctggagactgaacagacaccccacccaagagagagggcagagaagctcagccctaaccttgcaggtacgcggcaggctctcacgggctgatgtttctcacctttcgcttgtcgtactggtggttttccccccgccttgaaattgcatcaagaccgtttgtccttttgatgcttttccctagtcctctatatttccatgacagaattatttttcacagagaaatatgtaccgcctcccatggcaaaggtacccatttattacaggcctgtggtgctaaagccccaggcagccgggtcttgaacacagtatccttttcatctccctgggccaggcattactggaaacacggtggatagctatgctgctcggagagggtaattgggtttcgagtgaaaagcggtgtttaaatgcaagacaggcagggtcaaattcatttccctccagggcttttggccttccagaaagcagggtatgacaaattacaatgtgtgaacactggcagctgtgatggccccacgtgttctcaagcctctgggacaaccacagtcatgtgacattttaagatttattttgaaattcctttaagctacccaatcccggggtgttccaggcatcccatggtgcatatggagaagtgggttgtaatggtggtgtagggactcacaggaaagttcctgaactcccggattcaggtccttgcaactaagagccaggctttgatctgacagcaaggactgtaacctgagctatactttcccctgctgctggaattgtgtttctacagattcatatgcaggaattcaaggaggacttggctgtaagtttgcatgggagaacaagacatggatgtagatttgtaaagcctttgaaatttggagacaccctctggctcacttggagtctatacttccgagatgctgtggccacccatgtacactgctactgagtcacctgaataggtgactcctcctgcccaaggaactcactgggttctgaacacttttctaccgaagaaacttctattcttaagcttctgacatttgggggtgactcacagaactgaccgcaagctgcgaggtcatccagctcaatccccattgctcaccctcccctttctctttgctcagtgggaccctgagggaagtgacctgtccctgtgtatcagcaactctcagccaccagggcagaatcacacagaccagtgcttggtagtcagataggattacataagccctcttagctgatgtgctagattaaccatatggccctgtcctttcacgacataagtggtgcacccatgatgctgggacccttaactaactggcttctctgtctttgtcctgtgactctctgtccttacttctcaaggttcatgcttaccaagaggatgctagatttgttcctggacctgtttatacaattagtactcactattgaaatgatgtgattattgaatgtcatgcaaaccactgaggcatgagaagatagtcattgctgtggattcagtgctttggaaagagtggggtaccacaaaatattcaatgaaaaaggtagagacaggtcaagtatggattcagaaggattctgatctcagattctgccacaggactttgctccactttaaagacaggaaaattggtgtggctcatggcagatcatttgaaactgtagtgggggtgccacattcaaagaaaacgtctgggcctcacctctaaaggctgccctaacttgaaatcattcaaatgggagatttcaattcatgcgattcaaattaaaataacatgtttaagttaggtacatgtcaattttttatgatttccccattgattgatttttcaattaatggaccagaagtgaactttcactccctttatcatctcttcctgcagacctcagaaaactcttatccaacataataaccaccttaagagtaatcgttaaactttaattatttccattataacatgatagggagtttaggaagcagcatttgatgagctatgttccacttggtagtcacagtgcagtctttatttgaatactagttcatttcttgagtttcacactagtttatttcattgacaggactcaatgaaataaagactttgggaggcagcaggagtccagccgaaatattactctgcagactgtcctgggaccaaaagccttccagtgtaacttctgtttgtagcagaagtttggctgttgtagggatgttttgtcattgtgaccactccaaagggagtgattttaaaaatcaggaaagaaagatctaaaactccactcttcctcaaacactacctcttctagaatgcctctcccatttataagggggtgacagtcgggtctgcaggctaccgagggccacatctctattcagtttctgaagatgccacccaaatcacccgtctgtaaaatcacatctgcagtaaaagttctcgatgagtagtcatgcattttccctgctcgtatgagataaccagagcgatcacagtgcctcgccctctacctagtgagtcttcctaagtcttggcaaattcctgtggtgcttggtcactcgcagttcttctagcaagtggaccagtggctgatgtattcggattcatgtagagtgatgtttgagccagttcaaaacagtgaccactcgagtaattcctgaaaggacagatttctgtccttcagagacttattcagtcacttttaatgtcactttttataggagtgaattctggatttagagctaagttcatttaaattatttcagttaggttaaacagtgttcacatatatatatattttttttcgatcacccacagaatattacgtaggtttaggctgaacagctcattctctgaacctaccctggatgtcttgactcactgttgcttggttgcgttaaagacggtatgagctttagcttccaaactaacagaagctgaactctgagtacgtgccaggtcatctacactctgcacttcctaacgtactgatgttcacggagggtcattttatgtcagtgttacagccctttgttgttgattcaaaattctcttttgcaagatgagtggagtgaaaagtttcccattaagcaaacttctctgatctgttgctatcattgagtttctaatttggaggaattgttgaagaaaagacctgcatggatgcctcattttaacctcctcattggcagttgccaagaacagtcagcagcttggcgtgccatgccaggctgctgcaggggcccctcctcccttcctgctgccaggaggccttaccagcttgtgtgtgcctcttacaacactctaaggtgggggtggtttcagtaaggtaggctttctcaacctcagcactattgacatttgggactggatagctcttggttgtgggggttgccctgtgcaggcagcataggatgtcagcagcattcctggcctctacctgctgcataaccggcagcagctcctcagttgtggcaactgaaaacgtctccttccagactttgcaaatggcccattggttcagaacctctgaggttaaggaatgtgctgatgtggccttcggtgcctatctctacctgtggtttcttctgcctcctcccagacaaggtctccaggtgacccagctttgcttttgcttttaaggaacctgggccctatctgggatgctctgtctggatcggaggcatggacggccaggtctaggctttcccttgggagagaaccctgatgggttgaagattgtgtagcctcaagcctctttgctctccccatgtctgtgttcttaatgcagaggacagtaactttgaataactttttagagggttttttggtttggtaattgttttttgataatttggtggatcactaaaattattctccagtctaaactttagaaaaagaacttactcataacatttctcaccgcttttatattttgtttgtgaaaaattacatttgcaaaaagaaaagaaaaaaggatagccatccttccgaaggttttgactacatcttaaaatcctaaattactgatgcaagccaaacacagcttcttcctgttgggagtttctgctgtattcttgttgatgtcagtcatataaacaaacttcaaattaaaaaccacaaggaacagctgtaggggctctggagcagggattctgcccggagacaggcaggcagcacaatcctcgagagttcccaggaaatgaaattccacatttggtgtgagcagcccaggtctttccatggtattcctagcacatacggtgtgctttcaagcctttgatctataccctctgaagggcctatgttttacagcctttccagaacacagagcccagggctcacacctatcgattccaagggagcaagccatcaaacttataccaattcttgaaaccactaagatacatttgcaagataaatgggttcaagctctcctacatcccacggttctatacttggggtggggtatttagaggtagcttagaattacagtcaagtaaggtccttcactttttgtctgatagaatcatcccagcatggccccagatcgttcttgcatttgtgggtaaacatcatttgtcactcataataagaaagtgggaagaggagaatgttaacatacctatagataatacatgcactgttcctgcatgtgtcacaattagctgtgtcttgccccgtccgatatgaaagcctacaagataagaacaggagagcattacaagcggtggctgggggtcactggctttatagagcagatgcctcaaatcagatgccttcccaatgccaagctcatcatggtcatggaaattgattaatgcatgcttcccagtttgctcctgtctctgctttcgttgtacaaaaccaatgcaacacctacagctaagatgatatttaaattaaatttagaagtgaacataagctcctggatgaagtaaataatatgatttcgttataagcacagggaatgtgggatgtttcaatgcagatttatggtgttttaaagaaactttgaggaaaaaccaaccacatacacatatgctgactccatggcttatgtttgctctaccccacctgtcctgctacaactgggactggcaaagtgcggcctgcaggccaaatcccgccggggcctggttttgtccagcaaactaagaatggattttacatttttaagcacttgaaaaaaaattgaaagcatataatatttgtgacacatggaaatgatccgaaattcaaatttcagtgtccatgaataaagtttttacttttgaaaataaaatggtgaaaatttttatgaaaatacctatttctagtatcctcaattttgcctcttggtctgcaaatccctgaacatttactctctggctctttagagaagaaaatgccaagccttatgttagaatgtcttactcccattgccataacttctgagttactttccctggctttattctctggtcagttctgtcagacccctgaggccgggcagattttggcctttgtaggggaggttgctaattctcccccctaattaaaaaattaataataatgaccttggggtctttctgtagtatattgttgaaggttgtataaacataaagggttgatgatgagaattttctggaccaggctggagttgccttggctgtttcttggtccagccacctaggaacagctggggagtgtttcatgccttcacagtttctcctattttatccagcctttcctctctgacatttttaacatgcagatgtgtattttctgggtattattttgtgtccaggcacagacatgataaccggaatgttaaatttgtggcaggagaaaagctcccatctgcattagcttataaacactctgggggcaaatttccacgtacagagctactcaccagagtaacagtgtgcacagaaggtcttctgtcaacattgctagtcagtactttttatcccctttgctgtgtaaacttctctgcatcatgggttttaaattgaaaataacttttgttttcctcattatattgtctgttacatcaacatttgacaaaaggattgtctgctacatgccgtgattgtctcagtgggcttgcaaaactcagacgtgacctcatggttatgtgcagtttgttgatcaagtgaccatattctgctccaaagtgttgccaggcactttctgtgattcatcatatttcagccagaattggaattacagtatggctgtctctatcgtctttccatcatcacctcccacatgaggtgcctttggaaccccacagcaggccattccgttctcccgttggctttgtcaggagagagggggatgaacagcctgtgccttatcccctccccttgttcctcaccagacacggtgattttgtagtccttacccctttcctcctcatggcaagccccaagaatgcattcctcctgcaccttcccacctggctccagatttgtccaccctatggcaaggctcttccacatgatgacatcacccttctcccttctctcttgccctatatagacttacagcctttctccatcagctaattctactggagctcggctctaagctcagtgctgaccaaggtcattttgcacagtgaagtcagtgccatccttgagctcaggtgctggcaatggcacggtccacgctgaatgtgttgttaaactgttggcttgggtggcagatgaggtactgctctactattgtgttgtgctagtgggtataagccagcagtcaggagaaagtacctagtacttgtctatatgtgctagtcatatccaaattttaggttcttacagtgggcgaaaccagggatatttacagttttctgaaggcactctttttgtgctcataggaaagtgtgaattctaagcttatagaaccttcctgccctaaacctcaggggaaatgtctatcaagcctcatcaacatcaacactccttccttgcccagtgtccaagtttcccagtgcctcacttgcattagagccctgagccttctaattatgctagccccacttacagaggagcatacagtcacacttcaggtccaggatctcattattcttaggccccaggcttctgatgctccctgtcaccttgcttgtatgctggggctggtgttctgcaccacatgtaattggcagcttgggataggcaatgaacctgacaatgagaggacaaaggcttcaggcacctgaaatgtacaagaggaatcttccaggaccttggagtacttcagtaagaaattgcttttctgaatcttttcttctcttttctttacttttcttttctctttttcttcttcttcttcttcttcttcttttttttttttttttttttttgagaccgagtttcgctcttgttgcccaggctggagtgcaatgggcacaatctgggctcaccacaacctccgcctcctgggttcaagcgattctcctgcctcagcctaccgagtagctgggattacaggcatacgccaccactcccggctaattttgtatttttagtagagacggggtttctctatgttggtcaggctggtcttgaactcccaacctcaagtgatcttcccgcctcggcctcccaaagtgttgggattacaggcgtgtgccaccatgcctggcccgagatattgctcttctaaagcccttcctgaaaagactttactgcagtcactttgtagaaagcacatattcctccattacggtcagtaagcaaatagttattaagtacatactaagtgtgaaacatttttctggctctacaggagacatttgcgaataagatggagtccttgtcctcacaaagctcacagtggcgtgggagtggcagaagggcaacataaatgcataaatgagcgaacggttaatttttgatactgctgagtgttaaggaagtgttgtgaagcagtattttggtctagaatgaactctaaggaggtgacatttttagtgagacctggatggtaatgaaaaagcagtcagtcatctgttgacccagggttggatgttgcaaacacaaagaccgtcacgtgttaacatcctgcagtgggaatgatgttcctctgtttgcaagtcagaaaaaaaggccagtgctgctggaatagatgcagcaggtgagagtggggagagatgaggacatgtgtataaaatgagaggccctttgggcattattttaaattgaatgggaagccactatagtttttcttataggtggttgaatgacatggaaacacttcttgacttttactctcaatcctctccttctataacatcattttcactcaattttctttctcttgcttcttttatttacaacccagcccaattcaccaattcctgagaaatggtttggctgacgtttgttggtaagaaccaaaggagtcattgtgttttctttggagacatatctgtggtcattctttttttagctagttgaaaacagtgggtggtctgtcagtttctaaatatatgtatgtttctcccatgtgtgagaattatttttaggacttcattaccatgaaggtgaggttttgtttaagttttgtttgggatctttcttttgtttaaaggaatcagttgtttggagtccatgaatgtcagcaggagattaatttgtgaataaaatttaaagtgttgaccttgtcatgtggttaattcacaggcagctgccagcagctggtgtcaatcagggtatgcctgctaaaattttattaagcacgagagtgttctcaatagagggcttaaaactatgtaatccattgtgcttactgctttcataatccatctaattgtccttgaagcttccaagctgtagggtttggcttcactgataattttatggtcacattaataattgggctgcagcatctgaatatgttctccaaatagagatgaaacagataagttatttctacaggacagggaacacagagtgctgttatggaatttccctattttttccttctcaacttggaaacacatcagaaaacagtactttgaatgattctctatattgccattgccataaggaagaacaacctaaaaactttaaactgctagagcagattcttctccagtgacagtagggctggagatcttttgtagattagaagtttagagaggagaaagcttaggttattgatgtaaaacctgcagtggaagaacatttggatcacaaattataaattttctgtcttgcagattaattgctacctttgtaaagcactcttcccttttgctttgaggagcctgtattatatatacataggcttgtaactccatgcgtgatacaatacctggtaccttctgggcgttcagttaatgttgatgtagccaagtcatagagtccatatttgtattttcataagtccagaataacacacttacctatttaaagaattccaactgagtgtggacaaaaaccctgacaggtataaattgtgaaaagttctagtcttcatttttctccccatatgaactcctttgggtgctaatgataagcatgttcattgtaaatatggattttgtggcattcactatgtatcgtcccatggcagttagttgtaagtattctcttaacaatgcatatagcttggaaaacatcgcattcagcaccagggacagtgttaaaagtccaaggagctctctttttttggtgcttttgttttctgttctgttgaccctctagcctcccatccttctagaactgggttttatcccagggaccaatttggggaccctggacctctccttgcttgatgccttttgaacactccttggtcaaggtaggcttgcctgttagaggagcctggacatgaactgttaatagggaagctataagaacatagactctgcgacagtgcatgaaagagaaggtgatgctctgttagaaacagaagggatctggacaagccaattctacaaggtggtttttgtggagtccagtttttgagtcatttacatttctgttttgtagtgaaccacctttcttcacaggactttgctctactttaaagaaaggaaaataaacttggcttacagaacacagcgtggagctctagtcagggctacctctctgtaatggcctggacctctcaggtttagctcagcatgcagttccccagtttctctagctaccttatacctttataataatcggctctaattcttcagttgttactatcagcaattcctgaatgtataaataaatatatatacttgtatacttacaagtatataacatacctgaatttttttgtgtgtaaatacacacacatacatacctttgtaaatttattttcaaaagtagtgacaattcggggcatgcaggtcttcagttaatcctttttggaccaatagcaaaagagggaatatatgcacctttgtatatttattttaaaaactggtgacaatttggggtatacgtgttttcagttattccttttacggaccgttggcaaaagagggcatcacgggtagacatttgaaaagaaacaaagaagggcaggcccatggcagagctggtgctgcagtttttgtgacaccactgcaggaatgataaaggaggagggtggctgccggcctcagcctgagagccgcaccatggccacgtcctgggtggcagggactccgaggagcagggcacgggagggctggacggcatctgctctttcatgctgacaccacagggagatctaagtcagcagggccctgggtgttaggaagggtgttgagaaatgtcagagaaagatcactgcaagctttcttcccggccacatatccaagctctgcttagtgtctccgagaccttgaagatggggcctgagaggcaggactaacaactctgaggcaatcataacaaaacatgaattgtttggttaaaaggtcaggaaagaaaaaaaaaaaaaagtctctcactgtgctgtcattagaagcaaagaccgagaaagtgacaagcatctcctagaggaatggttagcaagtggaaactaattttacagtacctaatagtaattacagtactagtattgggttattggattgatgtaaatgtgctgtttttactgccatagtctcacaacactgtttccttcataagatcttaaattctcaatggaaagttctcttctcacattcctgggtgactggatggggcatttgtgtgtgcctggtctggttgcagagttcagcagcatgctgtgggcccctccctggaagatgtgttcagtactcagtgcaggggagggcaagtgacccagttgttgatttgctgctcttttaaatgccttgttaattttcagccagttcagagcttctagcatgtcagggagcagcacgttggatagtgctgaaatcaaagcatgaccttctaagtgtggtcttcaaaatgttcattacatagggtatggcaattgtcacactgaatcaattcagaggctgtatcctaggtttacctgtatggaccttagctagagatggtggttgttgcagatataaaaaaggcatggtctctgctctcaaagaaaatgtttttgccgttaatttattctcttaagtttgatctctcttgttctttcagttttcttactggatgcaacaaccgtttttttcttctgcattcttacccaggtttgtgcactagctgtctcttctcgataactaagccatcatttatgtcagcatcttgaagggctttttcacttaatagtctcaaagtgacattaattagaggcataaaatgataccaccactattgctgggagaaattaagtttcaaaaagtagtaaaggcactgttttcagtgattccctcctatgtttgagagccactctgagcagtagatttggcttgtttctgaatctaaggtctcaccaggagtttgccagattatgccccggacatgtacttattttagatgtcagctgtttacagctaaagtggatttagacttcaccatatactcatggaaacgcaagtacattgtcttagcatttgagctgttaaatgctagaatttgagggaacagccaatttatggttgctaaaagaatatgaagttgattttcataaccaactcccaggatcaccccttcattagtcaaaggcggtactggcttttggtgatggtttgtctgttccctttttcccagtagctgataggacccatctgtcagccagcatccaacttgctgaagtgaggctgagcagttatgagatccttgctggccttggatctccaagtagacaaagtaagttgttagtggtaaaaactgaagttgcaatttgaagagcacaaattgtgaccctccatactggcaaggctgtttggagtactgcctctgttctcccctgcttttgggatgtcgaacaggggtgagtgttgacacctctccagctgcccggctgccaccttttgagagttctgctggagcagctgttctttacggatcctttggctggctctcccccactctcctcgcctctgctccatttcctctgccagaacacctgtcttgccatgttgtcatggcaggctaatctttctttgttcgccagtcacagaggagatggcaagaaagatctgtgggtacatggaatgatgaatgaaggaacaaatgaaaaaatataattgagaaggtgtctttgtctcagatctatgggggttggattgacccctgttccagagaaacttagcagctttttcctgacagttaagtaaaactctggaaaactgtctcccatgttttctgctcaggacgttgatgatgggacaggcagtgtctgtggtagagttactttaatataaccaccactcatgggtttcgagaacgttaatgcgatttgatattgtctgattggtttctcttttctccagctctttcgcctgcagatatatgtcaggtggtaaagctgatcccattagctctcagtattctccatttgtctagaatgtctttctggggaagggcaaatacttctttttcagacacccgtgtaatctccctgaatatgaacatgcattttctatagtgtttcttgtatacagttgtgtcccaattgattagtttaagggagatctatttttgtcatcccatgtgagaacttggaagtaatatatctctaagaacatgatagttagatctgatagcattctaatgctgaatctccatatagattaaaggattttgagggctaccctggcaacctcaacacaaattacttagcaatgatgtttggagcacagctaattcagaagttgagttgggtctgtcttcatcccatttctctttaccttactttttttccatggtagggcaaagttctcagaatcacacacatcccattcccctaaagccaggaatcgagatttaaaccctggaaggatcacctgtacatgtaaactccatgtggtctcatttaacatgtcaggataattttcaacaagcctagttatttctacttagtgttctaatcatagactttaatggactttgctacaaaggagccgacataacgagccggcctccccaggcctgccagtcccagttcatctggggcttgctgtgtgtcagcactgtgcatggcctgtgctggggaacagttgcttggaagaataaaacacaggtctcgcccccagacacttaaaatccagaagacctttgtttccaaaatgaaggaattcttgatgggttaaggaagcagagtcacagaaccctgaacagtagcactccttccatgggactgttctaacccgcatgcaaacctgcatccttggtccgggcccggcttctctcttccctccggggcagcacagcacatcctcagtgcagcactcccagcaccttgtttgtggctctcttgcagaccatgccactgtggaatctgatgatcagatgcactttctctgtcctatgggactgggcattttgctggctgggaacatgtctttgttcctcttcacaatcctagctgatagcttggtgacttctgcagatcggggcttgaggtgcatcagcaatgcctggtcctttcatgcccagtgaaagtcagtttccttcccacctctccctccctccctgcttgagacttctccgccacatttatcgccatggagtataccgggagctgtagctatttcgctttccctgtctccctccacgagaaggtcaacacaatgtgggcagaggtttttgtctgttcccgggcgggcaaactttcagtgcccacctcagggccagaagtagagtagatgactgagaaatatcttttgaataatgcttgagtgaatgaatgaatgagtgaatgaatgaggagtctgtgtgagtgcccttttgggtgaactgataacatgcccttttgcttctgaaagggaaaataggactctcacaattttgtgatgcgtctgtctaaatagtattcatattagcccattttaaatttcctcaaacaagtagaaaaaagatcagtcgtcttctgcttccgacacccagttttgaaaataaatagcttagtcttgcacctaaaccaggcccacttccgtgtctggataaagccttcctttttttttttttttttttgccctgaagcaatcctggtggacgtgttccaggaagaaacacccttaatgaactcagtggctttctttcgatggtgtggacaaattaacttttattggcctcgcagctccccagatgtggtgacactataattctggggaggctctggctgttagggaagttttaatgcttgttttcattatcaagaattaaagggtaacaatgctggtggatcgtggcaaagcatcacagttagcagggagattccaacctgggtggcgtcccaggggacgcaggggtcagccgggctccctctcctctctttctcccttggccctttgtcttccctgtcatttgcctcctttttttttttttttttttttttttttttttttttttttttgagacagagtcctgctctgtcacccaggctggagtgcagaggtgcgatctgggctcactgcaaactccacctcccaggttcaagtgattctcctccctcagcctcttgagcagctgagattacaggtgcccgccaccacaccccactaatttttgtatttttgtagacacgggatttcaccatgttggccaggctggtctcaaactcctgacctcaggtgatccacccgcctcggcctcccagagtgttgggattacaggcgtgagccactgctcccggccctgcctccttgtttttgttgctcctctctgtagccctgtcccagcaacttgtatgcttcctttttcacagagccatcatgcatgatgaagaaaatggaatgcatcagtattttatagacattattattgtcagaaatacatgcagatttggacagggacaaatacagagatgaacactattattaaggcaggactttttattttttagctttagtgccttttaatcatattttcataatataaaatcataacataaatatcaggaaagctagtaattattattttgtgtgtggactgcctggctatattataaacagggcaaagcttacattttccttccttcattcatgcagtcagggaaatactaagttgcaaaatgatgacaatgatacaaacaagtcatttggcccagaaggcaccaggagcagctattaataaggaaaacaactttttccagctgaggccgagttgattaacttattttcctggaggagagataaagcttaagctataatttattgaaaattaatgaaaatgaattttggtggcactggctatcaaactagaatgaaaataagaatgtgagtatactgtattaaaccaaattttccttcaggactcccatatttcttcagctcttgtactgtcacagaggttcgaatttgaaagcattaatgttgtcattttttgccagtggttctgatggtaaatatccacagagtcttttatctttaatttcttttgatgtgtgtttttagatcaagcttagttagcaatttttaatgagaacttatacatcttggagctttagtgctttgtttcaaaagcctgaccttgcatttgctttttaaacaaatgtctcagagctcttgttgccaaagactaaaatcttgaaattttggtgtgatcatttataaatttcttgatgtccagttatgagactttgctagggggataacctagtgctgtaaccaatgacatactgatagaaaaaactttactgcctttttggttgaaggatgctcgttgttagatcattttttcccccaggatctcaattttcatgaatgttctttccagcctatctttaaggtttatttttatattgcattgcaaacaatgcagtatcaaatgtttgttgttcacatggatgtggacatcaatatgaggaaggaagagccagacaggcatgtgacggtcctctgaaggaccactgatattacaaatggcctgtgaactgggttcccaggcaggttcctcaaggagagacgttgcatcctggcacccagatccctggacttaaagatcaatggccttgatttgtctgaaattacttcacagagaggattcctgttaatgattacagatccttcccaatacactttatttatgggaccctctcaatgaggggatctctgctgtctctagcaccggaaagatgctttctccagaagatgaattggcatgaaccctaccaggcctgggagggtaggagcttctgtagccttttcaagtaaaagggaaaatccagacttgcattagcaaaaaaattaaaaaatttaaaaaatgcctgcattttcttatttatttatttattttctgagacggagtctcgctctgtagcgtaggctggagtgcaggggcacaatctcggctcactgcaagctctgcctcccgggctcactccattctcctgcctcagccccccaagtagctgggactacaggtgcctgccactacgcccagctaattttttttatttttagtagagacagggtttcaccgtgttaggcaggatggtctcgatctcctgacctcgtgatccacccacctcggcctcccaaagtgctgggattacaggcgtgagccaccgcgcccggcccaaaaaaatgcctgcattttcattagttcatgttggttccccattttcaggggagagagaagatgagtgggccggtctgacagcccagatgtgaattctggcattaacatgtcttaccagctttttgaccttggagaaggtactgagcatatccaagctctagcttcctcatggagggcattcccaccttggattgttactctaaagattaaagaagataataccaaatggctggcacattgtaggtgcccaaaataggtgacctctgtaggtcatctgtatggggattctcatttcactagaacgctccctcagctccagtgggaaatagagctcaaaccatttttgcatagcttagcaggaattgcatggagtttttaaaattatttgaaaattagaacttgcatttcattttttttttaaatccaaattctgggacacaaatccataaattccataaatgttcatgccatgccttgaattgctcattttatctgcaaatgggctgtctggattgcctagtggctcggtggtgaggcttttattcacctaccaacttaaaaggctgaggaggtatttgaaatctattttggcattctgcacaggaagattatttaaattacattttcatgtatgtgtgatacctacatgaagcccaaagcaagaatttgaaatgtgttttatattctttcaaatatattttgctttatttttcatattagagatggaaagccttattattttttaagaacttaaaagtagtgtttacaaagttatataaatataagctataaaaaaggcttgctgtgaccctgtgaattaaatgaagaaaatgatagaaagaatatgaaatgtgcttcccatttcaaaatttcaaagaaatgataacttatatttggggtttcgaacttgaatattctattgcaaataaataaaagccattagtttcaacagaaaaagaaaagaaaatggcttccctgaaaacaattcaaaggattgcaaccttgcaggacagagaccaactctagcatttgtagtactgggagagataaggaattgatgaagtgtcaagaggaaaaagaaaacagaacagtgggatcattgcacacttttattgatggagatctgcagcgaggttcccccccgccccgaaacttttatgagtattataaggcagtggctgaaattgtgatgttctcagacatctctatagaatatgttcttggagcagaaaggagcctctagggcctctcctctcatttggaccatgttcctttcatatcaaaaaatgtagctcagaggctaggccagggtgaactaaaacaaaatccaggtctcctgacgctacatcagctcccctgcccgtgacaccaaatgaactggtcctgtccttttctctggaaaccaccaagacaaagcttcatgtctccatttagtgatcctcaccaccaccccccatccccaaaatacaccaccctgtaaaataaagcaagaaaatctcttccctgtgttcaagctcctcccctggcttcacctccctgaatcttagcacttggagggttgcttcccagtagcaaagtaacctcaaaggtagtaacttactgagtgcaaacatagcctgaggactgagaccctctttgtccataattcatttcatctccaagagaagcccaagaggcaggtattctcagctgtttgttacagagaaaagctgaggtccagaggggttaataagcctgtgcacgcaggtcaggagagggaaggtcagcatctcaggacctgcagagtggagagcctggtcaccccaccctatccctctcctgaatctcactctggaaaaatggaagaaccaagtgcatgggaggctgacctcagccagctggctggaatgatttaaaatgttttgggttatgataaatgtggagagagacatcgaaactgatttatcaagaatattagaaaatgaagtgctgacatttccatgccattcaaatagggagtgctaaggcacaggagagcatttggcagcaacaacctttttgcttctgatctcagctcagcgctgctttctctctgctgctcacaatgccctgcttttctgtgatgcatctggccagagccagggaacacggcactcagtattccagagaagagccacaagatcattttcaggactgcagaggctgttgagagactgtctaatgtcacccacctcctctcctcaaaattgggccattctcagctaaccaggtggaagactttgatctctattaagtgggtaggttttggcaagaacaacctaatcatcctgctagagagtgcatagccaaattgggatgggatcacctcactgtgcccagctttccccttggctcttggaggggtgagcctgggaagccaggaaatcagactctaagcccacaccttcgtgattcctcagcgtttatgcacagctgctgcagcggtgcacaattttccatgtgggttctttctgctctgtaacttaaatagtccccttatgcttcctctgtaattgtgatgcagtatttattctgtttgggcattggtaattagagcaaattcagagatttcttatcccctgacaggtctctctgattctgagtgatttgtcaatatgaggacataagatacagcaagtatatcatttctacccatctagcatcaatattctaggttaacgcaagtcacatcacgcaaacatgttctgtgatggctttttatttctgctgctgggagaatgagacctttttcatgtttccaagagatgctgtcatatacattatacatacatattaggtatatgtgtgtcatacacacacagagttccaaagcaggaccccaggttgtatgggctgatgaacaattaagcgtatatttgaacagcctgaatgccgatgaactgtgaacccctcaaaggctgggcccgaattcctttgactctcacatcccctcattgcctggcacagtgtccatcacttcagtgatgtttggcagaaaccttctaaatgtgtgaatgaatgataggccggtgtgcttggcagtcacacaccttggactgcctgcacccatattctggcctgaacatttttagctgtatgaatatggtcactgtatttacaaaccatatatcaggagtccataacctatggcttgtggcccaaatctggctaccacctgtttttgtaaataaagttttattggaacacaagtatgcccattcatacagattctctgtgggtgctttcaggatacaatggcagagttgaatcattgtgacaaagactggctgtcaatatgtatttactatttggccctttgcagaaaagtttgctgacctctgccatgtaggagctgaccctgagcccctgcagtaaacacagatgtccatgagactaagtccttacctcttaagtatgtgtatgtgcacatgaccttccattacttgttggctattcattgtttttggtaaagttgagcaaaccttggtacaggataccacacttcgtctgtattaactcgttccatccctcagctctttcttcctctctcccttgtcttgaacaccaccgtaagcggcaccctcacagagcccctgaactcagggggttcctttagcttctttttttaccactgtgtgcccgagacttgggagagctggcctcacaccaccaagaaaccaccctttctcaatgaggatgaacagaacccctgctgacagggaactgcccccatgatggggtggcagggatgatgggaggtgataaatgactgggtttgccacccttcctgcaaggtactagactctttgggttggtgtgttacttaggattttctgtttttaatcatactcttgcctttgctctgaattagtaaagtcacaaagccccgaagcctcagggtcttatcactacctgctggtcatgtttaagggcctggggtcctcttgctctctccccctaccccaagcctgcaggtaacacccagcaaatgctgagggaggcctggcccatagaagaatctgcttcactctgggcagtgacagattctgatcatgtgcttgatatcctcaagtaaagcttctcacgatcatttctggtcttctccaaatagcagagtatcattaggctgtcaccagccaatggacacttcaagagactaaatgtttggcgtaggaaatctaagaggcaaagagcgctgtcggggttgccacactgtagttgctggtgagtttacccaatgagccaccaagacctacaccccattggtctgaggatctcctgcccaggaatcccatagctgctacagtgaattagcactgttctaataattgattgggttttttaaatccactgtcccatttgccttgttcttagccttcaatgactcccattagtgacttatttaggtagcctgtgtgaccctgaacttccccagaagacacaagcataatactaagagctctgaaataagcaggataattcttggcattcatgcaagcccgcactgcataaagcagagtgattttagtgaattgccccagtgttttacaagggactaaaaggcgtgattttgcatactttttgcacatctaacctacttgcagaattcatcccactgaaatgctcgtaacaggatatgtcctttattcagcgccaactgtgtgctggttataagtgggagctttgtagatactgtatttcagtgtctaccacccctagttgatttcagacaaaattgaagctcacagaggttaacctgtctcagccataaacattctctgccgaagccatttggaaatctacataagcaaatgaaaataatgaaggagagtctcttacgaaaaataatttggaagctactgagagcggttgtagccagtgacacagaaattcctgcacaggttaagaactacagggaagcacttgcctgacaaactcaatagtgaaaagaagtcctattaaagagattttacaataaacatgttctaagaaacatacattgcccagggccatcagcgggattcaaagaatactggcttcccaaggagcaggcccatgacccctttgggccaggtcagaccttaagtatagtgtggaaatgtgggggcaagatttgtcacttgcattcaaactcatgggctccgaggtgcctgccctcactaggactcttctgaatgcagatgaaattctgttggaagcccctgtatgctttattggggtggcaagtggggagaggaactgactttccccagcttcaagagtgttctccagctcctgatttgtaggctttagaatattttccaagaaaagttccattgattttatttttatttttttgagatggagtctcgctctgttgcccaggctggagtgcagtggtgtgatcttggcccactgcaacctccacctcccgggttcaagcaattctcctgcctcagcctctggaggagctaggattacaggtgcccgccaccacgcccgactaatgtttgtattttttagtagagacgggatttcaccatgttggccagactggtctcaaactcctgacctcaagtgatccactcgccttggcctcccaaagtgctgggattacaggcatgatccaccgtgcccggcctccactgatattttaacttggtcatttgagttcattgtcgtatcatataataactatgtatcagtgtacacagagtgcattttcctgttttctttttttgtttgtttgtttttttaaaccatgagatgcaactaaaataccagcttcccagttcagatctggtacataaagtaagccctgtgaatccctcgttctaaagtcctagaacttgcccttcaagggattggttgggtgctgagtggagcagagtgttacatttttaggatttcatgagattgaaattggccacggtagcagtatttacaccatggaaatcagcagatgctacttcccttccctccagagcctgttgttccagatgtcccagcccagtgctggctgccactgctcacagctgtcactcctgggactctgtgctgtacccagggtctgggaagggatggagaatgagcttgcatcttatctgcctgtctctgaggctgcagtcctctcctatgttctgacatggagaagacgggtgggaaatttgaatttcagccaaattaatgaccctggggcattgagcaagagggggccccataaggtggccttgaattttggagcccataaggtggcacttgattctttgctatctgagtccagagggctctgagagagaggaagtgaatgttcccaggaacacaacagagacctgcctttctaccttccaccgtgagcttgtgctggcagcaactgaactaggattgattttaaagtaaaaccatcctttgtcttgatttaaggtgcccaagtcctcagatgcttaagaaccaggcactgtgccatgttctgggataccggagtgaatgacatttcgtgatgatggaaatgttccgtagctgcactgtcttatgtatgtggctatcgagcatttgaaatgtgactgctgtgactgtgaagtttcaattgtcattgagtttgaatttcaatagccacgtgcagctagtggccactgtattggatagagcagctccagagtttcagggacagtcttgtgtggcagcctgtgtgccgggcatataggggatgcattcatcacattggacgcccacaagaccactaagtcctccccagacccctgctccagcattgctggccagcaagatcaacactcatgccactagtggacatctacccattcagacacacctgccactaggctgaacacattagaaggtcaccccatgtcattccatcccctgtctgcaggacagacagtgatctcaacttacaggtgaagaaagaaggcacagagacatacagcccttgcccaagccctcagtgccagattcctacccagacatatcttagtaaactgagaaccacactgctagatggatggcatctcagagaaccctgaggatcttatttaaagcaatcttccatacttgttctaagaggagtgtaagaaggcgctcccatatatcgtacggttttcctttcttgtgttcgtgggtgttcagccctctcaggttcttctttgggcacacactcctgtgagtatgcacattagtgtacatatttcattttacaccatttggtgaactttatttcaccaaagatgttggcatctttctcttttgctgtctggtttaattcactaccaactatatcaacatcagtgactgggtcaatgtttgaccttttaatttttttgcaggaatgtggactactgatcagtaaatcactggtctcccccaccccacgcctgatgagtgttgcttttggatctgtactgatggaaatgggatgaaaatggagatgtaaacccaagactgaacaaggccttttggaaatgttatatggtgttagattacctatgaatctactgttaagatttttgtacatttggctggcagttctttttgcttaagagcatcaagctgtagacaggcctcctgcaccaagctggagcagccagagcccagggcaggacctgccccagcctctccactgctggagctgggcctttcacctcagcctccaccttaaggcaggaggtgtttcctccccattctttgcagtcagcaaactgtctaactcagccacagcaatcctcttaaggaaactttgtgcccaggtggttttctgtcctggaaatacattacttggcttatttcaggctggcttctagcttgctaaacccagggctcagggctcgcagagtgaagggtgcacatcacatgaggcaacagggcgctgcctccgatgttacctccagtacacaggctagcaggaacacagacactttcaaggggcaatgggcaagagaggtctcggcaatccaggcgaagtccgataacccccagacccagagtagaacaggctgctttgtatcagctgagcacatgccggcctgtaggaggcttccgcactggggagctcaagaactaaaaccccacctttaggtcatttgtttttaaagatgctgctgcacagtttaaacttcaaaacatgaagtgcaagatggtcttatcaacgcaataaagtactggccgtgaagttagtatcattctttctgcagccccactggacacatagggcagcccgtggggaagggcatctgtctcctaatcatatacagtcaggactggtctcacaatgcccattgcttctttgggttccaggtacagaatggaaaacacactgtctatgatgtaaagccttgtacagtcctgaataccaatattatttcaattatttattataagcaagtcagcatttacttttccaaatgtcacatgaaatttcctttctcttcctaatacgattcctaagaggcctgtggcctcttctcttcctgattctcttcttatttagaatagatattttggactggcatatgttgttatacattatcaatatcataaacctttagccctagcagaataaaaggaaaggtctatcaattcattctaagcataggtatggtttgaattcaaggccagaaagatgaacattaaccagaaagcgtatcgtgcaggatgcagtgacgtctagtatcataaaataatctgcgaccccttggagctcgccacgcccttagactatgacctgtttacggaaatgctggctttagtctcattacagacttgggtttggggctacagatggactctgtggtgatcagcctgcatagcttcctaagacatgggtgaacatacatacccttcccgatgggcctctcctttttccaactcctgaatgacccccaagagcactttgatggtttcttggcttgaactgatcaagttctccatcatctgaagttgtgctttgaggtcgaccacttccgtatgaggcacgattcgttggcattcttcacctgcagcaaccgctgtgggactaggctggttccccagccccggcggggtgtgagtctgcgacggctgctcactacattcgggggacaggcactgcatcgggggtgagcaggccagggcagtttccgagggcgcctggagcccgttgagatgtgtggctctcctccgctcgtcatctgccgggcagagtgaccactggctggcggctgcagagtctgacaaaccaggctcgggggccctggcactgagggcaggtgcgtaaacggtggcaacctccgttttaaacaccctcctgagggcaggtggagcgggctcctcggagtttggcctcccccggtcctgcttggccctcccgagcagctggtaatcgggctcttcggatggaggccgagtggagttttggagcgcagcttctccatagctgagcggctccgggcttttacagggctctgtgcagttgacccccaaaggctggtccactgtgttcatgtgttggttggaatggaaaaccaaggctgtggtcttgtgcacccgccccgcgccacatggccgggcctcctccatgggtccagcctcgttcttctctttcgcatctgttagaaacccattgttttggcttttaaagggatctgcagctgggaggcttttgaggttcccctttttgcggtccagagggaacgtctggtaacacttcttaaggtcgggcgaggtctgcacgcctgtgctcttggtgacgttggggatggacctgcgtgcgggcactgtcatgtatttgcggtaggctgctctgcaggacacgggcttggcctcccgcttctcccccagctggcccgaggacagctgtgtgtccctctgctcattctgtgcctcgcagatatccttaaaccgcacctgcagggctttgttccgttttttaatctgccggttggggtccagggcgtatttcatctccagggccaggcaggcggcgggttccacttcactctccgatgttgtgagtatgcatttgccggtgtccttactgaccatggttcctgcattcagaaacagcaacagaggtgtcagtgggacagaaatacacattcgagcaccggccgcacaaacttttagccaccacgacgactgcctgtttcctaattatatttaagcaggtgaggtcggcctttatgttaaggaaaatcacacgggctgagagtcgctggcagcacagcttgaaatgcttctcagatattaaagcctgcttgcttttccaggtgggatacactcgctttccttttgacagtaatgcatgtttccccattagacaaacctgttttactacattcatcaagaaacccaatgatgctgcctcttctgctttgcaaattatcttttcacacgcgtgactccccttcttaggcagatggtttaccaagtgctacttatttggtttgcgttttgactattttttgaggatgacgtcattaatctattgctggaatctgggagagctgctgttttaaagacttactggagctgccacgtctcgagcagataaatgtggagagccctccgaggaggaacggaaagaaatctatttgcgtgagccgttatggattccgggggagagttggccgtgctcctggatgggaaccgtgaaggagaagtcgtcgaggggtggtcgcttctcatgggttaacatcagctctaaaaggaacgtgggtttccctgcatctacaaaggccatgtttgcaactccttttattccatggagagtggtactggaaaataattcttaaaaaaaaaaataaaagaaattactcattctagaatcaagttttgtgttgtgatcacaacctccgaaaatgaaaacaatggtggtggtttcagtacttaaattctgaaagcaaataaaactatgaggctttatgttaatcatgcaaattcatcctgggctgaattattaaatgcagctaaaaagatgcaggtggccaatgactcctctcggggaataccagtggggtaaaatgccttcactttattaggcggattcacagctgtttattgcacatggaagaacttatttgatggctgcgcttaaagcaagaaaatagagttaagtgtgttgtttgtgagtgaggcttcgccttttccccccttgtgtttgagaagaaaacagtcaaacggaaggcactgagggtgtacggggcccgagtggctggagctgagtgcccagagaggcaaggtcatggacatgggcccgtgagagctgcacagaaacagacttcgtccacattgcccccagcccagctgccgaccttgtgccctgtcctgggggtgtctgaaaaaccagcccagagacctgtggcagcactcattggaaaatgccacaagaactatgacatgcgcagcatggccactgcttctggagtgaggtggttcgagtgccagatgctctgctcgttcacatacagaatgccttgcttacaaatgttcctgaaggtcaaggctacacttcccatttcaaggaggatactagggttcagagatgttgcgtcatttttcggtgtcacacaggaaataagcagcgcaggcaggagcaggaccctactttagtggaccgctgaatccatgctgttctcatagacccagctgtccaacagacagaggcatgacccctccccacatccttagcccttactgagttagcatgacaggccgaggtgcacggtggttccataagggggaagaagagacaacttcacagccaccatctaaaagtaagtgacatgactagccctctattaaaatgacctctatgtctcaggccagcctggtcttgtcaccttgctggcctccactgctgttcactggatgaaagagtgaaggaatcaaattcttcatacattatgctatgaacaactaacaggtaatcatgtgtaagaacaacaaaaaacaatctctgcagcatttgatttaggtgggaccagagtttctaaatcctggcactactggtatttcaggatggatcatttgctgttggaggggctttgctgtgcggtgcagggtggtcagcagtccctggcttctccccactgaagaagtagcaccgctccctcccagtgtgacaactagaaatgtctccagccattaccagatgagcctgggagcagagtcttgcctggcagagaaccactgcattagcccttgcacctctggatgcctcgggctcttgttcgattatcctatagtgtgtcctgaaaggtgaggcttgcgtagacagcaaaggaagtccttggtgctttactaggtgctgggggtatttggagattgctgcaatttgaaacttgaaaaactgggcagttttagagaggagagaaaaggcaagaaacagactggagatgcaccaatatcttggccccgtttgggatggctagatgataggtggaaggagggacaaggcgtgcctgctcaggagaaagcatcgatggcttttagagattcttatcccagcaggttaaacagatgcacacaagacagcttggtgtgggggacagtatgggtagcagtgggggtggaataagaaaattaaatcttaaccttcactctgatctcctattcattctttaactgcctttgttgtccaggtatgtcagaatgtattgtgccatcattctgcagaagaccttcatactagggaaaatttgaaagagagagcatttttacaaaaagcaatttactagtaatttatcagccttttccctgctacttctgaaaaatgtgtgtctgaataagtttgtcctgccatgctattcatcatcaccatttgctagggactgcactgaaataattttcttacatcagttggctggggtaagaaatattctaggtcttggacgcaaccatcaaactaatacaacaaatcagaagaattaattgctggtggccaaataataataaaaaattctaagctcttctctgttttatagagggttgctggtacataaaaatcatttcgttgttagtaaaaaaatgatggtaatacttaggatttttaatcactttagtttgttattgctgacttaaaaaacagtaatagtaattgagttcttattctctgatagggaaaacaccaaggaatttttgtggctggtttattttggcttcaaatgaggttatgagttctttctgacggctggatgacattttctaaagctttaaaattgaatttctggacattaagaattactaaggtggacacatcttttcggggtgttcatttgctctttattgggggtggagggtaaggcttacagtgattaccattaagaaaatgattttgttatgaaaggaaatggggcattctacagaggactttccctaagacaagtggaaccttctcccacactatttcattcatcattccttcatgcatttattcagcaagtgaatgtacatacgttacagtgtagcattaacattcagtaagcatgcagttaagtgctcctatgtgctaatcaaatgtcaccattcccctatgcatagcagttgtgttttctagatttgatcctcatcatatccttacaaggcagccactattgataccctcatactgcagattgagaaaccgaggcacacgattttgggattttttgcaacttgctcagagtgaggaggctagtgggccacacccattgaaacagctgaatccgtttgaatcacatgccctaacccactacccctgctcaaggaactctgtaacttgaagtgatccatgataaacttgaaaacatcaaacaactgaaactcatctgagcaatgcccttgtcttgttcccacagtgtatctgggtgctggttaggcaaggacatccaggtagttccggtaacacagtgggtgttggagcactgagtgaatgttgccttgaattctggactgagcatgaagctgcaataggattcttcatgatggcttgccttggctgggtcaccctagagaaccatggactctggtttggggagctgatctcttggctctaaagcagcaggagttcataaagtttatttttcgtaagaaaattgtgttttagaattcattggactgtgctgtcttgaggtgaaaatggctagtcatggttgtgcctgtttggctcgagagagctagatgtcgaggagctgtttggaatataaatgtcttaattaccctcaaattaaatttcataatcaaagtgagctgtaaatacataaaccctgcatttttagattagtgacggagaaccatctctgcatgctgctttaaattaatggctgatatgaaaatgtgcattccaacttaaataagtgaaaaatggaagcaacttaatggctaacaataggtaaacagttaagtaaattatggtttacattcactctgggcggccattaaaaggataattatagagattatttagtatcatagaaaaacacgaaataatgttaagtgaaacaaagcagtctacaaattatactggaaaaaaatgaacaaaaacggtcatcgttgtggtattaagatagcacattcggagagatttatttttccttctgttttccaatttggggagaatggagggaggtacagcgtcgttctggttttgccaatgaaaataacacaaggtaaaatctaatccacacctgaagcaggcctctggaaggcataaccactagtatcagaataagaaaaacccagaaatgatgagatggggctataagtagtttgtcaaaggtcatcttttattgttttgagggagccctgataaagaatgaaaatgaatttcaagtgtgtatatgtatgtatatatgcataggtatatacgtgcctgcgtatgtatttggctatgtatagttaaatgtttagcagaagatatgtcaatatttgagcaaacgtactgtaaggaaggaagttagcatctgttttaattagaaataaaacagactcaatagtctgaaggcaattttgtggggttccattagctgccaagagaaactctccattggattctgtccattcttaaaatgtccgtgctgatttgcaggtttgcagtttgaccctgtgatgggatttgtgggggaagatgcaggcagctgccagtctgaccgagacacctcccagggcccagcagtctccgcatatagtaagatagctaggcaagcagtcagaggagtgccacaagggattgtatgaaattatgggttttcctagtggctttctcactgttcagacaccttggagtcaaagatgctggtggggattcaagatgaactgggtcagcattttcttccatatgccaagggggtgcctgaacatgaggctactcagaatgggagaatggtgaaaatgaacatcccattcttcaccaccggcttccaccggaaggggaggtaaaatagaacctcactcactaaatgaagtcactcacattgtgaaatagttaacttagagacctgtttcataggtgccaattgagtcttcagaactggaagtcctcttttccttggggcaaagccagctgccatagatggtggactgtgtcttagattcattatccggtttaattttctttatatagtgaaatgttattttttccctacatttgttgttttcagcagaggtcactgatgaggaccaaaaaggggtgactggatgaattcagacacccttgtgtgactgagcaatgcgtgaggaactgttttcttgcagaactatggctccttggaggaaacacggagatggcacgccccgttccctcgatgtgtagaatattgcagtgaaacctctgtcattaagaactgatgaccacctagtccaaagcagggaaaaggggcactcacagaggttaaatgtaggcatcgaggcagaagaaaacctatcttaggttcagcccccactcatgcatatctgcggttttagaaaacactcttaacgaacaaaaaaacctatggtcagttgctttagccacataatgtaaaccacaaaggctcacactggcctacttcggggagtgagaacaaaggagggcaagcatgcatgcttggggcttggtgcttggtgctcatgttttaaaagaaccagggaatggccctcttaaatggtccagacttttaatttatgtttcactacccagttctttgattttcagcttatgttgatgttaacctttgctcatcctgctacattcatagagatgaattaccaaaattttatgatgttggtgaaaatcaactggaaaatatgcctccttgaaatgagacattatgtcaatgtaaaaaaagttttatttgcagcagttagctatgccagctaataatggccaaaaggagttcagtacagttggttccaacaactcaccaaaatcacctgtgagattggtaaaaggaactaatttccctgcctccctgtttcccatcatcatgacagtgacagagtgtgagacaggagggctgtgctttgaacacagctcatgagtacctttagttacgatagcaggtgtcccactgaccctggaggcttcctggtgatgaagcaacaatcagctggtagtttggggcccatcagaggcgggagttggcaggacacagaagaggtggtctcccttttttagacttagtgggaatctcactcacatgaaaacacaaagatacatactagaatgtacttggggagtgctttgccttcctgattatgctgaatctttttttttttttttttttttttaactaaacagcatgttttgactcatgatttatctgaaactaaaactaggacattgattttttcccccctaaaaatgacttatatcaaaggagtctgttttccctgacacttcccagtcttatttgaggataccctattggaacaatcagggcaggatatctgcttggaggtaatggtcactacaatggaagtcatttagagttgaagatgcagtctgtctttctggcaaggccatgggaatgcccatcaactcgaccatcagaatggatccctcttgtattttcatcgtagtatgaaaatgccacaatgtttctttggtttggccaaatcctaaactttgcatggtcttcggttcactgcagaggtagctgtgccaggaagaaaaggagacttgagcatttcttgtaatgagcttctattcctaagctgatagccaaatgtagagaaaataacctgcacttggggtccatgtacacaatcctaaccgaagtctgcagaaagagttagtgcttgtaatcttctcggccctcatacagtttgcagttcatggcctagtctgaaaagactgtcttggtttgaatgagctattcattgcaagtgtgcacagagcgaaattttagcattcataacacaaaatgtcatttttgttggggggctggtgaagagaaaataaacaaaaggtctatatattgtatacttgaaactgtatattttattccttaaaaatctacctcttatcaatcctggtgttactctgccaggttagttggttgtttaatttttcccttgaccagcagctgttgtgaacctctgtcttctctgtgcatgataataagtagctactttttaaaaacatgaaaccatatccttccctcacaaagtttcatctaatgtcttcgaaggtttatctctttgtgcatgaaaaacttggcagtgtctctggtaatctggaggaggaggactcagtggtctttcttgggaagcagtctgacatgatgtaatgcctgagacccaagggtggcctggactcaacccagcaacacagctactgtgcttaccccagctgagcttggagcaaaagacaccccatgttaaaggcaggactggacttggtttgcattggggtcacgagacccatctccaacttagtagattctgtcagtatttttatgctgaaggcttccaacaagtgctgccaacggcttgctcaattcattccccccccagtctaatcccccaaatcagtcgtcaccatgccctattcgtttttgtttttccttcctgttgcttctcctactgatttcttccctttagttccacactgttcccaccctgatcttggccttcataactctcctgccctcagctctccattcccccatgccccacccccgtcccccatcctgcaggtcctgctagtcttggcttcaagtgcacacgtcgcttctctgtgcatatacctggatacatcccagttggtagcacttccaaagagtctcttattataagatcatctatactttttcctacctgctcatctttctagatttctcttggctactcagaaatgctccatctgctgacttccattaagccatttcctgcactgtctcctgaacacaccatggtcagtctctactttgtgtcttcacttccactggttcattttccaggaccgcgccctggtcctccttcctcatggatagtctgtgtttggtggtctagatctagtcttatcttctatgccttctccagtccttacctgtcaccttcatttactcactgaacagtgcatgcctggggtgacctaggcaccatactggatgctgggcacacaggaaaaaacaaggcatactctttggcagtgtctagtccagcaggagagagacacgttgatgcctgacaccagtccactgtgcacaagaccatgtaagaggagggaagtactgagagtgctccctggggagtcagggtaggctctacctgggagatgtgcaagagcaggcctgaaggatgctcactttgctttgctttgtgtcggttttctctccttaacacaaatataagtgttctgtggagtaggtccctctaagtcttcctcctatgctcagtcatccttctttacttactggtttaagaatcttaacactggccaggcacggtggctcatgcctgtaatcccagcactttgggaggctgaggtgggtggatcacaaggtcaggagatcaagaccatcctggccaacatggtgaatcccgtctctactaaaaatacaaaaattagctgggcgtggtgatgcgtgcctgtaatcccagctacttgggaggctgaggcaggagaatcgcttgaaccagggagtgggaggttgcagtgagccgagattgcaccactgcactccagcaagagaatcttaacactatacatcacagtatccttagagctgggaccttagctgagatacagcaagaagacttaggatgagtgtacaatattaatggcttccaaggagtctttttacattatctggatcctcacattaggtagaacctggctgtataatgaaacatgagtaggaattagagaagtggaaaggagaagggatagttttgttcgttgaggtaaaaccatatccagagatctttatcttctgaactttggcatgactaccttgagtggttgttgtacaaatgtttccggtgctgatgggagagaaggagatggcacacacactcacaaaaatgagtagatggcacagaaatggtacaggttctatatttaaccatgcagtatattggggccccatactgttgtagaaaatgtgacttgctaggaattatcagaaggtttgttcttatattactcaactttcttcttgggtactcccaagatatggtagtggcaaaataaattgagtttaattaaaaaatctcaatagcttggaataacaacgttttagagcatggcacctttcctaaactcagttgtctaatctgctctagaggatgaatcactggctttcagagggaaaaaaacaatagagggtctggggcatacccagggttctagtgacttccaagggtgtattagtccattctcacactgctatgaagaaatgcctgagactgggttatttataaaggacaggtgtttaacggactctccgttctgcattgctggggaggcctcaagaaacttaaaatcatggcagaaggcaaaggagaagcaggcaccttcttcacaaggctgcaggactgaatgagcgcaagcaggggaaatgccagacactagacatggtggtgcgtgcctgtaatcccagctacttgggaggctctccttaacacatccgatagacaaccatcagatctcctgcgatttcactcacaatcatgataacagcatgggagaaaccgcccccccgcccccccccatccagttacctccacccagttccacccttgacacatggggattatggagattacaattggaggtgagatttgggtggggacagagagccaaaccgtatcagaggggcataaacatatgaatgaaatagctttcattttcctgttctttagactgagaacaatgaatataaaattatactaaataaggaagcgcagtacttaggaatctcatgccacactgctgttgtccattgagatgaacgtggagaggaaggagaagggcaatggggatgtataaagagagagaggttgttaggggaacggtgagtcgagagaaatgcacagacaaacagacacatgcacacacagatacaggaggggaaggggatgtgtgctggaacataagtccaggtcagctgtgggacatctgtgggctgttccttgaatcaggcacatagagttttgatagccttcagccatgactcccagcgttttggttgctcttaaagggccagttgcagcaaccccatctcctgtccagaagggaacgtgacaattcaccccggggcaaaacaagagcccaggctcgggcaggcacccaaagcaggacatcatacagtttcctgttctatgaagcacccaacacataacacattaagtgttaaactcaatgaagagtcccattttcagcaaatattcctgcgtttgcctctatctttttatctctccagcacctccttggaacagatgccctgctactttacaaggcttgtggaaaagagaaagagaacagtagcaaaagcctgtgtagttcatgaatagaagttagcatcgtagtgagtaagcagtactgatgatctgtgaaatgattctctgtggacttgagcatgctaaaaagatcttgaaaaaggaaaacataaatctttccaaaacctcacatgacccctgtatgctttcgccttcttgaagctttggaggagagcataggtgtggatgaaatggagtcttttaaaagttgttttggtttttgtttttgtgtgtgggtttttaaagagagcatatcctgccacgtagaagaaaatccagggggtggctgtcctcctacaggaaggaggtaaacaagcatttttccttaagggctctattccctcagcctcgctccctcgaaggccacacttggaggccaggaagttaatccattaaaaaacaaggagaagaaagagagaaagaaagaaagaaagagagaaagaaagaaaagagagagaaaagcaagcaagcaagcaagcaaaagcaaaagcatattggtctctaccccagtccaggtaaatcagaacttctggaggatggagactgggttccactgtttgttttaaatacctaatataattttaataatgcacatacgataaagaaccactggccttcttcctttatctttttcaccctttgttgtcttctatttcctgctgtatctccaaagcttagagaagtttgtggcatacaaaaagtacccagaaatattgactgaacgaagggcttaatgaatgagtgaatgtcacgggggagcagggaggttgagccccttccatttttttctagaatgaacctggacatcagccaggtgttgggatgatcaccagcagatcccacacaggcccacagagtgtctgtgccctggcctggctgggctgtgctgtgcacaaacagatggggtggattcatgttccacagaggagagagctagtggccagttattgtcatggatgaaaatccaggtctttcacaacatccattaattatgggatggcaaattccaagtaaattgtcactgagcagacccatagtaggaatagggcatattcacacttttttttatgtatatatatttctggttggagacgcaaaacatttagaattctgttcccttctagaaattccatggcttggggcagctcttttcaaccatggatctggggtttgagaccagtcattcgtacattgacagtctttgcacagtgaataactctggaatttctgcattagagagggggtgctcaaggtcttcccatgctaccatggtttgctaacgtggttaatttctggccgtagtccttacgaactggggctttgagaccacctgcttggatttgagttctggcccttcccctccacttaatagcccagaactctgggcaagtgatctaacctgggagagcaaagatcagaaaaggtaacacttgtgtataacactcagcacaagctaggtaccgttctgtgctttgtgtatgtctgaacctttcattctccaaacaccctctgaaggagaaattactatttgtaataaagatggggaaacagaggcacaggtagtggagtcacatgccaaaggtcacacagatactggcagagccaggagggcaaaggaggacagcctggcctggagcctgttaccgcaccaccacgctgcactccactgtgagctgggtcagggctcaggtggtcggctcctaggaagcgctcagtacacagccctggtgatgaagtggatgtacacaaagacagcacaccttgggatgtgttgtgcatgtggatgacactggatgcaggacctacgagacacaagcttgagaatcaccaccagaaggttccaaccttgagtggctgattaaaaactgtacggttgtcttagacttatactttaaagctgcatttgctagtggtcactctcactgactcttcagatacagttagaactgatgcttccatgtggaattattttaaataattactaggagtgagttggggtccagtctctgccactcactcagtagttgacctgcccagtgcagtgtggggccaaccctgccagtgagcctgggcactctgtctgaggctccagtgtccagccacctgctaacttctgtcattcagcctcaccctgggtgtttttgccacatggacaaatgtgatagacacaataaataaagtagatatatattcagaataaatattatatagcaagactaaaatataaatagcaagtgcaaaacaaattaaatgaggatatgaatgacttcagtgaagccactgagctaacaactacctttaaaactaaaacagtaagtaattgagaaatgcagttatcattgggcaagaagtcaaatgaaaaatacggtttgaaagtgaacagcatattttcagcattcctttaagttcacacagtacgtttgcacatggcacattatctaagctatgggagtctcaagtgcacggttaagtggacactgtgcagtgtgatttacgcaaggaaaaaaagacaaaaataatctttatgcagcgctgtcattgatttttaaaatgataaattggtgggtctggcacagagatcaatggagttgaagtcacgacgtcaaattgagatgtgaggttaaggctgagagacagacatctccttctctcatgctggcccgatgaactctccagtttttttggtgagctctggtgaaaactctttttaacccagaatgtcagcatttgggttataagaacattaatttatctgactgcagtgagatacattttctcaattctccttatttgcttcttttaccctaatactaggtcaccaaattcaaagacattctttctctaaaaactcaacttctacccaactgaattttcaccaaaggaatcgctgaggttgagtttggtggtaaagaacccaaccctttggtgcttttttcttttctaaacactgcatggccagacgtcagtactgttcagccctggaagccgtcttcctctttactgccttctcacggtgtttcctttaattcctgctacacaaaaagttacaagtggaaatggaagaaaacaattctttcccaatcaggattccctgagttggtagcaaaatcactggctaggtttgtgttagtagcctcattaaatatttattaagcacctgttatagatagtactatgcttagtcatttaaggatttgcgctgtgaatcgcttcatccaatttcctcctatttcaaagtatttcttgtggacattctaggaggtaagagataatgaaaaacttattttttaaataatatttccagttgaaaattcacactcaaatatttaatagaaatcctatcttcccccccccgttcctgctggctcccagatttctgttgccattaaaatcccccaccgccttgctggccttgggtagcatctttaatcccttctttctatcttgccacattacaaagacttgtctgccagaaggttttactcatagctgccccctaacttacttcccagtgctactgagactggcacattctcatctgtgacaccttctcaactggtctccaactcctctcctctggtttgcctctagttataccgccttaatcttctgagaatatatgttcttgtttcaaacatcaacagaggaccctcttgccctgctggttcctcctcaaactgactccagactatgcctccactctctgattccagcacctcaacctttgctgaatgtcacttctcactcttcccatacaagtctgtagccctgagcaccctaccacttggcttaagctccaggactaatgtctgctgggctcaggagtgcaatctcaagcatcacccacgaagtgagccggggcatcactctctgcctgtaatctcctatcctgattctacctgggagtctttaggctcctgccacttccttgccacctcctcccctcctcctggacttgagcttcttggagtcctctcacttggtcttgtaacaccttacacattgccttggccactgctgcaacagctcagtacatatccacaaatcagaagtcctctctgaacaaagccatctgcgtatccatctaccttccctatgcttgccccatttaaaaatcccaggttttatatctttgctgcattttttaaggatgctaaaatcacttactacaaaaataagcagatttcactgtacaaaatgcaggtagtaagaggtatctaaaatgtaaccactaagtacacatagaaaagatttttaaaaacatgaagaaggaccattgacaaatacaagatccttcctagagaagaacaagggtgggggatctcacatcaccagtggaatgacctagaaacacaaagactgctcaatttcattaaggttggcagtgaataggatatagccccatgctgcttcctcaactgaacagctgtaaaaaggccctcacgccatcagcctgtgctttttcctctttctctctgggatgtgcctgtccatggaacccctgctttgggatatagctgtgatcatctctgctgagatggagtgagagcaacttttatttgcaaggctgcctgtagtattttcagcattccgtagcctccttcccatgtctctcatatgttgtagtttactgcatttcatttcatggccaaagctagattattaagggctgaactggaattttccatattaagtagaatataaacttcaacaagcattttgatatggtggggttttcttttgtttctttaccattctattggatagaatagtataattcatatgaatgtatgctgtgcagagatgtaagactctcttcttttctttttttgctcaaacttcctaacagcaggatagtgtggtaaagagaacatgtctatggatgtgcaatactttgaataaacagttcagtgctctataaaataaatattcacaaataatgactttggggagagttatttccaaatccctttgaaatatgttgttagccaaaaggtttatagagtaatttagaatcataattcctgcttgtccctaatatctgctgttctacattcaagttaattttctctcagtcccaattagagctgggaatacatactcagcagaaagagacacatttgtcaggttagaatgttttgtttttattcaggtagtgatttgtcatctgataacatctttatacacctcaaagtccctcaacccattcattatggtttgaataatgtctaaagcacgtacgactcaaatgcacactgaatatcctgtgacttacagtagaggggtctctgaaaggacttgaatttggagccaggaaatgtctctgaagttatggtttttctcaatgtgagaggtaagatccttggttgcctggagataccttagttagtgccttcaggatctgaaacagacacattatcacacatggtccaaaggttcaaacctatcctttcatggcttagtgcttaacacaagacattgtccaaacaacttgtttacagcaatcctgtcagggtccctatagtttggttcctgcaagtctgtattctgtccttaatgtataagaacaatgtacattttaaataaactgattaaaagtcatgaagtttcactacatatatatcataggttagctccagtattggaataaagacttctctcaatgtttgtatgagaatttcatggtaatgaaagtgtcgtcatgtagtatcaatcatattaaattttgctttaaaatattgaagtcaccccataatgttatgaaatattaaaatcaaatatgtgagacaaaaaaggatctgcttcataaatcatgccagctaatttctggttggggaatgtaggtctccaaccagtggaatcatggtggggaggggttgtggtgcttcacatttatgaaagactgttgaaaatgacgatgacactggttttatctggggagtttttatgacctcacactcccagaatgacggtggtttgcctcaagtatgtagaatttgcctgccttcccaactgagcttcttggatgctatggatgcgttgaacagcatccttcacaagcgttaaaatccgtggtgaacctgtcactgccctcctacgtaaatatctgaccacagagctgctgctttgggaggtagctgtgatcatttctgtatcatgagtctctgagaagcataagtcacctgcttctcatattccagagttcagtagttgtctctaaatgagatagccatggctgggcgcaaacaagagaatacaaatgtctacgtgaacgggtctgtcctgccactccactgcgatccgttgttatttctgagaatcattttgatttttggactgcttatttcagtgtgtaggagtcttccttgtagatgaatgcctttcacgtacaagtctttctcttatttattgacttatttaaaaatttttccctacagagggagaaacaaaacacaaaaattccctttcctgccacaggggaaaacaactgtggcaaaacagagaagcccccgaagtaaacagagtaatagagtacccagcctcccatagagcttgcagaaatctcattgtgcagacatggagcttcccagcttttgccttgttagcctatttcttaaccagtaattctgtttcttaataggataaagggcctgacttacatgaaagctcaaagtcttaatcacaatgataaaatacaaagtcgtggcaactgtaataagtttaaagacatatgtagcttttcaaggacatcttgtctttaaggaaaagtctttcatttagctaaagaaattaaactgaattgtttagtcttttaaacaaaatgatgaatttagtgaagaaaacaaaactctccatggctaatgtaatttatgcaaaatcatgcaattagtgatagctgtgctagactttttcttttccttaaccaaatgcgcctctaataaaaccatcgtgaggagcagtgccatctaatgtaagtagtaaacatggatagtaaatgattaatatctggtgaggcatgcagatggcaggacttccattttttctttgagctccttgtgcatgtttgctaatcattcttgcaaaaaaattgcaaagataaatatgaactttcaaaagtaacattcaacaggatatgaatgtaagaaatagtacagtgtgggggaatagtaaaaaccagcactttccgcctctgcatagtgaaatgacggtaacttgctgtagcgtaagcttaataagggttatatcattttcatgtatgtactactctgggaatggcccgggtcttgtgagtggtattttttcatcaagtacccagccagcgcagtcaccctgacagtccccccactgagataaggcatggaaaggtaaccctctagcaagtcctcgttgaggggggagcgttcaagtgcacagacgtctaccctgtgctatcctgagctgtagtcttctgaaatgatcgtttcgcttcccagccaaggcagggctcccccaaagttcattcccactcttgcagtttcacctcgggatgcttccgcagaatttcagcgcctaagcagacaaggtcaaagtaaaccgcttcgctgcttctggcgcaggggcccagagcgcgtgcagctccccagcacagaccaacagcaggagaggggtccgggcgggagccctgggctgtagataagcaaaacgcacccattttctctcctatttactccagaggcacctctcctcccccactcctggcatctctttatcactggctccctctccctgtggcatatttttgggtagtagaatgctgaggtcacagggagcggctctttatccaagcagtggggacatcagcctggagccctgagcatgaaccagcaagatgcagactctcgctcttgactttgggctccaggagctgccccgaccccgggctgcccgcgggctccctcctccctcctgccctcgcccgccagctcgcagtctcttaggtctgcagcgttggttggtttcccacgcctgtcccggtctgactcgggctgccaggcaccgggaagccccgcggcgccgaccccaacccgcagccccgggaaggtgccaaccccagcgagtggaggagacgagcatttcacgtgggcatctgccttcactgctgctcgcgcctctcctcaacggccggcgtcagggcccctctgttccaactcatcccccccccgaagttaatcagccgtacttgtactttccagggcgctttagtttggaaaatacttaaaagcctcgaaaccttccggggagacggccgcccccagatctcccagttttgcctggctagggctgtcgggcgctcacgaagctgtggcgtctgtctggaacccacatcgcagaggcgcagccccgctcctccctgacgtcgccaaagttgccagacgcccctcagcgacccggtcgcgccagatgcagttgcataaccttgccccccacctgcgaccgcaccgggtccgctcccggctgcaccggggtgtcccggccccgggagccgccgagtttccggccaagccggtttggggccgagtgtgtgcgcccgaatcggggtcggcgcccgtcccagcggtgctctgcccgcggccaagtacgacgggcgcgggggcgcgggaggagggcacgcggggctccgcttaccttccgctgcttacagataagtcgaggtcgatgcagcgcctggctcgggcatgtctcgctgcggaccctggcagcctggggcggcacggagcactccggacagggcatccgcggccagactcgccgggctcacgcggaggaagcctcggctccggggacttggcccgctgcgcgcctgctgcccgccccctccaccgctgccggcccggccctgctggcccggccggcccccgcgccgcagctcgcgtcgctcgcgtccctccggccccgcttagcgacgcgcgcggggaggcagcggctgggccagctccggggacgcccgcgcgctcgcttgctcgcgacgcggcggagccagccacagccacccggcttcgcgctcctccgatgtcctcatttactgcaattgtcttcggcgagatctcagagccagggccaggaggcgggggcggggcagaggagggagcaggagggaagtcctttccgctgctccaggtcccagctactccgcggagccgggcggccagaggcgagggcgccccaagccgcgcgcctgccgcctgtgcgcccggctggcaccgaggcgggcggagccccgggccccgcggggcggaggtggggcggcggcggcgcggagccgggccgggccgggccgcgtgcgtggggtggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtctgctgtgccagccagcctggcccggcggggctttgggaagccaggcttgaaggtgcgtgtcttgtaggtgcctggccgctcacctgcggatgctgccttgtagaagcaggagttcggggatcctttcagtgctggctccaacctggtgtcagcctctctacatggggacaggaggtcctatgagtggcctgaggactgaagtgggagggcctgcctggtaatgttgcatgctgacatttagggacactccagagcaggcgccactgccactcctagccaggaaccctaccccccctccagagcacacaccacccgtcagcagaagccacagggcgcagaggctgagttcctttgtggcagagtagaattctcttgggagaggaaaagacctaggatgcacacggagctatccccgcccttaatttcccacccaccaaagagtattgggtgttttgagctcagagcagcagacccaggggcccctctgatgcctgtcaggccctggggtctgggccagggactaagcagccagccgagtgcagggctcctggccccctggatttgctcctagaatgtaatgtaaaatgtaagtagccacatttattagtctgtttctcaggaaaggtcagagaagtagtggaccccagggaagggacaggcttcggagaggaaattgggaggacaaatggaaagtcccttcacccacccacctctccagacacatcagtgggcagtgagacctctttgcctatacatccctgagtctctgcacctagcaccagctctgtgcctgtgaccaagccatagctccatccttgttcgctgagctgaactgagcctatcactgccttatagagtgtctgttttttataaatgactttatacgaaataccttctttgtatgtggatgctttgggcagtgtgtccagacatttcagaagaaaaaaaaatctaaaatgtcatctatttccctctttaccccgcagcatcctttggtatacaattttgccagccttggggatccagatatgcccaggacgggagtcctgagcctgtggatccaaactctgcccacctcactcttcttgttgttcttcttaactcagatcccccaagctgattttccagcttaccagggaggctgttgggagctggctggaaagagatgcttaattttgtgtgagcagtatggaaactgcagtcccctcttctgcctggaaggggcctgggaagggaatgtataggagttggggacgtttaaaaccagataggagaagttgccactctccagcatgttcccttggggatgtgctgttgcagctgtgggctccagtaattttcccagtggtctggggagcttctgtaaatcttactttattggcaatccataaaattgaaatctgccttccgtcttttaaagtgactgtaaataaagctgccaggaaacttgggcattgggctggtagtatcagaaggctgaagttttccgggaccaagagtgaaaacaggtcaacataaatgcatgcccagcaaggcagtgctcagccacaggtggcactgtgaactggcaagaaaacagctccaaggacagtgctatctgagattcgcatgatgtataactccaggaagaaaatggaaagccgtaattggcaggttagaaaatccacttacatgaagaggagagtataacggaattctgtagcatcatcaggactgcttagagttgttcaattgtgtagtagacttacagttgttttgctaagtctattaaaatcattggcatcgcttcttttttttttttttttgaagtaggaaaccatttacatattgtagtgcttaagtgcatgtcttcagcatcacaaatcaaaatattggtgaaaacttgcctcaccttacctttggctctggagagatattccacatgggtgaggtgtgtgtcatcatgctccaggctttaaagcaagcatcatgctgggggctggctggagagaagggagtttcagccatcttcctgcccacagatccctcttgcatttttttttaatagatgggatgtaggcatatttttagggtctagaatgagtcaatatgctcggcttcctcaggaaaaaaaaaaagtgaaacttgatagattcattttaggaatcaattggtattggctttttatattttgcttaagatttttgttgaaaaagatagacttgcaaaggagaaaatagctacttttcaagtgggatttcctaaaagcagaggaataaaaataagggaaagttcaagacggctaactaagcaaaatatccacgtctctcttcttttgccttcttcttggaattgtgcaggggttgtacagagaattgctggaattccacccctatggtatagtgagtttgaggtctcaatttccacattaaaaagtcaagaatatacaagtcaaacatgttcaagaatgttcataacaggtttatctatatctgttccaaacgggaaataatccaaataccagtcaacagtagataaagatttcttggttcttcgtatagtggaatactagacagcaacccaaaagcactaactgctgatgcatgctttggcatggagggcttctacaaaggtgcagaacaaaggaagccagacgcccagtgtttatgacatgattccctttagatgaagtccaagaatgcgacaaagttatcaatggtggaaaatatcagaatggggattacctttgaggcatactcgttgcccgggaccacagcaacttcactggtgctggatcattctgtctcttgcactagttgcttatgcagttttccacctatatagaaattcatggagatgcttcctgtctcagtgtgacctcatttgtctgagcatcatcactgtgtcattgcaatgtccacatgcatgctccccaataacccttacccctcagtgaaccagtgtatctgtcagtgtgattaacctgtatcctctccagtgtgcaaggcaggagaagagaaaagtgtctccaaactagcaactgcagaagaggagccttccagtttagctacacagcagaacttccttctttaggagactgccgatgaaacgcctgccctcccaactgtccgatgtcgctgtgacagagctcgctatggacgtgaatttttctttcccatgtctttgttacacaaaagcggtcccgatccagatcccaagagagggttcccggatctcacacaagaaagaacacagggcgagtccactgtgcaaagtgaaaacaagtttattaagagaataaagtagtgaaagaacagctactccatagacagagtgggacattcccaaaagtaagaggaggaatgcgtccagcctaggtacaatactcatatatatggggagctctgctctgctacgagggtttgtgataaaggattaaatttcttaattattatattttgcaagaatcgatattatctgttttcgtttttgtttttgtttttgttttggagacagagtttcgttttgttgcccaggctagagtggcgtgatgtcagtttactgcaacctccatctcccatgttcaagcaattctcgtgcctcagcctcctgagtaacctgtaaccacgcctggctgattttttgtattttagtagaaatgaggtttcaccatgttgcccaggctggtctccaactcctcagctcaggcaatccacccatctcagcctcccaaagtgctaagattacaggcgtgagccactgcgcccgatattattatctttaaagtaaaattaggaacgcctttgttctcaggatgtctggatattaggacactcccaagtctgggtctgtttagtaaacatcaccagtgtgttcccttaaccttaaacatctagaggtgaggaatgcctaactttctaagaatgcagcccagtaagtctcagcctcatttctctagtcctcactcaaaatggagtcgctgtggttcggatgcctctgacatctgcatattccaaagagactcatagatgagcccaacctaagtctgtgatgggcaggttacacccgtcagttcagaagctgtggtagcagatcagccagtgctcaacgcctacgagggaaaagtaactcatatcgccttcgacctgtagggtcgagatcattcccttggggacactttagccttgtctttcaagaacaagacagacacaatcctcaaggtgccccagtggggcctccttttctgccgagaagccctgcaggaaggctttctgcatcattccccttgtcatattctgctcgagccttcactctcctctttctgggcttatttctggtttaagactctcgctttgtgtaaagccccttgcccgtggctcttgcacggtcctggcagccgagccgtgtttccttctggtgggaaccagagctgtttctgaggtgctggtccatgttccagggccatgccactcctctggctttcttttcctttcatggtaagaaactagagatggtttattggcctgaaatacaaatttgttttggaaaacctgagcatcgtgaggactcgttgagatccctggctttctatgatgcatcattgtgaatctgatttatccacagaaatggaaggttttccttttgaaagagagggaagtagctctaggtttttgtttttttctaatgctccctgcaactgaggcagtgatgtatgggaataaggaagagcaggcgtgcactctggctctcccctctcccctcacaatccctcattttcagggctctgagcaaaccccaaggctttcccctcccaactgcagcctctcctttcttttaggcggactcctggggaatgaaacagaaaccctttattttgttgacctttatttggtcagtcttgggtgctggtttctatagggtttcttactatcccattctcgtcactggggagccaacctcttcagcacaggtagatggctcaatgggcttgtcttaatccttgctggtaaggccaccagtctcattgagcctgctgaagccaccttctcataaagtggctgacatgcccacagagagtgacacttctgatcagaactagggcaggaaggagccaggcacggtggcttatgcctgtaatccgagcattttgggaggccaaggcgggcagattgcttgagctcaggagttcgagaccagcctggccactatggtgaaagcttgtctctactaaaaataggaaaattagccaggcatagtggctcatgactgtaatcccagctagtcggtaagctgaggcagtagaatcacttgaacctgggaggtgaaggttgcagtgagccaagatcgcgccatggcattccagcctgggtgacagagcgagactctgtctccaaaaaaaaaaaaagaactaggacaggaaggggtaagaatggatttcacacttgagtttccacccaccagcgctgtgtgctggtgctggagctactggctgcccttcccaggccttctgccccggtgcacaggaggcttttctttagggagctgctgcagggaggcctgcagtcttctcccagctggggggtgtaggaacttccttgtttgccctccatccccaccttaggttccacaggcatggaagagggatggggtaaaggggaaggcaaggaacatggaagcctccttgttgtacttttttccttccccaagccctgactgaatatgagacttcgatgagaatgatgctccgcttcggttgtgcgcctccagggtggcaggtactcggtccattgtggattatatactttggttcttaccagataactgggcactcaatactgttaaactgtctccacagatgtggatcagagaacgtaaatgatctctccaaggtcacacagctaggaaggggtggagcctggattcaaatccagttctgtctgatgcaaccagaggacagattctgaccaaaaatgccaactgctcatgccaggctctcaggaagctgatgctgcgtccaggctggctggagagtagctttgaccagcattcttttgtcgtcattagccgtccctcattatctcactgtattagttacactttgaaataaaaacaggcactgaaacagcaatatactcaaatcattttgcatttcgatagcactctaagcttccccaatataatttcagtgatattctcacgttttcttcgttgaataacagctattaaaatgattcatcacaatatacgtatcccatctataccacaagaggccacttcacacccttctggtgccatgtataatggcatcgtattaccatggccttttgattatcttgaacacctctttggtgctgtcatttgctgagattcagtcatagtggacaggatatgtgtttttattttttttaaagatgactaacacactgtgcatataattctaattacctacccttgacattttatgcgcttagtgcaataaattattttgctagtttggtctaagaattgacgacctgactttagatgtatttatttcgcagcgtggctcatgggtgatgtgataacaagctatgaaacattggaaagcaagcattttattctttaacaccaagttccaaatgggaaaagtacagaattaaaaataaaaaaatctctagttatgtttgatgacctctgagttcctggaactgtcagttccatgttttccgtaaacgtttttttttttttcatattattgagtctttggagaattaaacagtcttcgctttaattgcactgcacggtagggctgcggatctccccgtgtccaattcacctaatttgtgttttggcacattctgcagctgtgccatactctaaatgtgtgtgcacccctcacttcggggttctcatatattagtccactaactaaagttaaagtaaaaaatcaaaaacttattttaagacatttcttacacaattttgattttttttttttttgagattcaaagaaaggcagggaatttggcttgtaaatgttgcttaatgtttttttctctttttagaaactccagtgtccatagtttaaagtgaatatggctagaatgttgtacaaacgctcctggcttcatccacatccctgtatctcggcagtcacagctccctggcaccttctcccccttgcctggacggaggcttctgagtgatctcctaggccttcctagattgagaggggaaagggaagatcttaagattccagaatattcatttcatttaagcgagggaggcaaatcctacagagctttttcccatttgtgttcatttattggctgtttccgtggattcgagaaagaaacttgaaaatctgttttgttttgtttggtttggttttgagatggagtctcactctgtcacccaggctggagtgcagtgatgtgatgttggctcactgcaacctctgcctgccaggttcaagcaattctcctgcctcagcctcctgagtagctgggattacaggcatgcaccaccacacccagctaatctttgtatttttagtggacttagggtttcaccatgttggccaggctggtctcgaactcctgacctcaagcaatccacctgcctcagtctcccaaagtgctgggatcactggcgtgagccaccgtgcctgaccgtttttttaaaaaaaaatagagatgggcgtttggaaactgagtcactcaaaaggtgaagtagctttgtcccacagatctgttactcagtacaaagttgaaaggaaacctaaattcattttatttgtgtttccagtgtgcatcccagacatttgtttcagaatttgttaaacattgaagaagatcacctagggttgagtaggtaagaagtaaatgtggctttgagaggccgtgatagccgataccctcaatggctgctcttggcctgttggacaagccatccttgcacatgacttgctatcctatgacccgcctccagatcagtcaccctccccatttgactgtgggtggcctggctctgtttgatgaccatgagcaataaagttaccctttcattaccatgccttgggctatctgagctggatgcccctaagttctaatagaaaataacatttattgatggttttttttttcttctctgaacccaaatatgacaatgaggaaatttattttaaaggtactgattttttccttccccacagagtaaatattgtcacatggaactgctgatgatacttctgagtcccttaaaataagacttgtgattcattcacaccatgaaaatggtagagaaccaacatcttcaccttcagattcatacgttattggctctttcctttttggtccgtgggtgttaatgaacattttcactctggagctttctctgcttccgactccagcgtggatgaaggagtgcagcttctggcctgcctggttcatcctctgggtctctcagccctgggatttccacgttccatctctgttgtggtgggcgagttgcatgatgcattcgatttgatattttacagaacctctactgagaaaatagggtaagcagattaaagctgaactcagacacgtgtttggcaaccacccactcttgatggcgtaagtggatggaggcaggtggccacagcaaacaccatgtggctttacgaagaaatgttcctcttccatacgttaggcctgtgtaaagttccttgttggacttttgcttcttcgatgacaatacatattttgttagtatttaaaggacatttttaaacattgctgaagtgcaatcagcttaaattgcgattcatatgacaagtgttgaaacagggtgatgtttgccatgaaatttaaataagctccgttaaagcagaaatgtctatataccatgtaagacacaatggtctcccatagccttcccctgttctttacttcttgacaagcatgaatagtctctctgtttgaatacagagtagagtcagttattttaaaagagttatcatctatgggtataatgcactttaagcaaactctttacatgcaagtatgacttatcaacaagtaaaccttaccaaataaatgctcattttgattaaggctaccttcagataaccactgtttatcatgcacttagagggattcagttttccaaaataatttaaaaggtgactttttagaacatcatctattacattgtcatctaccatatattcttcttctcttttttttttttttttttttttttttgtgacagagtctcactctgttgcccaggctatagtgcagtggtgcaagctcagctcactgcaacctccacctcccaaactcaagcaattctggtgcctcagcctcccgagtagctggaattacaggcacccgccaccatgcccagctaatttttgtatttttagtagagacagggttttgccatgttggccaggctggtctcaaactcgtgacctcaagtgatctgcccaccttggcctcccaaagtgctgggattaaaggcgtgagccaccgcgcccggcctactgtatattcttatatatacatgtgtataagaatatgcatttacttaatacgctatcaatgtacagaattgtttgttgtggatttctgcacatgttccttgggtaagagagtcttgatgtgatttgcgctgtgagagcagaacttaggtgctctatgttctccaaagtccccctccacctcctggatggcatttattcagtagaatccgagctcaataaataaagaacctcgtgtacttcccaaagagccagacactgtgttagctgctttatacatacatctcttaattttcattttttgacaacattatgaactatgaaatattgataggacatgaaaaatcaagagctggtcttacggaatagtgcaggattccttccctgctccatttttcaaagctttgctccattggaacttaacaatgtgctgtctttcagtacgtctgaaggtctttttcaatttaaatcagtttattcctgtttttaccatatccagctccctgctactcctaatataaacagacttagtggcctattaagtattttacttctaatgcttttgagttttttcttggcagtggaggtgtaatctctcccaaaacctgcctgcacttcacagagaataggaccgcaattgccagaagaaactgaacctttgtgggggaaaaagaaaaatacagccttccctcattctccagtcttaattgagctaactcaatttatgccaaccagttcttgctggtcatagttctagagctttatgagaattaaatcctgatctcaccttaatcctcctaaaatctccgtgaaactgggcactgttatcagcaccattgtgaaatgaggcagcaagtacagggcggtccctaaatgtgactaagtcaggaatcttatgtagaaagcttacaaggaagttggggggtgattaggaattgtctccagaaataccagataaacagttcaaattttagtgaagcaaaagataggcatattttggccttgtttaacttgtacctgaatgtaccaataacacttttggaagacttggacgtactcttcctcttttcccaggaaaatgggagagtattcattcctgtacatattgagaacatggacaattctcacattttaggattgtcttaataggcaactgactttattatctacgtgttgattgaaagaatagctcatagcaggtgttaaaagtttttcctaaagagctacattataaatattttggactttgaaggccataacatcgtaacatttcaaaggtcatgaaaacccagctctgctggtgaagcagggaagcagctgtagagaatatgtagacaaatgggcaactactgagttccaacaaaactttatttacaaaaccaggaggtgggccagatttggtccacaggctatagttttatgacccctggcttatagcataagttgttggacagaattttgataccatatgtagacccaaattttaagaatgaattgatgcgtttgattgatcacaggagaattcagtgtttttcccctttgcttcttacatacgctagattgtaggctcacccggcctcctctgcgatttgggcagaattagagcagtatatcctatcaagaattacttctggcaggggatatggtgaaggggccattcatctgttagtatttgagtaagaaacagttccatacaaacaattgggaatagtaatgtctttgtcattgtgaaacggaagaattttgctgtcttagttatgggaatgctccagttatgggaactaaagtgcagtaattgctttaaatggacggtcatatatgtttggctccttagtccaataattttattcaccacgttcccctgagagaagacttgacaagacaatcctggacagtcagcattggattttcatctccagctgattgatttagtatttcatgcaacccaatggagtatctttgctgtagggttttaatactggagctattatgatgactgatgtaatttagtttcctgtattgatggtttccaaacaattgagatgaatagttaagtttctataattgttctctgtaaccatatgaaaaatgattatatattagcttaacatgagttttttcactaaaataaaaatcaataatcagttggttatccttttgaatattatatttaatgcctcagatttgaatattatcaggaagccaagatttcaagaccccgtttcatttttttaaaaacatgacaaaatgtgacatagtgaacattgagatcactgagcttcattgtggattagcaccccactttcaaatttgtcaacacgatatcatctgttagatgatatctaacgttgagatgttctctaagataataacgttgagatattctctaaagacctaggataaagttctaatttaatttcctattgcagtatttttgtgttgcctgtcattaagactgtggagcttccttattaattaaatttagttcactgtgtatattgctaccacttaccaagtggtcgttaatacagcctctcttaggtgatggctttttgtttacctagcgatgaaaagcttaacctacactgcatttttttcatgtgtgtttaaccgaaggaaacatctttgaatttatcttctcactgcataactggaaacactgaaatttatttgatgatccagaatcagttccttggtttttaactttatttccatccacaacaagtggcagctttgagaaggtttcatgttctttacactgagattccagtggatgagtctgaatgtttaactcccagaagttaggagaagattgagcttgcttttggagtttaagaatgaaaatgcaagtgcatgtgcctattttagggcctaagttggattttcataaaataaagcaaaatctgaggtcaccctgtgtgggaaaacctcatccgagactggagattgaaaataggagcaagggccagaagtagccgcctggagagcagagctaaggactgggtggtgcctgtgtgtcctttgggcacctggtgactttcaggacatcatagacgcaagggtgagggcccatctcatccttactgtcagaggcaacagtacagccctggggtgtatttcacattataccactagagctgggtgcttaaagggcatcatcaaatccatttttctttccttgagtggaggtgcctttcatttgtaaatgatggatttgaaaaatggacaagtagtgaaaatgcaggaaaatgattcacatcagtaggtgctccagcagatgtggagtaaaaatcaacatgtcccacaaatgggcaattaaaggttacacatagaatttatggaaagaactttggagtgtcccagggattgcaaaggtggttataaatgcatgtgctcacctcttcctgttagcacacacacctaaatacgcagaatctctcagcagagacattccgttgagagcctacttaataaacctcattttaattttattcaccttagtaaggctgcaggagttggtaagtcccgtggacttggagacttaggttaaggaattccaaacttgactgctaggctgctggtacaaatcatctttctctctttctagtcacctggatacattatgatgcgatgccagacttccccaaaaccccaatcaagaaataagaaaagatttttctccatttcctggttccctcacagtgagaatgagattttttatgaagtcttacatttggtggttattggcccattacctatggaaaccactgtaaagacctcacagtgctgccatcagcatgcgctctggacttcggcggtgccacataaggtggccccagtgctcatcccaggaagaatggcccctgcttgtctcggcaaatgactcccacggaagctgtggagagccacgaaggtggcaggcggcattagaggggctgtaaagggaccgatgcctgagaatttcttctgcaggatgtagaaccgtgtgcatttggatgataatgcagtcagaggagggcttcctgtgattacggtggaataactctcaggctgagcccgggaaaccaggaaatgcacgtctaccaggagccgaagcagaggggtttctttttccctcttgctctgtctcgttgaaccttggttcttctatctgtccctgagtcctgcctctgagccactgcctgttccctgggtggctccagccatggactgcatgggtgccaggcacatagctggtgactctgcccctctggtgagtgcagcatggcctctgctctctccccctgcctctttttgttttccttttctgagggttcctcagcctcatgaagtttaaagcctaatgcagatcctctccctccgctgcattgttctaggtgtcactgaatttctccaaagagaaaaataaaaactcagaatattcttgtgactgatttctgaatgtgacacgtggcgtaatgacttaaacgtattacagccagcagctcttggtataggacccatgatattttattatattttgtttagcattttgttgtactttattattttattgtctttgttttatttagaacactttatatccacccttttcacagagttttaaatgtacgttacggtactgttaactctgggtacgatgttgtgcagcagatgtctagaacttactcatcttgtggaagtgaaactgtacaattgtgtctgtgatccttcttaaagccttagctgggctgctgagtcctgcactctaactgcaggaagggcagctaaggaaagccaagtgcaacttgccagacagatgggattttcatgtctcatctatcaggcaagacattgtctcagtgtactcagcagactcctagactcgggttctgggctgatgctgtcagacatcataaaaggagagacactcctctcagccatgctcctaatacccctgataagcatgctcctaattcatctactgcccttagcaaagctgccgtttgtgtctccgatttggtgtctttatagacatcgccatcccctgttagtgaatttggggtcttgagacgtcatctgatgaggacctgctgtttcacagaggaaatataactgtctgtgtgctttttattattgtcatgtttgctgctgacatttcacagctttcatttattgaattttgaagacattgattttttcttcatagcagaaattatggatcagataattggccaaataagaaaaattcagacagcattgtttttctaaacatactgaaaataacgcatgtacctggtgaaaagtgaagacgtcatgacagagggtccagccctgctgtccaggccacccccaggatgggagccctgaatcctcatgggatgtgcgctgagatacaaggaggtccctgcacacacctgcctttccccgctgctggactcttgcaaatcatttcctgtgagtgtcagccagcccactgcatgttccgaaagctctgcagagtgcgccaatattccagagtttcaaagtagtgccctttgaaaagatttaaacctgcaaataaaattaaatttgcatttgagaatacaatgtgttttccttcttgaaggacttgatgctttggtgaataagcatatattacaaaattattcaatcacccatcacaagtgggtgtgtcattccagctctgtgcatcctttcaatgactccgaggatgatatcctcacggaagcagagttatttaaccccagttcactgatttctcagagttgtttacaaggcggctttccgtgatgtgtctgcttgggtaaggcattaaattatttcaagaatcattttggtctttgctctcaagtaaaagtggttttagaaggaaacttctacctggccatcgtgtgacaacactggctgcatatcaagaaaagtgagactttattttttgcacatgattttatactcatgtatgcttgaaggaatatgcaagcgtcgtgagatctaatccatacagaagttgagaatgtgtttccattagaaggtaaagagcctctagtattcaaagcctttgattcagcgggcaggtgcgaacggtggaggactgtgcttctcgcttgcagacacctcgaattatttttctttagctccctctgtgctttcagggagcctgcgtgagttaagcctctccttgtagtgatttcccgatgcccagcaaggccgaagctctcatttcctttaggagtgttgttttttttttctcaatgaaggatgaattttctaaatccataattacacctgaccatgatggcagcttctctgttaagggcttggaaagtaccttgttaattacttgacttattttgtcaacattttttcatgttctccccaccccttgccaaaaaaaaaaaaaaaaggatggagaatctcatttttgcttcagcgtctcttctgtgatgatttcttgcttttcaattcacgtttggaaaaatgttttcatttaaacaacctccctatttaaaaaatttaacagtaatacctgctttttgtaatgagtgaagataatacaataaggatgtatgaagtcaaagctaattaatcattcttctcccccatcccctttctatccatcccctttagattactcagtaatgtcgacagcttgctgtatgtctttagacaccttacttcttgtttgtgtgtacccatgaaagcttttatatgcatagatatttcttttacatgtatttcaaaaagctcagaatattgttgggaagggaagagagagaaaaatgttttctttgatttttaagacagtacttggaagttaagtgtgggcatcagtgtaagtaagaagtaggatgctagagacagaaagaacaagatgggtagtttttctttttattcaaagcaatcagtgatatgttctaatgctttggaaaggttctatgcctagaatgttcccaagaaaggtctgatttattcttcataaagtacttttgtgtacttctgagctagggtggaatttacatggtttggaatcatttttgggggtgtttttcaaaatgtttgattggaatagtgataagttctctttaaagagattgatcacgtgagattgggtaacaccaagatgaacagaatgaaaaatgtttccctatagcagtgctttcagaaacgtgaatacattaatgtacaccaagcatttgtagaagagggattagggctcagcattacagtgttttcctaactttccttactcacaggctccttatttatttattttttgttaggctgccgtggccagcgttccaggaaacacactttgggaaatgacgctcctttggctgtgtagcgcacaaggggctgtgagcttcccctgtagacgtttctgccttattccagctgatcagtaatattcatcagcatcatttcattcttttttttaagacggagtcttgctctgtcgcccaggctggagtgcagtggcgccatctcagctcactgcaagctccgcctctggggttcacgccattctcctgcctcagcctctcaagtagctgggactacaggcacccgccaccatgcctggctaatttttttgtattttttttctttagcagagacaaggtttcactatgttagccaggatggtctcaatcacctgaccttgtgatccactcgcctcggcgtcccaaagtgctggggttacaggtgtgagccactgcacccgatctttttttcacttttaaatcaaaacagatcattcatacaagagaagaaatacatatgtagagatgacaaatcattcagtgggcctctctgtaatgcttcccgctccagtccctgagtagctccccccgcccagctgtgcacgtcttcttctttgtgatgtggtctctacacagatttgggattcattttccctcgcttctctttttagttttaccacatattaatgtatccttaaacaatatgttcttaagccttgcttccttttgccgtttatagaagcagagtcaaacaatatatatttttccatgacatgcttttagctttcagcactgtggttttgcagtctctccaggttgatgggtgcagctgtggtccattcgttttcttagctgaataatactcctgttgtaggaatagatggcagcaagcgtaacccctcttcatggatgggtacctgggtgatgccagtgtttgctattaggacagcgtgttagatcctgcatttagcgatctccaggcacacctgcgggagagcgcctccaggaaacacaccccggggtaggattgccaggccaacaggtccttaaggcagatgattaccttagggaaacagaggcccccagtgtttcttaggcttcagaagtgtggtctacacagcaatagtaatatgaagactcagctaccgtgattccttctcagccactcctcctcttgtcctaacccagaatcatatttatgatattgtcattttaaacatatgcgtgtagtttctatgtgatggaatatggtagtgagaatctaagtatccagcctggtcacccgctcctttccgcctcacgtgcaggatggttgccctcatttaatcatcgtgtacagtctccctcgggcaccctgagccctgcatctgtttcacccagggcctccctttggttctcgttttgttctttgcctcttccaggactcctgcctcccttcctgcctcgctatcagccttctttagaatacatccccagccacgttccacacccaatggacagcttgtgtaatcatgttctcccacatccctaggagtcctgggatccatgagtggctgtttgtaaatctcaggaagctttccctgtcttcctgccctgccctgtcttccttcccctggtccactggcctcgggtttcctgcagcatccatggagcactagggaagacccagccacgcagctccatgtgatccctctgtggtccgcctggtgctactactgaaaggagggtctctgttacttggcgccaagcatggcaggtccagttcccacggatagccggggcatctaaccaagataatttagagcagaagctgtagctacattctgtacctgtttatcttgagttcctgctagcaggtaccaataatgatggattgtgaacaaacagctctgccttgtttttttagaccctgaaatagacaggttggctttgataatgctttttgactgatgggcactttttgtaactaaatcccattcaaaggcttaaaatatgccgcccaaggttgatttcaagatatattaaattgacctaaagaaaaataagtaggaaaaaaagtcctacctacatatgggatgatgtatggacattttcaaaatagtcacaacccaactttaccatagcaaaaacaagcaaacaacaccccccctcaccccccagaaaacaacaaaagcaaaaacatcaaaataatccctgcagtgaaacaagatttcccctttattactaagtaccttcagccaaaaggaactgcaccacttcatttaaatgtggttctgaatattcgtttgtgtttgcattgctggattatctaactgctgctttccatctgaaacgtaagccttcagagatgttgctccccagtaaactatcttagctttgccaggaccgggccttcactgagtgtaatagaatccctgatccccaggaggtagggaaggggctgacaatgacatgcatgaatgagaatgttttctagagaggatgtagtctgccacgtcctggagctgctttagggagagcaaaaacctgtttgtatctttcattatatatgcttttaagtacccaagttaggaagtagctatctgtgagcttttctaccagtcttcatgccaaagtgataatttagtaaaaaaaaaaaaaaagaaaaagaacaaacaagccctcgaaaccaacctgaaagcgcaggatacagatacttatgggcagagagagactattgcctgtctttggaagcattgccagctattgctgggaagaccactcctgcttagaggggtggaattctttctgagctagcttgtcctggaagtctccgccccaagagtgttcttgatgcgtgtgccttacagccattgggctgggcatcctcacctttccattggctggaaaatgaagaggataaaccccactctcatatgtaggcaaaaggttccttttgataaagtcgtgatttctccatctcaataataatagtaatgcacccatcccaaccgccccagagctttgctgttcaggaaacataggcatatctcaaagtaccctttaccttaattttcagaatcagtgccttgtctcatgacttttcaaggttggtgaagttctgaagtacttaaaaaaaattgctgatttaataaacttgctagttgaataaaagagtcagaccaagtagaaagtcgttttaccacagatgtgactttttctttttgtggtgagtacatgtcgtgggcagtgcatggggcctgtcacaactggcatcatttccatttggttgaaatccgagcctctgcatcctgccttgagatcagggcagagcccttgctttttagtttcatggaggctacattataacagagaggaagagagggagagggaaggaaaggaggagaaagaaagagaaaagaagggaaggggcacaggcaggaaaagaataggaacattccaaagccatgtctcaggacattagagctagaaccagtgtctgtgctaatgggactcttgcaaacaccctcttatttcactttacctggggttagtttttggtttcctgctttaacagatgaaaacaggttttttaattggattctgcacattacccctgtgaaactgcagaacataagcggtttaagtagtttcacactgggctttatttcattagtgatatgctgtatggattgtaattctcataaactgataatatgctgatttactggaaaccaaattgacaagaagcctatcatgtgtattggcagtctgttcagcttgctggacttggccaggagaccttgagctcctaagattttttcatccttctcttaaaaaatagcaaaaacatatctttattttcagttattaaattttgagttcacttaacagtttcttatctgtttgcagaaccacatggaagtaatgataaagtcttgtttcagatatataaggccaacatactaaaaatctgagcatactcaaatatgcttctgcatcttgaagaataaggttgtctatatgctagtaacatttatctgaaaaacatgccacatagaaatacctttatggggacttggccataaattctttgccaaagccaatgtcaagaagggtattaactaggttttcttctaggattttaatagtttgaggtgttaacatttaaatctttaatccaactcaagttaatttttttcatatcacggaagttaaagggccagttttatttttatgcatatgttaagccagttatcccagaaccatttattgaaaaggagtcctttccccattgcttttttcttttttttttctcagccttgttgaggatcagatggttgtaggagtgcagctttatttctgagttttccattctattctgctgttctaaatatctgataaaataaaagttgaaatttttaaaaaagtatctttatgaaatctaaaaattgtggaaagtaattaatctcattaatctaagagaatccttgttaatgtatttgaatacagatatttatagaaatacaactataatttgacctaatatgcagtagtatacatgagacttaacaattgaaattgttgttttatctaaacagaatctgctcatttcctttttacaccagcaatggtagagccagagaactttggttcacaatggaatcatcaagtcataaaacttttgaacttcaagggatttttccatttttttttggttggaggtggtgatagggaaatcttcttcaatgacaataagttaatgacttgcattacttcttggccaaagttaagactagaacagaagttttccgactcccagtctgttcagtattttccccatcatacctgtgattatcaaccttttctcactctgccaaccaaaaatgttcccttggaatgacttctgactgtttgtgctgaaatgaagcagtggtttttcaaagctcacacatgaccgtatggactctgcacagttggtgccatattaaaatacaatgtctcttacctttttttccctccactttctgttgttatttcccaatcaaagtaaaaccagtattaaggtctgtcttagttcactttgtgatgttataacaaaattacctgagactggtcatttataaagaacaaaaatttgtttctcgtggttctggtggctgggaagtccaaaatcaaggcaccagcaagtttggtcgtctggtgaggtctgctctctacttccaagatggcgccttgttgcttcatcctctggaggggagaaagctgtgtcccctcctggtgggatggaaagggaagccaacctagggctaagtgaaacctcttttttaagggccttaatcccacctcttaaaggatgcacttcttaatactatcacactggcactggcaattttggagggggcacattcaaactgtagcaaggactaacttctagcatattgtttatttaattccccaaattaagtagtggggactgcagattagttctgaagttttcctttcaggagaaagtagaataaatgggtaaagaagaaaccataaattcatcttgggtggaagtgcagtttctgaatatattctacacatcccaacaattgtgaatgtgctttgccatcttatcaaagcagtattatattatagaaggaaaggctttggttgagcatatggctatttctgagttacttagctttatattaactttctcatcaccagttggcctacttgcttaggccaattagtccttggccattttgtctatgtgggcatgctaggtcatgtcagggctgattttttcttctcaaaaatttttaattgtggtaaaatatatatcacatagaatttatcacctttgccattttaagtgtacagttcaatattgtgaagaacattcacatttgtgcatgactaaattccagaactctttttatgttataagactaaaactctctacccattaaataacaacaccccatttctccctcctctcagcacctgtagaaccaccattctacttcctgtctctatgagtttggttactctaggttattgggccaattttgacagcctttcttgaggtggaatcctcttcccaacatacttatttccattgccaaccatgaccctgcccatggagctctatcctacactctatcccatccccgtcttcagcccatcctgtttggtgacacccaccatggccccagcccacatcttcagcaggtgcagaatgtctcttagtgttgacttacaccctggcagtcctgtgcaccattcacaggatagtcttacttacagattgagaatctacagttttgagatcattatctttacatttctgtatcctccatccttcacagagtcttcagcacagagcatgagttcaaaatcaatgctgggagcattaggagaaaattacagagaaaaaaatgttcaaagatttcatgtagttaaacattcattccttccacttttgcatcctagattgacccctcttgtgtcttcctagataaatgggaagttgtctgtctcagttgatgtgatatttaaatataccagagtttggagtttgcagagaaagagtgtggagaagctaagtagggaaacttgatgagtccctagactgaggatacaggagaatgaagaggaggcaggagtggggaggaaggaacagagaaccaggaggcccagggacgtgtgtgttgcagcagctttgagtgtgaatgggcaagaatgaactgcacgtggggctgccacatttaacaaataaaaatataagatatgcagtcaaattttaatttcaggtaaaaaaaaacttaagtctatccatgcaatatttaggatatacttacactagaaaaaatgttgcttatctgaaattccaattttactgagtgtcctggattttgtcttgcaaccctagctgtaaagggaagaaggagctttgtagggtagagccaagcattggacaaaggcatggatggaggagcgatcggtgtccccagtccagttcagtaatatggagggcggagggtggagattacaagaattacaagcaaagatgggggccgtagaattccatcttctacctttaaagaatttgcccttttttttttccctttaattgatttttccctctgtttttaagttgttctcttttgaatactctgcttatagatttatttcctaaacaagtgctgttaaatggcctccacttcacaggctccatggaggagcagagctctcctctctctatgccgatgctttcagcatcctcagaatagcagctggaaggcagtaggttttatggggataactgtgcactcaccagtttagatgtgtggttgctaagagtcacggtatttgtttgcaaacctgttggtaccattggtccatgtttagctttgtttaatatacataaacaaaaaagtgtaactggaagctatggtattttatttttcaattagctatggaaagtacaagaaaatcaagttgctaagcaatttctgttgaattggatgtgggtggaaccattatcaaaggttggaagaaatcgtaaaaatggaggagcattttatattcacgttgtttttcctatgtcttcaagttctttaaaggaactgaaactggaaattgcagaaaatgcattatgggtgtgatttatgaggtaaagaagagtacacagtgcatggtgtgttgttatggcaaccctaggaaactaacatcaagatcttaactcaagatattgatcctcatgtatgttaacgtgagagacatgtgtgtcttgtgtggagggcctctccaggtgagagggtggctgtgctttcactcatggtcagctccagtctgctcagggagctctgggcatccatgtgcccatgtgtcatccttgtgacatcccttcagtgtcagctacttttatcctttgatcaattgctccagggctcataatacatgatgtaattggttggaaacgtggatgtccaaaaagtgcatcaacgctcaaggtcatgtgtcctttgttttgaggtgtcactctgggcagagctgtccggtgcaactcaggggaagtggtgtcctggtgagaaccaagtcagaatgtggcttgaaatgagctcttgtatgaagctggcaaattatggcttatctttcctttagtaggttttcttcatttatttccttaatttaatggaatgccttagtgctatttcaattaaaaaatattgatggtaaatgtttgggaggacattctgcatcctttgatgctcaagattttctgttctccaaagcagtagagacattagcctcactcaaaggagagtaaaattatgttcaatgtgtaaacttgcttgctgcgtaacaaagtaatattatggcagggtgtttgacagagactctttagcttaatgaaattctatcagggagatgcagttttaatagcgtcgttcattgctttttgtccctgtagtctttaaaggctcacatgtggggaggacagtggctgcatctgagctgccagcagcagtgcaggagttcagatgtgaaatttcactcatgccagcatttccagcatttatttttaatcaggatctgcgcttaccgatggcctgttaaaaaggaattgtgtaattagcctactaaatcaccttttcttcctcagtctcttcacatctctgaaaaacagcccccatatcactgtggcttactctctctctctcaatatgttgtaggaactacagaagtttcagcatacccacaaatactgggttgaatacctcttttcaaacattagtttttgaaattgtagtcaggtttttaaaaaacggttgaatcagagtatatcaaattgtcatgttaacgtggtaacatcataaacaagtttccttgggagataaattttgtggtttctgtacatagagaccacctttctttttggtcgacatttcattcctcctgtgtttttgttttgtgttgtgttgtgttgtgttgtgttgtgttgtgttgtgttgtgttgtggagacaggatcttgctctgccacccaggctggagtgcagtggtatgatcgtggctcactgcggccttgacctcctaggctaaagtgattctctcactttagcctcccaagtagctgggactacaagcacttgccactacgcctggctaatttttttctttcttaaaaattttttgtggagattaggtctcactgtgttgcccagactggtctcaaacacctgggctcaagcgctccttctgccttagcttccccaaattctgagattataggtgtgagccgctgtgccgagccagtttctcctaggttttaaaagattgactttatagtttggatctgcaaataagttttaaaaaattgtagaacctgttcccatgtatccttcattcagtctctgccctcattattgacattttgtgttaccatgtcacagtggtcacaactaataaatcaatactgaaaatctctttgaatttataacaatgtctgattatttagttttactaatctcaaaatttggaacaacataaatcagcaactttcaaggtttttttctgaaagaaagtagcttagaaatgtatacaaaagcaaatcaactcaaagtgtgtgtttatcatttagaaaggtaaaaatctatttttcctatcaaaattatctcttaatgctttttaatttattttcttgagtttagtaattctatcttgctaatgtaccttcaatttctacttacttagtagaatgttaatattacagatcgagcatccctaattggaaaattcgaaatcggaaatgctccaaaaccccaaaatttttgtgtgctaacatgatgctcaaaggaaatgcttattggagcattttggatttcagatgagagatattgaaccggtaagtataatgcaaatattccaaactctgaaataatctgcaatctgaaacatttcttgtcccaagcattttgaataagggatactccacttttattcttattcaccaagaaaccaccagagaagacatcaagcatcaagtgaaagctacagatgagcactttacttttttgggagtgctgtttgttcgtataaagaagtgaggctttttaagaagtggcctttttaggccttagcacctttttaagctgatcactgtctccttgtctatagaggggacccaggaaatcttaggtgacagtgaggctcagggtggagcttggttacttgtctcagcatcaagggacaggatcaggggaaaggatgctgagctgtgcttgtgggtgagaaatgagttaattaagccctttctgccatgataactctggtgtttgttttctgctatttaggctatcaaagttagttagtgactcacagcaaaaagaagatactgatattttcttgggttttgtttataatcatgttttgagcttatatagacatgctctttcttaaaattcatttatttgcttttcatccatggaaaaccagttttttttcaatgagttataaagtatttaataagaagagattctgatttaattatatccagagatggctttggatcatgttatttaagatggagaatgactatttagaaatattaatgtttggccgggtgcagtggcacacacctgtaatcctagtactttgggaggctgaggcaggcaggtcacttgaggtcaggagttcaagaccagcttggccaaacatgttgaaaccctgtctctaataaaaatacaaaaaatagccaggcatggtggtacacacctgtaatcccagctacttgggaggctgagggaggaaaatcacttgaacctgggaggaggttgcagtgagccaagatcatgccactgtactccagcctaggtgacaaaacaagactctgcttcagaaaaaaaaaaaaaaattggtgtggtagtgcatgcctgtagtcccagctgcttgggagcctgaggtaggaggatcacttgaacccagtaggttaaggccgtggtgagctctgatcacacccctatactttagcctgggagagacagcaagaccctgtctcaaaaaaaagaaaagaaaagaaatattaatgttcatatgtatctatatattatctatatctgtatatttttatattataatttaaattatttcagtagaaatttgaagtaggaattttagggagaggaaaaaaggagtgcatgcattaaacattcctttagggtcaagacgatggagccattgagtacattttaatgaatgtgaatgttatctgggctgctagaaaagaatgaaaaagccatacttaattgtttaaggaaaccatagaagaatctactgttgggtaagttgctacccaaatatacatacattctttttcaaaatatatcctgaagttcatattttccaccattaaatctattctcttcctgccaggaaacctgaactagagaggtttggaggtcttatgttgttacgtgccaaaaatatagaaagtaatttatgagaaggacaagaattgtgatacattactaaggcgcatgtaattttctaagtactaaactgacaggtgttttatatatatatttatgttttattggtaaagacagaaaacaaatacatcttagtcaaacagtgttccccgacttaccccatcaatgccaagggcacaggagggggtctgcagtaacttcctgaagcaaagcacggaggagagcaggtaacccatgacatgacctggcttgcgagccttgatgttttctgtgggtttcattctttcctttgagatcccaggcaaatgacacaacataggttgtaatggaacccctccttttccttgtttagactcttgaacatctcatattgctcctgactgccagcaaccaaatgaagggcttcattagttatagctaattaactacacaccagactgaaggatttctagccaaggagtttggggttgctttggaataatagcgagaagctagtcttttgagttttaactgttggatccctagcttagaaagttaccagtaccctttttaattttttactctgtaatgggcaggaatagaaattatgtacaacagtggaaaagtagaagaccatatcaaacctgatgtacccataagaagtagttggacgggcatggtggctcacgcctgtaaccccttcactttgggaggccgaggcaggtgaatcacgagatcaggagttggagaccagcctgactaacatggtgaaaacctgtctctactaaaaatacaaaaagttagcagggcatggtggcgggtgcctgtaatcccagctacttgggaggctgaggcaggagaatcgattgaacttgggaggcagaggttgcagtcagccaagatcatgccactgcactccagccggggcgatagtgcgagagactctgtctcaaaaaaaaaaaaaaaaaagatgtagttaatagcatatgcttctccttaagtgatcacccaagttgttggagtttcctaatcatcagtttttttctctgtcattttgagcttcctggaataggactgaatttgcaagttgaatgattatgcataaggctcaagaaaaacttgaaggcagataaaattgatttatactccttagctctaccctaccctatctacaggtatttcttggcggtcagtgaaggatcaaacaagaacagggttgggtaatgctgtcagcaggcccactacatcccatgccaggcgctcatggcgtcctgtctctgctcctgcctcactttccacctctctgcccagcccccataaatagtatgtgggaagctgggcacagtggctcacacctgtcatctcagcactttgggagccgaggtggatggatcgcttgaggtcaggagttcgagaccagcctggccaaaatggtgaaaccccatctctactaaaaaatacaacaattagctgggcatggtggtgcgtgcctgtaatcccaagtactcaggaggctgaggcaggagaattgcttgaacccaggaggcagaggctgcagtgagccaagatcgtgctactgcattccagcctcggtgacaggggaagactgggtctcagaatgaaaacaaacaaacaaacaaacaaaaaaaagagtgggtggggctcctgatgccttcgccattgtgattacacaatacttctacctggactgcctttctcccgctcccatccccaccttcacctgggaggcatgctattgcgttccccacagcacccaagtcaccccgtcatggctctgtcatgctgcatacaccactgctcctttaaagggtcatttctcactagacacaggggcagagaccatgttgcgtattttcttccatgccccaagccccagcaccggacttggcctatagcaagtgacaatgcttgtttttattaacgaatgagtacacgatcccaggaatctcgttgaagtccagttctccacgtggccacccttgactcccacagctgacctgggattgacaccgtggccagccctgttcctcacctgatgcctgcctgtagtcttcggccttgctgctccagaacttttcatcgtggcccctttagggccatggcagcacaaatacacttagtaggtgaggccatgaggacacctaccaccattaaggatgcctgtggggagtagggagatggaggataggctggtaagaccctgccagtgcgggcctgcctcagtgccttggaacgaggtattcccagtgcctctgagctgcatcccagtgtgtcctgagcacccatctggcctggcaagaagcaggcacgaaaggcatatgggccgtagcctctagcctcctgccacctgcattccaagccacgttccagtagcactttaactgaaacatctagctacacaagatgggctgagcactctacacagatgctggtccatgcagaaacaaccctaccccttctgcacctgaaagggttccctctgattagaaaaggtttgcttcaagttcggttataaaggaaggcttgtgcatagttagtggggaagccacagggatgtgcaacttttccctacagccctgaggttccaggcactaagaacttggcacgtctttccatgctggctgaaatcaaaatgaaaccttctttgacttttgccccttctgctggggcattgacattggggtttgacactggctcagacagtcaaatctggaagccaaaccttagaagccaaatcttagggtggcattaggactaagctgagaataaattctcagtgatcccattcatctgcctcccagtgtactaaagtaggactttgaaccttccagaaacctgatatgttggcaatttctcaagctttgactctttcttccccattgcctctaaaccctagcttgaattttactggctgccttataattgctatttgttaaaaatcaaaacgattttccatcctggtaaaatggtaaaaatatcagtagtttgcagacagtaaatatctgtctttaatacttcaaaaacaagccatatttgcctcctgcctgttttccttatgagggaattatgctgtggggtggtagagtgagaagggttaaatcactggggacccaccttccctcgttcctcatggaatttagatgaatgtgctcttgctaaattctccagaacgtgtatgtgcgtcacccccacgctgcccggcccggaggtggctggaagtctcactttgtttttcatctgctgggtggtgaccagcagagagcactgagcggactgttctttccaatgctataaaaagcctgtttgcaaaatgaggatttctgcttccaggggctgaattccacgtctgcattatgcttgctgggtgggtaccaggcacagtctgtggcttggtcgtagcctttgccatgtcttttgatgatgtgacatgcctgagacacatggtggagctctgcaggtggtgagcagccacgaggctgtgcttgcatgctggagcagaaccttgttactgctgattgaatagtctcgcagaccccttttctgtcaaacgcaaagccatgtgtttttgttccatgtggaaaatcacacacattctctagcatattacattgtcattatgtcaacatttttaaattttattgtttaaattgacgaataaaaattatatatatttatgatgtacgacatgatgttttgatgtatgcttacattgtggaacagctaaattgagctaactaacatgcattctctcacatacttatttttcacgtgtggtgagaacacttaaaaactaccgtctttggccgggtgcagtggctcacacctgtaatcccagcactctgggaggcttaggcgggtggatcacctgaggtcaggagttcgtgagcagcctggccaacatggtgaaaccctgtctttactaaaaaatacaaaaaattagccgggcgtggtggtgcgcacctgtaatcccaggctgaggcaggagaatcgcttgaacccaccaggcagaggttgcagtgagccgagatcgcatcactgcactccagcctgggtgacagagcaagactccatctcaaaacaaaacaaaaccaaccaaccaaacaaacctcacaaaactactgtctgcagttttcaagtgtgcagtatattgctattaactgaagtcaccgtgatgtagacttcttgaacttattctgcctgtctaaatgaaattttgttttctttgaccatcgtctccccggtccccccgctctccagtccttggtaaccacaattctactttctgcttctatgagttcgacttgtagagtccacttagaagtgagatcatgctgtgtttgtctttctgtgccttacttatttcccttaaaataatgccctccaggtccatctatgttgttccaaatgatggtatttccaccttttttaaggctgaacagtactccactgtgtttttagatcacattttccgtatccatccattgatgcacgcttaggctgtttccctattttgactattgtgaataacgctacagtgtacatgggagtgcaaatatgtcttcaacatattgatttcatttcctttgggtatattctcagaagtgggattgcagcatcatttgatgattttagttttaatttttcgaggaccctccattgtgctttccgtaatggctgtttacaaatttacactcccatccacagcacacaggggctcccgtttctccacatcctaacacttgttcttattccttttgttgatagtagccattctaacaggtgtaaggtgataatttattctggttttgatttgcatttccctgattattagtgatgttgagcattttttcatacatatgttggccactttttattttgaaaaatatctatccagtgatcaccttagccacacatgtactaaatatgtctgtccatttcctttgcccctttttaaaacaggtcatttattttcttgctattaagttatctgagttttttatatatttgagatattaatcccctttcagatatatgaattgcaaatattttctcccattttgtagggagtctcttcactctggtgattgttccttttactgtacaagagctttctagtttgatttaacatcatttgtctatttttagccttattttttattgtgctttttaaggttatatccaaaaactcattgctcagaccaatttcaagaggttttttttctttatgttttcttctagcagttttacagtttcaggccttaggtttttaatacattttgagttaattattgtatatggtatgagatgaggttataatttcattcttttacatgtggagatccagttcttccagcatcattattgaagattatcctttcctcattgtgtgtttttggcatctttgttgaaaatcaattgactgtaagtgtgtggatttatttccaggctctctatcctgtttcattggtcgatgagtctgtttttatggccagcactatattgttttgattactatagctttatattagatcttaaaaaatctggtagtctgatgcctccatctttgttatttttgcccaagattgctttagctattctgggttttttgttttttttgttttttgtttttttgtttttttgtttgtttttggtggttccaaacccatcttagaattgttcttttaattttagtgaaaaatgtcattggaattttgaataggacttgcgttggatctgtagataactttgggtaatatggatattatagcaatgttaattcttctaatccatgaacataaggtatcttccatttatttttatcatcttcagtttcatcaatgttttatagttttcagtgtacagatctctctctttcttggtttaattattcctaagtcttttattttttgaagcatattttatcacacgtttgattacttttattaatgcaactttcattaaacaaccagaaatttttgttttaagactcatctggtaattcttttctatcagagcagggttaaagtttgctttgaaaatgatcacatggagatcaaactctctttagcgaatgggtagactgaatccaaggctttttttttttttaacatttaaatgccctctccacaagccccaccacaaagttattttgaaaatacgaattcagtactattcgatacaagaaaatgttggtgtagtcagtgtcttacaatgtatattttaagtgtattgtaaaaaagaatattcagtgcatgaatttctttttcttattcttttttttttattttgaggtgaggtctctctctgttgcccaggttggagtgcagtggcacaatcatggatcactgcagcctccacttcctaggctcaagcaattcttcttcctcagcctccccagcagctgggacttcaggcacacaccaccatgcctggctaaacacatttctttggaagagtgccatttagctagaggcttggggatctttaaaaatactagaaatgacatctataactttgtcagaagcacattcactcattaattgatagaatcattgtccccttatttagactcaaggcttttgttggaataaatgttttcccttccttcttgtttgtgttaggctttcttcttttctttgccttttaatgttctttcaaacaaatagaagactgagtgcattcgctcagacatcttcatttgttcaaataaactccattttttcagacagacttgaacaaatggagagacagttcgtgtgtcacctaggtaaaggctgtctgctaggggtccttcaacaagcaaaaccaaggtccctgcacacatggagttcatattctagtgaggagagacataaacaatttatgcaatttgtgtcaacctgattggtgcatggagaaggcagaaaaggagggaaggaagtgagccaggtggtcagctggcagagaagcgttccgtagagggtacaggtagagtacaatcctgaagggtgcagaccttttagttctgcatcttggtggtcatatgtattggaagagcttgagaaaaatgaaaataccatttagcttaagaagttgtgagttatctgcaagtcaactcatttcaggagtggaagaatccccggaatgatttcctaatatcaaaatgtatgcaggtttctcttttgaatgtcttgtatatttagagagggtgctgtacaaagtctcttgttttccatacagcaaattccaggatcccttgctggatactgtggctggagcaatgtgagcaacagaggcagagtccgggaggtgatgtggggctggggcactcatcatggccttataggtctgcgccttggtccacattcgtactgcagttattgtttttatttgtgataatgattttatactaaataatggtgatattcctaccatatttaccacgtagtagtgtctgaggtttctgattctttcgaacaaatgcctcctgttgaccctgtttccatttaaccaatcaacctagatttctgctttttgccccttcatgacaccaacacagtgggttgaaattcaaaacaagtggacttcatttcatgatctcatgtgcttcttatttaaacaggaaataggagcattgcatttgacaacttttaactgtgtagccagataattagcttgtgaaaaacatactcagttttacaaacaagttgtgattctggaaagtaaaattagtcattatagtactactttgcggatttacctcccactgcatgctgttaagatctcatctaagcaagattaataaaaaataaaaaatcttgactaaacatctgttgcaaagtgactttcaatttggctcttcaccatgtgactagtgattagagtttttggtttaggttaaggggatttgatttgatttggcatggtccctttttaattttatgtatgaggcaaataactgaaatgtccctgattgtcataagtgaaaaaatatcattaaaatatttgaattttgttcaaggagattaatctctataaaccaatgttttgtattccctaattagaattatggtagtcaccagtatgatcaatgctaagtgtttatttggtaattaggaagtgcaagctctaaattttgataagattgatgaaatggcctcttctcatattttcattatgtccgtataaacataacttagaagttggaaatatgaattttgtctacataacagtggacatgctacaacaaacaaatatatagctacaaacaaagctatatatttacattgatatccccttgattatttttctcaatgagcagacattcaagagatttttttcccccacaaaatgtgatgtgaaacatctacaatgtatacttgccaagtgcataactattaacttactccaggtaccagatggtcttattaagatactaattaatgtcaactctgacaagtgaagctaatgtttaaattcagctgccagtaagttctctgtcagagcactcccaatagaatgtgagttatatgcgggcttctagaacaatgtccaaaacacagtgtgccttcgcaaaggtttcagcgaacggataaatactgtggctacattccctttctaggaaataagaattataaaaaatgttgatcttctaagtttaattttattatagtttgaccttacatataagttgtgttttgaaggtaccattcttcccttcttagtaaaaatgtaacagcatccatacgatgtgatttcggctgctccattttattgttgatctacttgttcttcaataatagaactcttgttttataataatttccataccatgtttgttaaccaataatatccataaccataacttgaggcactttgttatagctgatcctgaggttaggaatacttccttgacatgatacatacagtatattaaaccaacattcaaaataatagttaaaaattagacactaaaagcgtgcccattaaaatcacttaagaaaacaggcgcttgctgtcattattataatttgacattaccgtgatagtgcggcctgaggagtaagtctagaagcagaattaagacctacagtgattagaaaagacaacacaaaaatattgacagatgttggtttgatgtatttagaaaccctctccaaagtgggggaaaaatagtttggaagtaataggagaattctgtaggttcaattgcaaaatgtacacatcaaattcaatagtttaccctaatatacaaataaaaatacacaaaatgttcaaagggttatttaaaaaagcactccctccaaaagacacaaaaataaaaggagctgttaaagatccgtatgatgaaaaccacaaaacattcctgaaatggcataaaaatagacttgaacaaatggagagacagtttgcatgtctaagtgggaaggctgatattgtaagcctcttcaattaatttaaaaattcaatggaattccaatttgaatcccaataggaccttgtttcagactcaataatgtgtttctaaagtacatgcaaaagaataaattggcaggaatactcaagaaaaatgtgaaaaacaagggtaatgtgaagtaggccttgcaatactgaatagcaaaaccatttgaaagctacaataaagtattaattaaattgaaagtactctgtttctatataagtgtaagagcaagaaggaatcctttcaaatacaacattaattacatatggcttataggacatggtgattttcagattttcttctttattttaaaatatataaaatatatactttatattttatacatataaagtatatggattttatacataaaaagtaaataatatatgtacattttatacatatataataaatacatataagtatatatactgtataaagcatatatacttatacataaatctatataaagtatactttatatactttgtatgtatagaatactttatatatgtatactttaaacattatatactttgtatactttataaagtataaaatacgtatattttatacattataaatgatatactttatattttatatagtaacatccattcttcttccttctaaattttgacagacaatacagttgtgtagccactaccaaatacaagatttagaatatttccatttccgtaaaaatatttctcatgcccctccatagtcagttctctcttctttgtcactctagtactgccttttctagaacgacataaaaatggattcatacagtgtctagccttctgtatctggcttattttgcttagcatgatgtgttggagattcactcatgtttatttaccagtagtttgttcctcattcttgctgagtactattcatcatgcagatatgccataatttatttgtttatttagtaggtagtaggtgtttggagtgtcccctatgtgtggcaattatgaagaaagctctataaatacttgtatagaagtctctgtgtgggcatatcttttcatttctcttgggtgaattcttagaagcagcgtggttgggtcatgaggtgagtatattatcagctgtatatgaagctgccaaactatttcctaaaatggctttaccattttgccttcagaccagcaacatgagtttccattgttctgcatctttgtggtggttgttttttttttaattttagccattctaataggtatatagttatatttcagtgtggttttaacttgcgtgttcctattgactagtaagatagaccatgctttcatgtgcatcttggccatttgtgttccttttttgattaaatatctgctcacattttttgccaatttttggtgggttattttcttcttattggtttttgagagtttgtcatatactgcggatggaaaccctttgtcagataggtgtttttaaaaatattttctccagttctgcagtctgtctttttactttctgtatagtgtcattcaaagaccaaaaatttttaattttgatttaagttcaatttatcaattttaaaattttatgtttcatgctttttgtatcctaagaaatatattcctatgcctaggtcacaaaagttttctatgttttctttaaaaagttttgttgttttaagttttgcatttaaatctatgatacattttgagtcaatttttgtatacggtttaaggtatggctcctttctttctccctccctccccctctcccctcccctccttccctctctccttccctccctcctttgctccctccctacttccctccctcccatcctccttccttcccttccttccttggtatttgggtatccaactgtttcggcaccatttgttgaaagtacagtttgcacattgatccttcttgacacgggttttttttttnnnnnnnnnnnnnnnnnnnnnnnnnnnnnnnnnnnnnnnnnnnnnnnnnnnnnnnnnnnnnnnnnnnnnnnnaccacactgtcttgaatctgtagttttataataagtgcttaaccatattgagtcttccattccatgaatatggtatattcctccaatttttaggtcttatttgactcccgtgtcaatgttttgtgtgtttcagtatacaattttgtgactttaaaatattcttctgtatatggttttgtgttttattcttcatcaccatcatcatcaccaccattcatttatgtagccagccactgtgcaaatatccttaaatacatatctaattaaacttttcaagaattccagattttagaatcatgatccgagttttacagatgaggaaaacgaggctcagaaaggttaaatagcctgttaaaatttatacagcaaacgtacccttggtcaagtgattattccaaattgtctgcctttgaaacctttactcttgactcctaaactaattttgtatcatttatctatataacttttgccttaagaccaaaaaatattggccgggcgcggtgactctcgcctgtaatcccagcactttgggaggccgaggcgggcagatcacctgaggtctggagtttgagaccagcctggccaacatggggaaaccctgtctctactaaaaatatgaaaaattagccgggtatggtgacgggtgcctgtaatcccagctacttgggaggctgaggcaggagaagcacttgaactcgggaggcagaggttgcagtgggccgagaccacaccattgcactccaccctgggtaacaagagcaaaactccatctcaggaaaaaaaaaaaaaaaagacaaagagtattataaactaatgaaaagagcgagggtgatgttgggatccatatttggcagggaagcaagatatttgtactctttcttacaacttccactgtattttgttaagacctgaatacacctctacagtggacagtccaaataaataagccattcccgtacttaagaagcatgcatatggtggagctttatgtgcaaaagcaacaaagccctctagttatattttagctcctcagatacttttctgagtgattattcctgctgcttaaatctctgtactactcccttttgcccaagttaaaatacctaaatcattggttgtagttctattattgtattcagtaatagttcctttgattggaaaagaaatacctcctttttagaattccctggcagtctgtaataactcccttttataatatttgtaacattgtgtcttaattaattgttgtcatataagtcttctcactagattgtgagtagaagctgttttcctttggctttttgagatgtttcatatgtacaaaaatgttgaatcagtattagtgttaaacacacgtacccacctaaattcactacatattaacattttgccatgtctgcattatccctgcatgtgtaaactttcttttctgacataccaaaaagttggtcacagacacagggacacatcattcctcgcttcatgcaactcctatgaataactgctctgtaggcacaggaatattatgatgcctatgaaaatgaacaatgattcccgaatagaatgtaagatctcttccctgtgaggttttccctttgaccttaagggtccccaccatttgtcttgtcaaatgctgtatactctgaatctgtctattcatttcctcatgatggaacatttttggcaaaaaaagtaactacttaagtgatcctgtgtgcttagcattctacctaaaggcccatactataattaggaagaatctatagggtgttgttttcagattgagtgagtgtcttcgtccccaaagaccttttacctcgaggtttcagtgcccattgaggagcctcctctggaccaaccattcctttaggagttgaaaccttcagttatcaagttctcttcttcattccgtgtttttttggctcatagtcttccgtaggtcacagctttacttttgccctcaaccctgccacgtcgcctatatgtctgtgtagacacatggatttttttctcattcaatttgctacatttgtttgttgtcatcgttcattttgatattcagattgtctcaagcatcccacacgtggccaggggagcctccccacaccacctcctgtgtccttttgacatggccccactagcctagaagaaagacgtgacccagcctcccactgaggtcattctggtcaggggctgtttttatctcctgctgacctactcttgggaactcaatgatgtcaacacactgcacactcattgaatgttggttgagtgttgcacttggcagtgctcttcatggttttgaatcttcttgtcattttagccttatcccctccatttctcatgacccattctagaaggacccatttagggaagcttcaatttcccctggggtgtggggaaagtgagacaaggggtggaagtagaacctcagtgggttgtgcttcctgtgttgatgctttcctgcacaccctgctggacaggtacagggctactgcagaattcctcgtgggttcccacaaattgagtctcagtccaccacagtaggcgattttgaaaataagcattaggcatttatgactaaaatcactttggtagcttatgtagttgtaagtagataagctattggatgatcacttgtcatgtgcagtgtttgagcatacaaccgcatacaacatatgtatgtattatgagtacatacatatttataagaaataccataaaagattatctatgtttttatttactataatctcatatttcaaagtatcttttattctccttacgattcatttatttaatgttttaatactttataatacttaagtatcatcataaatatttaatacttaatatttaatgatgtgtgtgacatttctccttaatacatcatccaaccaatgttaacaatgttgaggacagtatccttttatgatttatgtaaggcattccattttagctaagaaagagtttcaactttcatttataacaatgataattgtagtgtcctttatctatgaaagtcagtttaaaaacacgtatagacatattgatcttctcttcaataataagagtttttttaagaccgagttacgctcgtttctattatagtgtgttttcagatcctctatatcatgcgataagacttcgaaaattctaaactctctaaggctctattattacgtgatatattgagtatataaaaataacgtataaaattttctgctttgctgtcttgctttaggatcaaatgaattatattaagaagctgcaaacaaagtatatagtcctcattacaccataaactataattttgtatgtaatatttgattataatttatttttatacttcataacaaatgtgaatatgtgtttaaattattatactttataagtagcaaataactgttatgggtaatttaagatccagatattcccttttggtatatttgtccaataaacatcttctgcaattactgccactataaaaatgaaatcgattttgtttttaaattatatttctttcctttagtgcctggaatggtatgagatactagtactctataaattcactaagcactcagtttaaatttaagaacaggttaattttgttgtagtagttccaaatagctaaaagatgacattagtgtaagttattttctgttttatatagttttggcttttttttttttttaacaaacattcctcactctaaagttctttataaaataaagaaattgtaatatttgggagattaaatgagtaaaaattaattatatattgaataaaggcatcatgggaatgaattcatctttaaatgaaaaaaggaacaatttcaccatgggttgtttatatgggaaaggttttatgagttcactgatgagaatggacacccattttccggtgagcttcagttttaacaataatacctgaatcagcctttttattatgtcttatgcttaatcaaatatttaattaataaaacgtgacatactttttgagggcacagcgatgactcctgacattcaatgtatgcggcactgcacactatcctctgtcctcattttacaacatcgttctttctatatttttaattattctttctttcttatactccccgcccccttaatcttaaaaggattttgaggtagctttaaagaaattctatataatatgaaaacacatgtgtgagaaaatcaaagcaacaaggagaagctatctcatttctatttcaacaaatataagtgaaagaacaatgttacaaggattatagaattttgcaagatttttccaagtatgttattattttaaatctgagaaatatgatagttataagggcaaatcgtttgacttgtcctgaaaatcactaagctgggggaggaatataaggaagatatgatgatcatgaatataatctcatatctacctgaggatagtaattatagttctttggctgggcgcggtggctcacgcctgtaatcccaatgctctggaggccaaggcgggtggatcacctgagatcaggagttcgagatcagcctggccaacatggcaaaaccctgtctctactaaaaatacaaaaaattagccaggcgtggcatacctctagtcccagctactccggaggctgaggcaggagaatcacttgaacccaggaagcggaggttgcagtgagctgagatcgcaccactgcactccagcctgggagacagagcaaccctccatctcaaaaataataacaataataattattattattgtagtttttttacttctcttacattttctaaatgttcttcctttcctctgggttctgtttttgtttgtttgggcctcctttattaatgctggatgaatttttttcacaaggcccagtactcttgctcagaccctctgtctccaagtttgtgcacagagcatggaggcgcatgggctttcctgcatggcaagcctggatgggctgagctgtcatacttttggaacctccatgcttagtattagtgcttatgttctctttggctggtcattttcaccaaagaggattcttctggtcttctttctaggtttggtttgggactaaggttaggaggggttagtttaagcctccttgctgatatgctgggagctgagcagaaaagagagaggggagtatactgtttggtttgacatcaaactaaacaggtgtttcttccaggtggttcttgtcattttcttctgcttttcaggtacctcccttgtccagagagtaaacatgtggtcctctccccaggagtgagttggagagcccctcactggacatgctgggcataggcagactggatatagggtcacatttcaaagccatcagcactgttgtttttcatctcacatgtagcctcctgagtacctggcaccctccagtttctgggccttccttgggttttgcaccagggattcacagacttcctgttaaatgtcaccacgttcttgccttgagggcagttggtacccactcatcaccctctttcctgcttccagaattctcttgtctttagttgcatctcctcagagtcccctggtccttgtgggcttgtgcagttttaatatgtgccttactgtcatttaatgtgaggaactgggaatgcatgttttaaatagtttctaatttgtgatgtaggcaacccctaagtatattttgaaaaacttcagctctgtgcagactttgcaggagtttggggctaatttataacattttgaggttttgtttgttttttggactccctgtttttctctttcatattttctcacagaaaataccacctatgaacattttgccattggctttccctctacaaaagagaaagccattgtgctctgttggccttctatcttatcagctctaagaactcactcatacttggatttatttcaaatcattttaaagaaggacttgactctcagttacattcccttttcctatattctcttcttcataatattgctttacagtattgattctttggcttgaatgcgccccaaaagaaaaatcatccagaagtcatcaccattatgttttttttgttgttgttgtttagtaatatattttaaaatgttactggataattcattttcattgctttttatgatgattataagatgggtttattttcattaatatatttgaaatttaagcatttgagtgagatttcctcttcaaagtccttgccttagtgaaaacacggttaaactttgtaacaagacctcagttgaaatcatgaagcataatcccggattcagtcttcagggttctccttttattgaaaccgggcacctaccgtccacactcgtcactcctgtgtctctgtttacagctccaacagcttctgaggctgggaactgcccagagatcctttggaatttagagaacttagaagaacgttaaaatttctgcctgtgttgtgtgtcccagagagcaaatctgtgctttgtacaaagtgtgagctccagggtcgattgagacagctcttgtctggctgatgaaattaccaggagcaattttataccctgctatccaagtcacatggctaagtccatttttattacaccttcacagctcctcaagaatatgaattaaaaccctttggatttttttcttctaattcatacttagaccttccactaggcatagttgacaaaggcactgtttaaaagatatgtctcatcctgagtttccattcaccagtctgtgcttttgttagccttttgtttttatatcctgcaatgacatcctgcattcaacttgcctgtcaccgaatgtccccctgctccaccaccagcaccccattctacctgtgctgttttccttctactgagactcacttccacctgtgcccagttccacctgcctttccttctacccagcctcagttctacttgtgctcaattccacctgcccttccttctacctgtgctcagttctacctgttctccatttttcctatcaacctacctagtgaaatgggggcccaaacacatttaaaactggggcactgaggtacttccaggagggctgggggtgtgcggggacgacttctgtccagggctccctccaggagcagtgccaggcagtagccaaggccacaccaacagggggagccctgcgagagagattttttaagacaggagcttaagaaatggaactagatcaggggcaggcagggagagtttgtccctcctgccagatggatccttttctttctggaccacctttaaaaatattaacatactttctctttataaaaacaatctgggcttagtctccctccactcatgactatctggtatcttttctagtcattttttgtttttcttgtactatatattctttatattggtcaaatgtgtatacataattactgcagttttcctcttcaattattttctcatgctattaaaatattccatatttgcataatgtttcatgatttaatggttgcacaatatttcatcataacacaagttatgattgcttgacttgccaaataaaaatataagacccccagttcagcttgaacttcaggtaaacaacagttttttttttctagtatatgtatctctcatgtaatatttcattgcaacgtttgggacatatttatttttctttgtttatctgagattcaaatggaactgggcatcctgtactttatcttgcaaccctacaaaatatcacattatttacacagtttcttgtggtggatgtttagaattttcagcaatgctatggacatctttgggtatgaaattttctattttgaattacttcctttggtagattatcagaagtagaattacttaggagatgagtatttattttcaagacttttcaaacctatctccaaatcactttttaaaaaggttatagcaatttatgttcccaccaacagcacacaagagtcctcgttccctgcacccttgctcacattatcatcattgaaatacttctttgctattttggcaggcaaataatgatgtatcattttcatctttgattactaatgaggttcacttttttttgttgtttattaggcatttagtgtcctggtttttaaattttctgcaagtatatcctgacttctgtggccccattttgcattgctttgaagttataaggaatatgtcttatttttacttattgacttatttttactcagctgctggtgctggagcctagtccctatgttcaggctcagggatggttctgcacagtggcttttgctcccagcctacctgctagcctacccattgtctagaagataaaagcttcatttaggagtcatctcccaaatgcatttaaaataaatcagttaaagcacagaatagtaattttcttctgagcacacagaattaaagttttattttcacagagctcgctcacttttgttcctaataaatgactggtttcaaaaggcttccataaatacccgttttatccacccttataagcccacagatatgctgcagggttctgctgtgttcatggaaaccataaggcttcatggtatctgcagtatttgcccaaaaaaatactgataacccaaggatgggactccattcccaaagggcagggaggaaggggaggggcatttcagtgaattttaatatgcagatcatccgtttcctaatggagttcatgcttcaccttagagctgaaaaagcaagacttactttcgctaagaaaggaaagactgaacgatgcacatgacttctggaacatttccttaagtttggtaaagagggcacgcacagtgcccggcagcaccgcctctaacttgtggagatggcccatccttctggcccttctgggcctcctgtaattaatccccatcgcagttaaacaaggggccgcgtggttgccttctctgatatgctcttccagagagacttccccacggggcatttacatcctcccaggacttgttttatggaaattgctgtgttcgcttcagtttttcgttttctgtgttacaacggttttggcatttgttgccttgcatgaatttctccgcatgacgtgacagtctgctgcctgaattcagtatgtccacgtcacctgttcacgtcatctggcctgagtctggctgcactgatgtttctcattagtgttactctgtgctcataccctcagcattttgagaccccctcaaggattatgcttttctttctactttcagcctgatcatttaagctaagcacattgatacattgcttctggtgataaatagctgactttgtgatttcatttattctaatgtgtaagtctccattgtgtaactggtttgacctgcagaaaattgatttcagcacctactaggttcacctaggctgatataggcctcttcttcagcgggaaaagctcctcctctcaaggggaagagtccgggtcagcgactgcatcagggtcaattgtgggcagagtacttcgaagcctcttcttcctcaccctcttccagctttctctgatgactgcaagcgtagaggaaagtgaatctctaccttgtgttggtcatcagaagtggcttcagattccttagaggaagagttaaaatgtgcatctggatgaggggtaaagaaatgaggtcagccagtaagtacctgtcttatagtcctagagtacagcctccacacccagctttgccattcactccttcagagagtgaaacctctaagcctcagtttcactgcctgtaaagtggcacaggaagagaaatttgtgtgtgattgaaagaggtcgtattctattaaagtgacagtgttgttattaagacgattatccacgggacacatctcattgtcataaggagtagacaagatacaaaggcagcctttcttgagctgaatggtatgccaaatatttatatgtttcaaaagttcacaaattttgccattttactaatcattgcctcaatggaaaacaagcattatttagctgtttccctgaacaccaacttggaatctaaatctcagcaattatcatcattcacaaataatttatatttctgggcaaatggaagatatcatatcatcattattgtgtttgttcaatttgagtaatgcgtccttcgaggactcatttggaagtagatatgtgtactataggtataaaatggattggagaaaatattggattttaacatttcactgtaaagcctgtattccaaattaatataaaagacatttaggcattctgatatattgctggtaaaaggagagttagtaaaagaatgcaatttgagagctcatttaatagagaaaaaatagggacatgtctcaaagtgtgtttcatgctataattttaccaaacttgtactggcttaatgggaaaaaatatatatcctgtgtttcttaaaatgtcattaacttagggggcaatatttaaaagcaaggaaggctttacaatgttgttagctacaaagcctagcagtgagcaattgcagttaatggcaacagaactgcctagctcacaacccaccaccaaagcaaacacccttcagggcacgcaaacaaacgtgtgcacacccacgtccacacacatactggctgcctccatttgcaacagccggagagacgtttcagctttggccctttaccttccccattcttgattttctgtgttgctttcttttttcctccttcttttcctttccacccagctccgtctggtctgagaaactcccagctctcccacttgacattctgatgagcccacattcctcctgtccttcttctcggggaggagaattgggccataactcattgtggagttgtggtgattgcctccacatcgggcacagggggatacaggctgattttgagaaattagaggcctttctttgccatggcccaagaggagaggctgcacacacattttgccggataataagggcagcaagtttccaagagagcacaaaacagaagttcccatgatttccatcctgtctttaattttcttgtatttaatgcaaaagtatttcaagcttatttttccagtctggacaaccctgtatcaggaaacacttgaggtattaatagttagagagaataaaatacagccctgagtgtgagtgcaccagtgtttctcattcatgttactgtgtactcatgtcctcagcattgtgagaccccctcaagggttttgcttttctttctactttcaacttgatattctaaggaccccctaccaaaaaacattcctgaggttggaagtgacccatgccttatgctgatcttccctgagagaggggcagcagaacccagggctccctgcccatgccccgttgcttctccctgacagtttcaagtcccagaatctgggatgatttcggcttttcccatgagtgttgctctgtctcatctaattctatcttttgattcatttacagggaaacttcgtggcttgcatgacagctattttacgacaaatggaagattaccattatgcccacttgatcaagacttttgggaaaatgaggactgatgtggtagtaagtgtccctttcaccctgttcacataaccacgttttagggccagcactttagacaaaagcctgatatcaatatattcatttaaaataggattttgcatgagaacttgtctctgattgatttcaaatgcctcctgggaaggtctgactgaagccttgtttctaacaagacaagggtccggacttgcagacttgcttctagggctgaatggagaatgactcaggggctgagcccagggaaatctcttgtctttcttggtgacagtttcttctcctgtgctttgggataattggaaatttggagatgttatccatggatagtctcccattaactcctattcatttattggttgactttttaatagcagaagccagagtgacttttcagctttaagttgtactccattattaattagctgtaatcatggaagctcatcagcatttctccaaataattctctagtcatcctcagtaaaactatgatacaacttaattaggaaaagtataacagaggggaatttattgcttatgaactacctccctaatgacctgaaattacattgccatatggcaaatatcctctgcaaagctgcaaccaaacttgttggcagactttgtgattacatgttgacttgaactctaagattccatttctaaggatctgtaaggtcctgtagaacagggtccccaatccctgggccacacagcaggaggtgagtggtgggcaagggagcattagtgcctgagctctgcctcctgtcatatcagtggctgcattagattctaataagagtacgaacgctattgtgaactgtgcatgcgaaggatctaggttgcatgctccttatgagaatctaatgcctgatgatctgaggtggaacagtttcatcccgaaacctgccccaccaccccctggtccatggaaaaattatcttccacgaaactgatccctggtgccaaaaaggatggggaccgctgtaaaagaatactcatagatacctgcagaacatggcagtgtactagtgtttctagaacaggggttgttgcacttgacatgtaccttattaagaaatgggaagaagagaatgatctgtatgagttttttcaaaggattatttctaatacataattttcttattgttgccactatatatataatgcatagttttcttatatatctatagtggcagcaataagcaaattatgtattagaaatgatcctttgaaaaaataatatttttatacttatatatacatatatatacacatatgtacatatatacacacatatatacatatatacacacatatatacatgtacatatatatacacacacacacacacacacacacacgcagtcgtgtgttgcttaacaattctgccaaatgcatcgttaggcaatttcatcattgtgcaagcctcatagtgtgtacccttacttaaacctggatggtggagcctgctacacacctaggctagatggtctagcctgttgctccgaggctacacacctgtacagcatgtgactgcactgaatactataggcagttgtaatacaatggctatgatgtcactaggtgataagaagtttcagttccattacaatttttggaccactgacatatacacagtctgtcattgaccaaaatgttattacgcagcacgtgactgtacttcaagatttctaaggagaacaaaaatggatctagaccttaaagctctagcagtttcctctaaataaaagtaagggaacaagaatatgtatatgtttgtatttctgtgtctggttttccctgaatattaataagtagttgatagtaggagtatattcaaatgtgtaacctgtatcctgtttatatcccatgactctttggaaatcatggcatagcgaaatcaaattttacatttgtaacattttattccataattgaatctaaactacacccgaccccctgctttggtcagtgtaaagcatagttgtagcttaaagctagaggaacagttttgcagataacgttccaggttgaataataaagtcttcagaaatagaagaattactcacctggaaaagtcaggactccaattagtactttgccctttttcagaacaatcacttcataaaagtccccatgtgcaaacatgtaatctgaactattaagtgctgtaattgataaggatccttcaaggtaagtgaaaagcgatgatgccgaatggcatttaaaaattactgtagcttgctgaattccaagtgtgtgccctctgtctttgctcagatcccaggatcagatgtttactgtgtgttgtggtcccaatttcccaggggatgtttttccatagacacaacagtttagaaaaatcaatgatttgtagacaatttgacttccattaagaaatgatgttggccgggcgtggtggctcacgcctgtaatcccagcactttgggaggtggaggcaggtgggtcacctgaggtcaggagttcgagaacaacctggccaacatggcaaaaccccgtctccactaaaaatataaaaattagccaggcatggttggggggcacctgtaatcccagctactggggaggctgaagcaggagaatggctggaacccgggaggcagaggttgcagtgagccgagatcgggccactgcattctagcttgggcgacacagtgagactccgtctcaaaaaaaaaaaaaaaaaaaaaaaaaatgacgtttgtggttttttataccacaaattagactggaaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttgagacagagtttcacttttgttgcccaggctggagtacaatggtgcaatctcggctcaccacaacctcctcctccagggttcaagcgattctcctgcttcagcctcccgagtagctgggattacaggcatgcaccaccacacccggctaattttttttgtattttttagtagagatggggtttctctatgttggtcaggctggtctccaactcccaacctcaggtgatcctcccgcctcggcctcccaaatggcctcccaaagtgctgggattacaggcatgagccaccacgcccggcttactctgacaactattaaataaaagattattttgtacagaattatttgatgttatttcgtatttcaatatgaaagtggccaaaacactttccatttttttttaaattttattattattatactttaagttttagggtacatgtgcacaatgtgcaggttagttacatatgtatacatgtgccatgctggtgtgctgcacccaataactcgtcatttagaattaggtataactcctaatgctatccctcccccctccccccaccccacaagagaccccagagtgtgatgttccccttcctgtgtccatgtgttctcattgttcaattcccacctatgagtgagaacatgcggtgtttggttttttgtccttgcaatagtttactgagaatgatgatttccaatttcatccatgtccctacaaaggacatgaactcatccttttttatggctgcatagtattccatggtgtatatgtgccacattttcttaatccagtctatcattgttgggcatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggatctagaagccacactgacttccacattggttgaactagtttacagtcccaccaacagtgtaaaagtgttcctatttctccacatcctctccaacacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttttaaatttgtttgagttcattgtagattctggatattagccctttgtcagatgagtaggttgcaaaaattttctcccattttttaggttgccttttcactctgatggtagtttcttttgctgtgcagaagctctttagtttaattagatcccatttgtcaattttggcttttgttgccattacttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggttccagtttcagctttctacatatggctagccagttttcccagcaccatttattaaatagggaatcctttccccattgcttgtttttctcaggtttgtcaaagatcaggtagttgtagatatgcggtgttatttctgagggctctgttctgttccattgatctatatctctgttttggtaccagtaccatgctgttttggttactgtagccttgtagtgtagtttgaagtcaggtagtgtgatgcctccagctttgttcttttggcttaggattgatttggcgatgcgggctcttttttggttctattttcttgagactatttccttttaacaagtactaattcaggttctcaaatttagccctttttggttgagtgagtcattttcatacaaaatcacacttactatcaacaccagtgacagtgagcatatagagcacaagcggaatgactgatccagaagagaaaaacaatagacatgttcagctcagaactctgaggacagagaccatcccaacccttttggattcgaaccacaaagaatctgtagaatcttctacactggagatgctgacctgcccaaggggctgctggctgccacgtgtccacgtctcagtaacagaagcagagaatgtgccccgattctctgtagttagctagaagggaacaatgacggctttggtacttctagcggagaatgttgtcttgccacttgtcacaaattcccactctgtggctttggaaaacacactacattttcctacactctcacacttctgtgaccagaagtgtgtgggtctctcccaccgcatcccattccctgacaccagctggatgtcctacaattcaattcaattctgacaccatctacctggagttagcatcagattctgcaaggaaaagggcttatctgaccttactcagatttcaccagtgttttacttattctctttccactgtggatcacaaaaaattttacaaatacagaaaagctgaaagaataatacaatggagccaggctcagtggctcatgcctgtaatcccagcactttgggaggtcgaagcagaaagatctattgagcccagaaattcaagaccagcctgtgccacatagtgagaccccatttctacaaaaaatataaaaaaatagccaggtatgatagcttatgcctgtagtctcagctacttgggaggctgaggcaggaggatcactttagcctaggagtttgaggctgcggtgagctaagattatgccactgcactccagcctgggtgatagcatgagaccctgtctcccccccccaaaaaaaaaaaaggaaaccatgattcctgccacctcaattcatccgttgaaagcacgttggcatatttgcttccgtcatgtgtctccaagtgtctctatctatacagccaacccctttcagtcagtgagagacagggatgcacctgccctaagctgttcagcaaacgtctctggggactaaagacattctctattggtcatattgctccatgagaattcagcaacaacccctcatgccatttgtattcagatttcctccattctttccaaatttttttgtccttttcacgcattgcatttgatgattgtgtctctttaatctttctttttctaaaataaatccatcaccatcacactgttttattttcttttcatagcattgcttttcagtttttttgaagagaccaatccactagcttttgtagactatctcccattctggactttttttgtgctgccttgtaatatgcctttcgactggtttctttatccccctgtatgttctgcaaaccagaagcttgttctgagattcaagctcaactccttggcaagagtgtttcagcattgctgtcgaaagcttcctgctgtgttacttcaggaagtaacacaggaagtgggcttgtcatgctgacccactactggcgatgctgaatttcaccactgggttcaaagctggtaacttccagatccctccattgtgaaagtatgtacctcttcctacctttgcaattgtcagataatctttggataaaactttgaatccacaaaaatgtggccatgtcctatttccctaacaatccttcatcggatgggttgaaaatctgtggctggtccttgtccataatggttactcctttggctgagcagaatggaaatttcctaagtctaagagtgaagatgctttgtctttagtctaagagcattgggaagccattggggaaatgggttcagtgtgatgtctggaaagcattgatgccttgatgagatttgtcatttgaaaagtgaagcatggggacaagaaaggacaaggatggacctaagttgatggatttggagtcccctgtggcagtccaggtgcgagaggatggctgttttattctagtgggtgggcacagggatggaaaggtgcagacagaggtatgacacgattttgcctctgaagcagatggatggctgctattagagcagcctgcttattgtataagacatcctgtgaatagtcaaactaaaacatgcagccgggcacagtggcttacacctgtaatcccaacactttgggaggccgaggcaggaggattccttgagcccaggagttcaagaccagcctgggtaatatagcaagatgccatttctactaaaaataaaaaaactagccaggcatggtgatgcacacctgtggtcccaggatactcaggatactgaaacgggaggatcacttgggtcccagggttgaagctacagtgaactaagatcgtgccactgtactccagcctgggtgagggaatgaaataaataaataaaataaatagaaactaaaacaaaaaatgcaacaggaataaatccacattgaatgatgaaattttcacaaaatatcccttgttgacttggagaccctagtggaacagtccggtaagcctcatcagctgctcaaggcaaacacagttgttaggggccaccgccatggctagtgaattatgcagaaaacaaggacgccttgcagaacctcatctcccactagatgcagcattttgtttgatcagcaaagtaccaaaatttaacagctgagccatactaatgaagtatgggactgtgtctcttagaaaagaaagagaattgggaaaatatgcttctcttccagaataataaaaacgagaggctgtagctcaattattaggctttgagaagtaatcatcaagaaagccagcaatttcatgcaaatagagatgtgactgaattacggtactcagcctacaaaatatgcagcctggtcgttaaaatgggaaactcttgacaaagtgaggaaactcagtagtgaaatatgaatttcaataattaaactggaaaagaagccatttgttgtgtcggaagggaggactgggatgctcccgctcctgagagcaggtggacacagtgcccacgtacagagtttggaggacatctggactgacttttccaacttgattttgtctgggtcactaatgtctcctagactggaggcatctgctctaatagagtgatcaggatcactcattttatttatggtgggggcacaccaaactcctcacactacagacttcacctgctaggacctgactttgccattagagttggagagaaagtatcttaactttgaacattagcttgttagtgtcatcaattttaacttgtgcctctttgcaggagctgcttatttagaacttcgtactgggaattgctttcttggctgcttaaattctgttcaccaccttggccttcacagccattgcacctaattatgattcaggagattaaataaatgagaaatatccactcatttggcaatccctgaccatggcctcatttttctaagacagttctcggttgtcttttcatttcctaccttgagtgttgagtgagcttggggctaccagggatgtgtgctttttgggatagccacttgttttgttcaggttagctcagagcacctgtcaagctctggaaagtaggaaaccttctaattctgatagacacatactggagtccctaggaaccggctaccccttcctgatgtcaggcacattccatggaagcagggtagagcagctgggtgtgtacggaaccctgcttcttttcagttgccctgcgaagtacacagcatcatctaagacatcagaagcataactcggtagcttttggggatgtagctgccatctaggagagtttggcaacacggccgcacactcaaatggtttattgcatgccaaatctgtgcagatggtcaggagtacctgttggagcctttcgttttgaaattccgtaagagaaaggaacagacagtagtatcccgtattcaatctgatgtgtcctgttcatcatgaaaaattgatttagagcaaacataagaaaaagctgtaacctgcaagccttgtttgttaaaatcatgttttcctagaagcagaaagggcttgaatgcctattcctaacctttggggatttactctttaactattagagagacatgctcagggactgtttcagaatatattcttgaagaagccgtctcagacaggaggtgctcaggtaaacagaaagacaggtctaattcacagctcctatgaaatatatcttcattacttttcaggatgtgttcattcagcctttaaaatggggtattttataatctaattgacaggagggtatcatgtttacctttttctttgtgggccatttcagtgttttgtttttttatttcaggatttcctaatggaaacattcatcatgtttaagaacctcattggaaagaacgtttaccccttcgactgggtgatcatgaacatggtgcaaaataagtaagtgtggggaaaacggctctcaccttttctatggctcccaattcatgtctgctgggaacagtggtgttgcctggagaccaagctggcttcaataaaatgctctgcaaacgctgttcctaattctgtgctgcagacagttctagggagacagggactctgagtttgtggtgacttccttatgacaacacagggctctggctctaagaacttgagctccgtcccctggagaaaaacagcctgaagctggatctcccctagctgtcatcatgggcacaggggttctgctcgacgtcgctctgcgctctcatgttacccacatatttgtatcagccctaggcactgtcagctccatgcaagaggcttttgcaaagtgttgacatttcacatatttcagtttttttaatcatgagcattttcttcatactcattaaatattgaacttgtgccttgtttataatctccagtgagggctgttggttaattttctagcacattgggttttatcatttctgtaagcactaacaatgaccatagaattctcaatcacgtgggatttttaaaaagaactttctgttcatctctgtttttctttctcattgcaatttttatggagataattgtgggttcatgtgcagttgtaggaagtcatagagatcttgtgtataagggagtcgatgatgcgattcactgatcttactcagatttcctcagtttaatttgtattcattagtgtttgtgttgagttgtgtagtttcagcacatgcatatactgtggactccaccaccaccgtgaagccactgagtgtttccatcaccacaaatgttcctcttgttgcccaattatagccacatatacctctcccctccccactccaccatccgtaagctctctcgaccactcattcgttcttcatttgtataattgcttcatttcaaaaatgttacataagtgtaatcatacagtatataagctttcagcatggctgttttcactttgcttaattcactggagatccatttaggttgttgcctgtatcaatagcttattcctttttattgctgggtagtgtcccatggtacgcctggaccaagtgtgatgaaccattttcctgttgaaggacgtctgggctatccccagtttgtggctcttacgaataaagctgccaccagccttcgtgcatcagtttttgggtgaacatgagttcggttctgtggcataaatgccttcctggacaaatgctggcttgttgggtaattgcacatttcgtgacgtaggaaactgccaatctatggctgtaccattttacgttcccaccagccatgtaagtgattcggttgctccgcatccagcctttgccgttgacactgtttttgcttttagccatgctgataggtgtgtagtgtatctccctaggatgttaaattgaatttccctgtgatggctttgcctctctttaatgcctattgtccttcccttcgacaaatccaaagcagcacgacctttcctttggcctcctctgggtttttctgctttactggggcagcagagacagattggccttgtgtaccgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtggttccaggaagcttctggagtctgtatttcagttttaatggcacagctggacatgtagttttaccacctacggcttagaaatggacaaaatcagcctctgtggtctcttatgtatttgtgtgcttgtttgtctttgtctctgtgaacataccttttctcgatacacggggcttgtaaaatgtaattaaagacaatgtctattagttttggtgatataacttgtaaatcaagaatcaaaattacaggatttaatgactatcccaaagtacggtgttcacttggttatgtccaagatgggaactgataggcgatggcctgacattatagctgtgctctaggatatgagagtaccagatggcaagatgacatttaagatgagcacagcacagaaacagtagaagtgtgcttttgtgctagcacccagaagtgctttataatcttcccagaggggagcagctgctaaggtttcactgaagctctcaggttctgttggaagcacagacctttccctgttggcacctacatgctggtatccatcctggaactcttattagctgacttgctcggattcacgctttgtgtgtgcagcatagtctaaatggccagcaatcataccatggctatcatagaattctccttggttgttaatgagaatgtgaccacttgcttgaatttttgtgtctcttctagtcttagggtttgccttcgtgctccagtagggtgcttgagtttatgtactaataacccctactagaattttaagtgataggaatgacctggtaggaagtgagtctgccaggtaaaccgaatccctttgtcacctcgaagaaaccgtttcttattaactgctttacttttgcttgagaaaggcatttctacaacatgtggtgggtgagagagaggccagtactgaatgtaattttccctattttggaattagactttcttgttcgtattgactacatagcgtgtaacaaaaccttatccacagttgtcagctactgagacttgtaacggaatttttaaaaattcaactactccagctcacagcttccctagtcctccctgcctactgtaccctctgctctcaggataataaagacatgaaaccagcatttgcatttcctcagagctagtgtagtttgcaactgtgattatcaatcgcttccaggcattcctctctgttggcataggttttgtgtttgagacttcctgttctttttcaggctaggctgggacctacgggaaataatgattagtgttttgaagcccacacactttcatagaggacttggtatgtcttgcaagtaaaggttcatataacatgaatataaaatagaatatgtaaaattgtagagaaaacgatgctttctagaagttgaaatactcaaagctgactgcaggataaaacataaaggcaaataagacggttgccgggttctcactggttggtgaaaatgatccttgccatttatcacgggaagctggcagtttacaatgtagattttttttttttccaagacagggtctcactctgttgtccaggctggagtgcagtggcaggatcatggctcactgcagcctttaactactgggttcaagcaatcctcccagctgagcttcccaggtagctgggactaccgacacataccaccgtgcccagctaattttttgtgggtttattttcttggagagatggggtttcgccatatggcgcaggctggtctcgaactcctgggctcaagtgatccacccgccttgtcctcccaaagtgctgggattacaggcatgagccaccacacccggccatgatgtagatctttatataggagacactgaacaggagaagatcatagggaaggaatcagttgagaattcaaaattctgcccatagaaaacagaagagattattctctcagttaggaaatgcgtaagatgttaccagtcagcatgttggttataacagtggttggttataattggacttgtctgaaagactagctcatcaaatgaaggggatttagctgacctgatccattcagtcttgtctagtcgttgaccatttcaacatcagagattgtcagtcaaaaactattgtttggttttgttctatctgcaatcaattaatcttatacttgtcctttcaaactttgaaatttcatcccgatttggagtttgtgagatcatgttgctatttatttccagtgtctgtgtgttacacattaaaaaaaaaaaatcatggccatatggagaccatcccaaacagatcaggatgatgcttgcagtctgcaaaggatggaggattttgatctcttgacctcattttgacaaccaccttggctcatttctctgtggcctctcctcctctccccatgattcatccttctttcaaccaggaagtgttttcctcaatccattgacgtagcatattacattttcaccagcctgccatatatgatgtctatggacacctcataatcacatgcagctcctttcatgaggaaaatcgtccatgcttatttctgtaacttaacaatttctccctttttaaatagaatgcatttcctcacttataagtattatctaccagatgtatcagagtccaggatggcaagctctctgctatttctgccaaaattaatttggcttatagtcaggacaggaaagggccttaagccctagaaagggattccaccttggagatgccagttccttaaggataagtcgtgttggtgctcagaaggcaaatttgcagggtaggctgtttgcaggtactttgccatttgctttcgttgccgtgaaggaatttgagtcgttgaccacactgagctgagggcttggatcaggggaaaggcaccgcttgccttaggatgggagagagggaaaaattagtgcccacgtgcagggggcctgcccccaggaccatggcaccagtggcaacctgtggatggccaagtcaggaggactgcttgttttctttcctgttctacctccgtccagagaagcacctctgcatcccaattaagggtgcatagttgaatattctttgtgcaggttgaaatcatggttataaagcatttggggcttgagaaactcttggattattacttcttaacatcttttttcctttctttgaagcctggattttagttgatgttgtgacttctcatttaatttatttttaatatttattggcttactattgaggttttgcacagccaatggcttgatgattttaggcacactttagaattatttttttcctttgaaacagtatacagcagttgttgacagcaaaacacaactagctaagtaccaaaacacacacacacacacacacacacatatatatagactgtactgactatacattttgctttgcactgagagatgtttcatgcataaaatagagagggcacttggctttggtcctcataacatgaagtgcctcctctggcattaagtgccagtggaatgtggcattaacgccagccaggtgctcacgatgagatgtgcatggtctctgagaatttggggtgaaaaaaatagcaattgaaactcagtatagtgaaaacattctggaatgaagatttccctagagttctccatacctgcattttactacagctcatgcacttaataatattgctctttgagccttcttcctctccaagaaaactggcctaacctgagacatttcacagcccagagtccccagtttgcaggcaccagggccacagttctccttcctaggctggttaacttgggctgtacctgagtgcatttctggcaagtcacccagagaaacacatgagacttttctgggggctgtgttggccattgtgatgcatcaggatttcaagacagatactgacttggatccagtaatgatgctctggaccctccagcaggaaaaggaccccactggggctacattgctatgtctatcattttagttttatctccagaggttgcttttagaggggacacagggacattggcagttctctctcagcagcttttgggcctagatatggttgcagatggtgtatcagagcccactgcaccttgggatggaaactgacctacgaccaaatgctacctgttcgagttctgttcattcttaaggcctagtcataaattatttcagatactttccataacagttattctatttcatgtctgcttttgctctttgcttaataactaaaacaaataatttccagagttttacctggttgtttataaccaatgtattgcacatagcctagatattttaaactgtgtcgtcttattcagattgcctgttttaaattttaattcagagatgaaaaatcaacctactctcaaaggagtggcagtgatgaagagctctcagcaggactcttatttagggaagcttgctttaaaggaaagtttgaaaagggcaaagtctgtttaagaattctcagagatcacgcgcacctcgtcgggagtgcctggctggtactgatgccgcatcccgctggcacttaatgccggaggaggcacttcatgttacgaggaccgaagccaagtgccctctctattttatgcatgaaacatctctccgcacaaagcaaaatggaggagatacactttattatgatcctcctcccggtcctctcatgctaagttttaacctcctgtgctactgggacttggaagaaggtctgtgcagtataggaccctctggtgtggtgcttttacgtctagaacaggaggaagaggcagccaagtgaactgagtcctcgcaggcttgccaggctgtgtcttccgtgtctttttgatagttctcaatgaaggacagttgtttcccctagaggaaaatcgacaatgtccagacacgttgttgtcacaacttgggaagagagggctgctggcatttagtgggtagaaaccagggatgctactaaacatcttttcatgcacgagacagccccctgccgcaaagagtcatttcatccataatgtcactagtgtctccatgtgatagatgaaaaaacagagtccagagtctcagtgatgctcagtaactgttagaaatacatagaaatatgtgtgcagtggctcatgcctgtaatcccagcactttgggaggccgagggagttcgagaccagcctgaccaatatagtgaaaccctgtctgtactaaaaatacaaaaaaaaatcagccaggcatggtggcatgtgcatgtagccccagctactcaggaggctgagacaggagaattccttcaacccaggaggcggaggttgcagtgagccgagatcgtgccactgcactccatccagcctgggtgacagaccgagactccacctcaaaaaaaaaaaaaaaaaaaaaaagaagaggaaagaaagaaagaaatatatgtgatttattgcagtgactctcttctccttgtttccccatttctcagccacccttctctgccatgtgacctcagccaaaccagcgccctctagaacaaataatagcagctagctgctgaagataggactggtcttcacttattaggggggtgtccgagaattggaggtggtttccccaagtcgctctgccaggggctccagtgtctttgcaggagatttttgtgggctttgatttggggtggtgtttgggagcaagatggcattggaatcacagtgacatgaatgtacatgccagggctgcctccagtcctgcctggcatgtgggacacacgttgaaaatattagcaagagcctgttctcagggtgcttgggctgccagcctctacaccccaattctgccgagcctggggtgaaagagtagccacaggcctttcctctctacctctcccagccagaggccaccttcagtacaagggttggaagctgagccctggagtcagtttgtcaggtcaaatccgtgctccaccacttatgagctttgtaaatttagtgttgggcagatttaccccgtgctgtagtttcttcacccgtaaattagagacagaagtcaagcctcgctggagtgttttgggggaataaatgagaaagcgcatgtggggtgctttgttcagagcctgacctccagtgaccttgcaacaagccatgtctgtgaccccctccatttttatgaagatgacatgatagtgtgtcattgtccctctgaatctgagaattgagcccacaggtaagggtgtgaagcatagacattgccctggagattcagagcactttgtacatgtattgagaaattacattataaaaaaatacaattctttgctttcatagattcactctcttcttgtgaggatatttgtatatattcaaattgcggtttcccttgatttataggtaattaagtcaacccattttgcttgctgttttcctagaagcagcatttgtgaattgctttatgtgacatggctgacactctgtcaagcataggtcttgtgcagttgtctctgttcagaagccagtcaccaaaatggtggtcctatctgccctggcatcttggaaggacagagctgcagtccccagagaggatcctgtgttgtccctcatgtgcagatgaggttctgagattcaggggggttgaatgagtggctccgggccccctgtgtgagtagcaggagagactgcagaactggttgctcttaagccacatccaaggccaggcacataaaatgtggacagtgacgcccaccacccatgcagtccttgggaagccccgttggcataacgagaatagagagcttgacgaggaggtcctcagtgaatgaatgccagctcctgaccacgctcagttttggtaacagtaagtggcactgtctacagagcctctcaggaaccggggactccacctgcctcctctccttctcccaccctcagagccaatcatacacaggacccagtggataggactggagttccggaagccagctccccagcgcctcctccgagctgccatccttctctcctgtggcaggggtgtcttcctctgaaatcagtgtccatctcagtcctggccgcacctccacaggctcccgatgtctggcaagaaaagctaagcagggacttccaaacgtgtttgaacaaaactccaatgaagaaaaacatttccaatcactgctcgatgcacttccccacccccatcaaggtgtaactcagcgagaattccttactgtgcagagccctccgatgtttttattctgttctgttctgttctattccatcccatccattctatcccttttcacttaataagtaaataaatacaatttcgcattcttcccattctattgatttcgtgctccactgaatgaatcacagctgatgccagcctgtgccacccagcacagaaaatgccacatggctgactttcctccctccctccctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggtcaggtatctgtgctgtagatatctttctccactcagtgactgcaggattttttttttgtcacttaatagtgttctttgttggatgacatttaaaatgtcttttgaagacacttgcagaaagaacctgaatggactcacctgctggtgactgtctgggtagcaaggctcagcatgcttgctatgtggaagcttcacgaaatgccgtttaaaaaataaaattatcttcaaaaccaaacatgcaattccaccattctttgtcaagctcctgctattttttcaacacgaaattggaaataaagttgaataatatactttctccatcttcaagaaagcctgactgtgatatacttaaatttttaaaaattcacttatgtaatacatcttcaggtctataaaaaaatgataatgtttaattgtaatttttccatggaaccgaaatgttaacagcattgtgacattttctatacattgtttttcatgcaagacccttctgtgtggcacttaatatttgtcatgtgcgattttgtgcatttgtgcatgggtctttggcactgggggggatatctcttctgaacatttcagtggctgcactgtacactgtcccattacccaacacacagtaggtgctcaacaggcagtgactgtgtaactgctgggctgaaagaaggtgtatccctaggaaatgttctaggaacaaagtgaaccaataaaatacatgaaatacttttgtagcagttcattttggagaataaaaggcagttactctttttatatttgagtccacaaagaaacaattgcagctataaatatgcagtgaacaaatacctcttattctctttaagatctattagccagagctaattccttaattgaatgttgttctaaatttaccaccaaaatgcatgagggcgatctgtgtttgtatgtttcagccaactgcatgacatcagttccatcacaactgcaggaggatggaggaaggctgctgtgcacgattacttgctgttttgtggtcaacctttcccataagacttcagagaaggtttttacttaatactgtacctgtcaaattcccagagctgcaagtaaattgaagatacaaattatgttgtaaagtgaaatattttgtgttattcgcgttattctgcagtttggttgatttaggaagaaaatgaactctgacagcttgatcttttcagttcagtggattctaatgtttcaaaacaaaagacctgcactgaagcctctttcctccatgctttggcagagacaccactgtgagctcttcttcatgctcaaacctcggcagctaccggctccatgtcatggacacacagagtcctaggaagagatagattctgctaaatgctaatgtttgtaaatataaatattaaccataccccaaaagggaaggagttcttttgctggctgactgaatgggtagcttttagcacctgccacttttctcagcatgcaatctattttttatagacagaaaaaatctctttttctagtttttctggtttgctgctgttgcctcagtgatattgcttgggatgcagaggtttggcaaagaggttggaggagcacccctgcattagtccgtgttcacgctgctgataaagacatacttgagactgggcaatttacaaaagaaagagtttattggacttacagttctatgtggcttgggaggcctcaccatcatggcagaaggtgaagggcatgtctcacacggtggcagacaagagaagagagcttgtgcatggaaactcttctttttaaaaccctcagatcttgtgagacattcactatcaagaggaacagcacgaaagacctgcccccatgattcaattacttcccaccaggtccctcccacaacatgtgggaattcaagatgagatttgggtggggacacaggtccctcccacaacacgtgggaattcaagatgagatttgggtggggacacagccaaaccatatcaaccacctttcctcttctgttctgtggttatgctagacggcctcaccttcttttcttattcttattcaggggaaaacactaaagtgaagtttcctgcaagagccagaaaatcctaagttaacaaattgaattctgcaactgagatgcagtgggtggatgtagggctgggctccttggaccgaggctgaaccataaatacctcccactttggtattgctttgaggagcttcccagcattcacccttcacccttttgctgtgtgccttcctttaccttagctaaggaagtctaggcagctgtgcaggatttgataggtggcagctttagctcagactctggaagttccctgctccctgctaactccaagctggctccttgcagctgtccccagtgtcccttggactatggggccaggcatctgatttgattcttcaaactgaatgttactgcttctactttatttaagtaaatggccatctcattgccatctgatgctgtagcatactgtgcgaaaggtattttgaattagctgttagcagctgggtgcggtggctcacacctgtaatcccagcattttgggaggctgaggtggccagattgcctgagctcagaagcttgagacaagcctgggcaacacgacgcaaccccatctctactaaaagtaaaaaaagttagctgggtgcgatggcaggcacctgtagtccagctacttgggaggctgagacaggagaattgcttcaacctgggtcgcagaggttgcagtgagcggagattgcgccgctgcactccagcctgggttacagaggagactgtctcaaaaaaaaaaaaaaaatagctattagcctgcagatgatttggatatgggacctaaaaagcaagctgattaattgatagatgtatttatttatgatattcagcctgagaattaagctggatttagaataaagtgtttcttatgagatacgcttgggggtaaacatgatctgcatgtaattcacaggtcctggcatttcagagcagtattcaaatgcatgtctgccatggactgtgagctcccaaaaaaagtgcatgatgaagtgagtttcgaatactgacagaaacggtagagaaaggacatgtcctggtcctggctaccgttgatattctgcttggagcttggatttggggttgtgttttagcttaaagaaaccatatatacctccagtgagaaagagacttttgggtgaagagggactggagggaacccatggaacagaacaaaggctgggcttacggtgatagcccgcattcatttagagatggaaagttgctggaaactttaaaacagagcactgctgtcactgcctgatgtttttcagggactgtttgggccactgtgcagagcacagggagtaggagatttgtgtgcaaactggagggccagcgagagccctggggataagctacaccagcgatggccatgtctttggctaaggtagtcattgggaagagggaaacaatgagagatttggggcatgttttgcaggccacatgaacctgtacaaactagatgtaagaagtgaagaaaaatgaacaatcaaggaaaagtcttaatatttttggcttgagccaaaagtgattggtggaaagtttaaagataaagaagcgggcttgcgaggtgggagtgttcccgagctctgttttggcctagcgcagtgtttctcaaccctgtttattttttttcccattatgaccctcctaaggagagaagtaaattcactttaattaagaagagaaatttaatgctaaggaataagaatttgtggggtagggtgtgctttggaggaccacaagcagaataatatctaaaatgttctttaccctcctcccaagaatcaatttcacccccttagtggagatgtttcccccagtgtggatgtgtggcctggttaattctcaggtgcccaggaggtggcccaatagagaagtttagctagcaactggaaattctacactgacgttcagaagaaaggtaaggctagaaggtacaatttgggatttagatgatgatattcaggccacctggggggcagtgtctctagggaagagaagccgacccaggctaatgcctcagggctctttgatatctaggggtttagcagtggaagataagtcagcaaaggagaccaagagcaggagtcagtaataggaagaaaaaaaaaaacacaggagagagaagacagtgctgaatttctgagagagagcatagaaattaacagagaagtaaccaaaggatttggccacatagtggtcactgctcccatggaccagagctgcctcagtggagtggagtggcagaggaggaggccagcctgctgtgcggcatggaggaaggcatggaaggaggtaggcaccctggctgtgggcgttcattgggttttcatggcgctcagggtcagacagatggtgtgtcgggagctgtgataccaggagagtttgtaggaatttgctgttgatttacggcatgttgggaacactggtggagatgagcggatgatgggtgaaggtggaaacgctgggatggaggaggttcatgagggcaatgagttctagatgaaagggatggtacaggaggggctggcctggagaggagcaaggtcaggtgatttgttgcaacaggagaggacagagggaggtacaggtgtcaacctgtgtgtagatgtaggtggtggttggatgatggaaaaaaacccatgtgacttctgctttcctactgcagaatgaagtcaggtaattagtgagaaggggtgcagagaatagtcaaatattatgatctctatatctctgtgatggccatattaatatttcacctttcaccaatttccccgctaatgcccacgcatggcgtacaggccgcgttggagatccctgcggctcatgctgccttattacgtaatgccctggagaggcctcacaagtagaagagtctaaaacgatagattgctttaaataactcatgctaaatcatcctcctgtgaacatttctcgatggatcttgtcttttaagcttcaacaaaccctattagccatcaaaatcctccagtctctcaaaatagccctcatcagacttgctcccacatgcttgcgtcatggctgggtggccactggagaggttgggtggagatgctggctgtgtacataggaaccagagcccctagagagatgacttgtgtctgagcaccattcttaaagctttccaatacatgggctgtcagtggctgtatgcatcttctctgtttgacttggcttagggatatttgggaggggacaggggggacaggcagcattaagcatccttttgctggtcctctgtctttgagtgcagttctgtgatactcagatgtcttccagaactatcggctgtttgattgtggaaattcctggaagaccagggctcctgttccttctctcgccacccgtgctttttgtctttctcaccctctgttcctttaagaccacaaagcagggactcggacactggtgacacggacatttcaggctctagctgtgggacgcttcaggcaggcagcctgatcttttttccattttgtttagaggtatagattgtacacctctgctccgagctcctttatcaggccccagaaatcatggatgcagcaaaaattttgaaaatgaaatttttcctatattatcccaattactctttggtctccatgaagccattgtttttccaattcctctattgcagaatgcatgcagggaatttagaaatcacatggtaaacgttatgggccatttcctattgctgactttaccttcctagttcctcagagatgtaagatgaatgtccctggtgccagtgagcagccagtcagtgtgcacagagctggaaaaactaatagactagatgcatcttactgatcacgttgatgtggaggggcctcatctctctggtccagctggaaatgtgattgcttcctggggtggccatgactaagggattcctgtctcagctgcctctatatggagaactgagctcaactggtaaacgctcagtttccctttcagaaaagaatgttactctcaagagcagcagtgattcaaatggccttttgactttaaaaaattctccatttaaaaatgtagaagcattttatcctatacaattataaacattattggtagctaataaaaaattttgatgaggcagcagatcattaagaaaatacatatagaccttgcacacttcattttgacttccaatagataaatagatccatttcacaaagcatgtgcatttgtcaggttgctttttcttggttttgtttttttatttgacttaagataggtctatagatgagtgtttgccttcgttttctgtgagccagttttcatacctttaaagttgaataagggctgggcatggtggctcacacttgtaatcccagcactttgggaggccgaggcaggtggatcacctgaggtcaggagttcgagaccaggctgaccaatatggtgaaacctcgtctctactaaaaaatacaaaaaattattagctgggtgtggtggcgggcacctgtaatcactgctactggggaggctgaggcaggagaatcgcttgaacctgggacgcagaggttgcagtaagccagaactgtaccacggtactccagcctgggtgacagagcgagactccatctcaaaaaaagaactgaagacaatcgatgaaacgatttgaacgctttttagatttagtgagtcttttaagttgtctctcacccatctgacttgacagcagtttttcaagtgagtcatctttttaatcttttcaaatctttagaattcgttttcatgtaaaagtcaactttcttttcatagccctattttatataatatttcattaaaacagttataataacagatttatttggtataaagcaggtatggagcacgcacacagctgtgtccactcactaatccatgcgcacacgcttccctcttagctgtagacaccacatgatcacatcactaggggagctattcagtggaaccccatgctgtccttgttaggtggatttttaaacactctgttaaactaaaaaagtatattctcactggccagtgtccagtgtaagcaaatttgcacatggctgtcccttgagtcactgtagttaccttttaaaaggaaagagagggaaactccattgtgtagatctttccccagccaagagaccgttagcatgcggtacagtaaggcagccactcattaactgtttgtttacctggcaaagagggcaggttggtgagctcccaggtcctcagaaaatgagactaagttttattaagatctgaggggaaaaaaataaaccaagcagaactagaattcactggaccagaaggttttgttctcccttttccagctaatctctctcatccaatctgagagaattaagcaagggtgagggagttgcagctggctgaattcaggaagttaccaaagaaggctgatttaactgaaaagacatatattcttcccaaagcccaggctattgagccagagtacctgatcacccagcaaagcaccactcaggctgtgaggctggccacgcacagggaggcaaagagaggaggagagaggaacttaactttgtttttcttcaaaaagatgtgttgtttcttggcaaaatgtaatcaccattgttagcaaacccatgagatgctctcagcaatgtttatcaaatagaaagagcttccttctgtgtgacaagcaggggatcagagtgacagtgtttagatctgttacttacaaggtgataggggcaaaaattaatacctgcacaggctgactcctgaagtcttcatcaccagaaatgccagcatgatgtccaggccctaaggtgcctaccatgtccccatgagagacacacagtgccatgaacagtctgggttttccagaaatacttgatttggttaattgacaaattctgttgttcctcctttatagttaattaataattttccagtgtagcgtttcctatcagggggtgtgaatccacacacgtggctttttcacaataaaatagcattcatggtgccttaaaacagcttgaaatgccccaaattactagacttgtaggtggatttctcacaaattattattaaaggtaatgaaaatcaaaatcaaagcatttcatatttattgtgtctttagggcaggccatactttacaagtaccattttaagaaatcctctcaatagccataagagggcaggtcatatgatctttatttttcagttgaggaagctgaaggcaatactgatttagtatctcacacaaggtcacatggctaataaggcagagaagaatcagctttgcttgactccagagtccgtgttctgtatagacaaaggcatgaggtcatccaataaggtaatcgcttggagaaacatttttccctacttgttttgatgtagaacttctgtaccaattgtaaccctctgccggttgagtaaatatttggggttaaatataaagctgaaattcaaataaagaaacatgttactgttctctacagggctggtcctcaccttttcacaacgcactttggaaaaccagcacagaacaaaggcccctcccagcctggtgtattcagacctcagtgctttgcctgggctgcagctctgttgggaaaaggtggcagttcagttcccgaggctggtgccctcggcaagaatgggagagcctggtaatttataaaggattatcacatgcaaaggcaatgtttgttttattccatcatctctcattctttcaaagcagtggcgttttcttagtatcgccatgtaatagagttcgagaaaagtgaccttaaaattgaggcaagtgtcacactttgagaatgcattaatttttttaaagacattttagtggttttaaaattttatttcatatatatatatatatataatttttttttttttttgagacggagtctcgctctgtcgcccaggctggagtgcagcggcgcgatctcggctcactgcaagctccgcctcccgggttcacgccattctcctgcctcagcctcccgagtagctgggactacaggcacccgccaccgcacccggctaattttttgtatttttagtagagacggggtttcaccgttttagccgggatggtctccatctcctgacctcgtgatccgcccgcctcggcctcccaaagtgctgggattacaggcgtgagccaccgcgcccggccttcatatatttttatgttgtaaaaaggggaaacctttgttctttgagtaaaatgccctggtagtgaacattttttaaggttttttttattttgacagacatacccacatttcacgcagcatcatgcttacccattcacctcatcttgcattcagagagctctcaggcacttgcaaaattgaaggccagaatgaagggagctcagtcatccttgacaactgctggggacaaagttggcaatttgttcattgttcttgcaagcacttagcctcttgccgagcactttaacatcagagaattctgggcatagatcagaaatcagtggctgcagaggcaagctacgtgcaggtaagttaagggcttactatagaaatgcaaaatgccaccattcttcactgtgttctgagaggtttcatactgttgtcgacacctgtgctggtgtagaattgcagatctctttctgtcttttttttgttgtttttctccttttcattttttcattttttactccacgctaagaacatcggaatattttcaactttaccattggtaaaatagtgcaaaggaagtgaagatcacgtcagcccatggtccatattttattccttgagttaacaaatcaccaacactatttagtttagcgagttactcctttggaatttacagtaaagccatatttaatatatttccatttagcaagtatttgttttaaataacagccttggcttccttgtttggtttgtgagggagactttgcttctgtgtttccaacgtggctggaagtggaggctccagggctttgcctcactcatacagttttatttttaaattgaaaagtggatttgtttaacatcctccaagaagcaaactcataaagctcgggctttcctaaaatgcattgccaaaatcataattggtagaaagttagcaagaaagaaggattagctcatcgagccgtggcctagcaaattgtaatgggctcaagtagttttgtggcttgttgagaaaatgatacagagtttaggaagcagaaggacacagcaatgacacaggagagcctcacaaacaacaaacactgcctttgccaggagaattgggaatgggaccattcttgaccttcctggaagaactcagaaggacgtttcactccaggaggcatcaggagggaagtctttcattgttttcaaggaatctgttgtccctgggagtgggtcacaagtgctgcacacacacttggtgtctctgaaggagcctcaccacatattagagatgaggttcctccttgcctcaggaccccatgcctcattggcattgctgcagggagaccccaggggcttgtggcagtcagaggtcagcagaagacacgcagggttgatctgtgctcatggactctgatctcacatcaagagccaggttccttttgaccgggatgatttgagaaatggtgggagcagggcagttatcaattcagatgagtagatgctgacttagctctgtacagctccctggcaccacccatggtacagggaggcagggattaggagaatgctggcctccctgtaggtcagtgatgttgcatcagtactgggattaggctggggtgtccaatcttttggcttcatgttggaagtattgtcttgggccacacaataaataaatacactaatactacaatagctggtaaactaataaaaagatctgtgcataaatctcatgttttaagagtttacgaatttgtgttgggctgcattcaaagccatcctgggccacatgtgacctgtgggttgcgggttggacaagcttggattagaggacagaagaacttgcagctttcagcttggttggttgcttgggtaagggtgcactcttgtgttctctctctctctttctctctctctctctctgtctgtctcttttctctctctctctctctctgtctctcatctctcactctgaaagaagtcctgttgggggagtcccaaaagctaaaccattggcctgggggagaaacgtgtgctggatggaaaagaggacaaaggcatagacttgttgacttgcatctccgaggtcctgtgatgtggccaggtggcctgcagctcacctgagagacacaggcaggatttcctctcgctttagaaattgagcagcctgcttggagcaggcttgttctcagattcattgacacttctgcccatcagggtgatctgcaggaatgaaaagtggttagaattctgttgcaaaggttaattttaaaaggccagtgaacacccacaagggggtcaccagggcaaaaccacagcacacacccgcctctccgtttaactcacactagtccaggtgctctgcctgctcttacctgcttttcctcttggttgggtaacaagcattcagttgactgtatattctcctccctcagtttcttctgacatcttcgtgagacctgagagcaagctctgccttggcgacaaccagttgtcatttcttagtggcagcctttatttttcaaaaaatgaagaaggataggcagtctctgcagagtgatagtggggagctgccagaggggcagcagggtcctgcgtgtatcctaccaactgtgtttccattctcttttctcccaccacagaagaacaagtaagcgtagagctgacagggaaaggtctccccaccagggctgtctgtcctgagagtttagaatgtgctgggagagcagagcattctttggggcctgtttggcgccaacaaggagcgttacgtggtctgtgaccagctgctgcacctcctgctttgctctggaaggaggccttgaaggccagttggaagttctgctcggctgccttgaataatgaaccatcaattctgtttcccagctgtgcttccacaccctcactcttggatgggactgctgggttccttgtctgccacaagcagcaattgctggaagtagcaggtcagaaatgggaaaggaggcctggactgcatagccaggcaagccagtgaggttggagcaaacccttgaacaggggctgggcccacctttgtagtcttgtcaccaaggaggttactgaagcctccagaaggcacactgtctgatccaactcacatgccagaggaacactgaatagtttccttccgatgcattacgttcattagttatagaaggaataaagccatcctatatcttctctgaaaaatgaaggagtgaaaagagcacaatgtaatcctattatggttgcaactcttcccagtttggttttctgcagatctatttacatgcatactttattctttcataatcatggtgtaatatcatctgtgtactgcattattttacttaccattctatcacaagcatttttccatgttactccagcattttcattgccaactttcttattggctgcatgagagtctatccagtgggtataccataacttgtcagcacattgtatcattttcataaatttaggttgctctcaagttgtatctgttgcagataacattgtagtgagtgtcttcatgcatatggtttctatattttgcattatttcctaggacacattcccagaagtcggattactggggctcgatacacattgtcaaattgctttccaaaaggattttactgattttattgcactctcgccagaattcaatattgtcttttaaaaaaattgttaatgtaatggcaaaatgttgttttatttttactgaattttcatgtcttcagtgatttgcaagataaaacagttcccagccattttctttccaaatgtagtttctgtttttgtaaactatttacatcctttgctcattaatctattggttttagtgttttttcttgagaactgtcttaacattgttatactatgctcatagtaacctatttcatatttccagttattttttctgtggtggtgtttgcccatctcattcggttaggtttttaaaaatttgtttttattattttacatacaaatatttaatttatatctttccatcttttttaatgatttctctgtaatagcaccctccctctataaatttgatagaccattttaggttttattattttatattaaactttttgtttgtctagaatttaatgctttgtattaaatgcatgtaagttgattttttaaattgcaactagttattacagcaccatttattaaataattcttcatagtttaaaagtggttcttccagttaaggttttaacataatgttagggataatttctgggcaatttgttgcttcaataataacatgtttggccaagcacagtggctcatgcctgtaatcccaacactttggaaagccagagtgggaagatcacttgagggcaggatttcgaagttatggtgaggtattatcatgtcactgcactccagccagggtgaaaaagtgagaccctgtctctaaataacagtaatcatcatcatcaccttttattcttgggttagtaccacattgttttaattaccatttctttatggtgtgttttagatatttggcatcggccaggtgcggtggctcacgcttgtaatcccagcactttaggaagctgagacaggtggattgcttgagcccaaaagttcaaaactagactgggcaatatagtcagaccttgtctctacaaaaaaaaaatttaaaaattagctgggtgaggtggtgtgccccctgtaatcccagctactctggagggtgaggcaggaggattgcttgagcccaggaggtcgaggctgcagtgagtcgtgatcgtgccactgcactccagcctgggcgacagagtgagaacctgtcaacataaataataaatcaatatctggcagcccttctctgttttactattcattttctgatttttcttctgtagtttaacctattgttctaccaaatgtaatttaaaatcattctgtgaaatccagcaaaaatagctttttattttaattttgattagatttgcattagagctcagtattaaaacatgcacaccttttggtgccagatttcatactcaacatactttgttccttttgtgcgaaggaaattatgtttattatggaaaacagtgaaagatgagaagtaaatggctcatcctccataaatggccatcgctgactgtttcatgtagaactttctggcctgtgcccatatcttctctcttcaggctttggcagtggggctgatacttcacaggctgttccagtaccactgcaccttcactctggaggtgggagtgggactccgtgctgaggaccctagatgcacatctgttcccttagcagggagccatgtccagagagtgaggcatgcagggagtggtcatgtggaaggtgcggtcagaccgccaaggtcatgccatcttctgggcactggtagtccctatggagctgctgctggccagtgggaagatttggaggatttgaggatactcttcagagtgtgcttccacagtctaaccctcctgcttgacgacctgttatgtgtgagatggtggctttgtcacaggaatcacctgaaagacctctatctgggctccgtgaaactacctaagcaggtcagtctttcagtgaactgatctgatatcattgggctatcacgagcctgaggctggctccccactttcaaatcatcctcaaaaggcagggcaagtgttttcctctggttggtgatggtgtcctagcatgccctttttccagctggcttcccactgggctcagcccgatgcgtctactgcaatccccctttcctgtgttgccctcggataactccatgtgtaggcctgaatcgtgttcatttccaggaaaagtaaatgatgcatatcttactttccatctgtggtcattttttttctgcttgagaaacacctgggtctgcttgtttttgaattctctttttgtttgtctgaaaaagaaatctattttatttcaaaaattcaatattgaaggataattcagatttagaatttgaggctagcagttgatttctttcagcacttcaaagataattattgcaccatcttttagctttcattgtttctgttgaaggtaacatatctttttctccagtggagatataatctcagtgctttttcgtctttgtttttaaactttttattatcaaaactttcatacatgtacagaagtagaatagtagttatactattactattatattatgtagtatatactacagctctgttttaaccatcgttcacctttaccactgtcaaccatagctaagtttcttagatttatcatcccagctttgtctttctcaccattatgttgaagcaaatcttaggcattatatcatgtcgttcataaatatttcagttgtcattcaaaaatatctcttaaaaataagaattttttaacacctctatattattactccttagaaaatgttgttttatacatagttcctatagtttgcccaacttagtatctaaacaaggtaaaaatattgcctttggttgttatatctagtaagtttccgataatctttaggttgacacccctactttttttctttttttttttctttttgtttttttttgagagagagtcttgctctgtcgcccaggctggagtgcagtggcacaatctcggctcactgcaagttccacctcctgggttcatgccgttctcctgcctcagcctcctgggttcatgccgttctcctgcctcagcctcctgagtggctgggactacaagcacctgccaccaagcccagctaattttttgtatttttagtagaggctggttttcactgtgttagccaggatggtcttgatctcctgacctcgtgatctgcctgccttagcctcccaaagtgctgggattacaggcatgagccactgcgcctggccttttttttttttgaagtacatgatctcactctgttgtccaagctggagtgcagtgatgtgatcatagctcactgcagcctcgaactcttgggctcaagcaatcctcctgaatagctaggactataggtgtgcaccaccatgcccagctaatttttagtttttttgtatagctgcaatctcaccatgttggccaggctgctcttgaactcctggcttcaagcgatcctcccacctcagcctcccaaaatgctaggattacaggaatgagccactgcaccaggctccccattttttttccttataatttatattgcaatgtttgttcaagttctgtaggaaattccacattctggattttgcagattgaatccacatggtgttatttaacgtgttcctctgtctgctatacttttgtaaactgatagatctacagactcagtgagattcaggttttgtttgtttgtatgtttgttgttgttttttagcaagaatacctgataagtggtgtggtgttcttcccattgcatcacaccagcaagcacatcatgtttttctgtctctcttataacgtgaagattgattagtggcatcaggtgctgccagcatttatccagattccttcaatatacagtagtttttcacctaattgttatggcagccaatgatgatcattgactagacccattattcctttggagttaaaaaaatccttactctaattatgttattctgtctgctttcattagccagaattctttcataagatggaaacttttttcataaaatagatggtaccctgagagtgtttattaaaggaaaggaaggataaatgcttgtctctttcattttaattatctatttgctaaatagtgaattggttccctggcatcctccaaggatgaccagtaaatttttttctttaataccttcatgaattttcatgtgtctaagtccgttgtagttatgattctttttgctgaacaaattcttccatcttgttccactaggagtcttttcaggtggattcctgggtccttaccaccctgcttaagtagtctttgataatggctttctttttgatgtgacaaaatatctcaggttgatcttttacattttccatcccaaacctggaataagccaagaatatatagttgcttttagtgggaagtggtatttagaaatcataatctggacaacgagggtgctcactgcaactgagttactcattctttccaagccttttagtgggcagagctaggaaatacattttcttttttttaattctcttttccctgcaccaggatgtaaagtaaggaaatacattttccataggaaaaaaaatcaacatgaattcatactatatttgcatttccaatttaggattatggagattttagttaccttctttgattttatatgtgtaatttgtctcttacactgaaaatttgggtccctaatgacacaaacatgatgtcttgttgctttgtatgtatatataaaatatataataatttgtaatatacagcataatatagaatacatagtatatactatactatgtatatatttcacacacacacacacacacacacacacacacacacaaaatagtttcagaataacaataccaattgttactttaaaagtttgttttctccttaggatatatcctgcagacatacacaatcaagtcatgtttctcaggcacttgagatgaatccttgcatgtagctaaactcatcaatttgatatttaggataattttattttgtttttgatttttagtgattgcacttttttatttagaataatgtgtctcagatatactaagcaagtgttttcatagtattttcacttctgcccctacctttccctacaggaaaccacttttattcatttgttgtttatatattgtaacttaacttttaatatcagtaaatacacaccacacaaacacgcacacacagatgcgtgcaaacacatacttgtattcccatccctttcttattaaatgggaacatcaatactgctttttaaatctaactttgtattctggagactggcgtgttgtagtatatagagatatttctcatcactttttaccactgtgcagattccattgcatgcatattcatattttcttgcacctgtcctctaataatgggcgtgtgatggtttttcatcttttactgttatagatggtgcttcatctatagcctcatgcacacaactttacatggttttgccagtgtgtcttcatgatagattctttgcagtgggttgatgtaattggaaggcaaatgcatatgacaattttggtaaataatactcaattgaatgccataaggttattgaattgtaacatctcaccagaaataaacgagcctgcttatttctccacaacctttccaacctattatgttgccagacttttgtacctttgaaaatttatcacatgagaaatggcatctgagtgcagttttatagatctcaatgtatgttttttggtttgtttctatactgcttagagtttataatattttggaaaattctcagacagtatctccgttatcattacttctacctcattccctttctcttcttcttttggaactcaattacagatttgttagaccttaggcccacatcacatacatgtcttatgctttttttttttttactttatttttcattcattttctctctgtattttattctagctatatatttctgatatattttttacttttgtatttctttcttctgtcctataatctgctggtaaattcatgcatttttgttctctgtttctgttatggagttttcatttggttatttttgctaattggaaactaaaatttcctattcagtcttttggtcccttaaagactcttggtggttctgtttctgtggatgtgtttctgttgagttttttgggaagaagtcagtcttgttttatgatcacgtcctggtttctggtatgcctggattttcctgaaatgaatgctgtagatcatatgtaaaagatatacagacttaattgaaggtacgatgatgttatcttactccagatagtgtttatttttttccataatttcctgtgtttttatgttgtgtatatttgtttaataccatgaaactccttttctgtgatattcaaaatgaaggtcgtggtagttttgagtggaaggcagttttgtattgtgtttttaaaactttattttccagcaattaaagatgtccacagttatgagaaataatacaaagagatcctgtagcgccttctctcagtttcctctagtggtaatatctggcataactgtaatatatcacaaccaagaacttgtgtcactcttttataggtcaagcctcttttctcctcctcgccctaccccgtttctgacaaccactaatgccttctttatctgcgtaactttttcaccgtatgaatgttacataaatgggctcatacagtaggtaaccttttgagactggcttcttttccactcagcataattcccttgaggtccatccaggttgttgtatatagcaatagtttgttccttttattactgagtagtatcccataatatggatatagcataattattttcaaccatacaagggcatttgggttgtttctagttttgggttattttgaataaagctgctttgaacatttgtgtgcagttttttgtgtgtgcacaaaagtttttatttctctgagttaaatgcccaggagtgcagttgctagatcccatggtaattgcatgtttagttttgtaaacgtctgggaggcaggactttaaggttgctggggcctcagggatgcataggacagctggggctttgcatcctcgactgcttcagctgaagacacagtctagagtctgtgtactctggcttaggttgagattgggaagacatcccttgttctcacttccagccctctcacttcagtcaagacttttgcttacaaagggcagcacagaggctcaccgtgcttaagtgtcacgtggatttactggacagaccatttgcacacatgtgaggcaagtggtatcgaattttacctggtagcaggtgccagcttccttcctgcatgccctgtcccctttatcctcaaagcaggcagagaatatggccacttggcattctcagtctcagcccccacaaccccacccccagacagagatgtacactagccccttcatttgagttccagatgtcctaaggcagaactctgaatgtccctttgggtcctatgtctagttctgtccctggtggccagtgccagagtcttacagcacagccccatgtgttgggagcgccagctttggggtaattgtcatagacagtagcgccctgtcgggtcagttccgtgtgagaacctgagagggaaggagagttgctcacggtcagacaggagctctcatcagcagctgagcctgcatccccaggcgtttgcctccttcctttggttttgctgatttcgcttccttgtggggagacagagctcggcctttctgctctcctgttgcgctggctgtgtactgtttattatagcctacgtagagagaatagagggacagacagcatttctggtgacagggcatatccagtgaaatgcagacataaatcatcttttaaacaagggtgggtttgcggtaggaaggcctgtgtgaggaaataggccctctctgggctccctccgtccttcacagagtgcctcctgacccagggtcgcaagccaggttctgtgccaggcaccactccagagcaggtatctgtggcttgacaaggatgcacagggcagccgatccttggaaagtctgtgtgtccaaagtgcctctggatatatttcaaggacctgcctgagctgagtcacagttagcctctgacaatatttctaatagaccactctgttgttggacagtttttaccatttgcacttccagtatgaccactccaggtctctgcattaatttttctttttaaatcctctgttttaatgttttcggggtggggggggcccacttctatctgaaaatgcccatccagacactgtgggttctgtgccaatgccagggaaggaagctcagggttctgccctgggccctaagaccttagtgactcaggcagccctgctactggttgggagcgctctccactggccacctctgctgcaaagctcttttctcttgcttcatgagaagtggaagagtgtgaaacagtacacggaggcctttctggctgtttacaagggagatgggccaccagtgtttgtcaccggagcttcagggtagcatgcctaggagaggagcaaacaggggccttggggctgtggagtcatgctgggaagatgaagaaaagacagttggtaactgacaaattgcaggtgtgatcattactctctgtgactccctgtttctcagatgcactgttgcttacatctttgtatgcttttgcattcctgctgattgattcaaggtgcaacgtgcctgcttgtcaggtatgctgttgatcacattatttaagaagaaataaagtcgttcccgcagctccacctgcagtgatgggctttaatgttttgtgcttcccgaggaaaacctgccgatgatgtgaagtgacattcaacccgccgagagctgatactggcagacaaatttcatgtcctgtctcctgatcaccagtttgctgcctccaagttgttagggatattaaaaacaggggtgggaagtccccacttgacaggttcaatttgtaatgtgaaaggtgctgagaaacaaagcaaggacccaggcagctttctgccaaggctgctggccccacactcagcaaggcaaagagaaaggggatctatctgctagtagcatgagtgtgggagaggagggggctgttgtagggtgccgtggaggactcatacatgatcctgggaagagcgctgctgctagcccagggccacaaagcgtcaaggacgttgagctcctgtgcatgctcctgtagccttgtgtcatctgaagaagcacagaagtggcaggaatggccttttcatagggcatgggatgctgtaactgatgtgcaatctgttatctcaaaggagaccttagcacaagtgggaaaggaaaaactgcccgaccatggagagaacacaagtgggctgagtgtagctgcctctccttacctgtggctggtgccatgaaggagtgctgctgtcattggacactgtggggccagcaccgggttttgtgtgtcacttgcattctcccttggtacacagagcccagactggtttcctggtcccttcccagcgagcactgtgatggctttgccattgaggtggatggaggtccttgaccaaagcatgcttccccctgaccccatcccacccgcaggttggcagctcatcctcttccacctgctgtgaaagggctgggtctggggacatgggatgagggcgacttgcctgccctatgaaccagaagatcaacccctctgaagccaggcagcagattctgcggctagatcacccttagatacagcacagggcctaacgtgttggtggcacccactgtgtatttgtgggatgcttgaggaaatcaaaaagaaaccaacacaaaagaaaagactcttcattgtaaaaagcctgatgagaacagacaggatgtggcctctgccaaaaccaccatccacttccccacccaactctctgcctccagtatgccctgagaacccgcctagtcatctgatctgcctccatcatgcaggcgtactgagctccttcactcctcaggtgaagccacccggagcacaccgcggatatgcagcttgagaaagccagtgtgtgctcgcccacgttaccctccagggcaggtgcaggtgaccacttgtctcagcccacctggcccctcaactcattttgtgttactgaccctctctcttccatcctcatggtacttggggtgtccagtttaaggcctgtctcagatatacttataatgcaatagaacagattttatttaccagttgaacttccttttctcccagagaccattatttgcactaaatgtggttttgttttgctttttgttgtcgttttttgttttgttttgttttgttttttgttttttgttttagatgaattctcactcttgttgcccagcctggagtgcaatggtaccatcttggctcactgcaacctccgcctcccaggttcaagcaattcttctgcctcagcctccccactagctgggattacaggcactcgtcaccacgccaggctgatttttgtacttttagtagagatggggtttcaccatgatgaccaggctggtcttgaactcctgacctcaggtgatccacccaccctggcctcccaaagtgctgagactacaggcgtgagccaccacacccagtcaaatgtagtgtttcatgtgagttgccctattttttttttttttaagatggagtctggctctatcacccaggctggagtgcaacggcgtgatctcggatcactgcaacctccgcctccctggttcaagtgattgtcctgcctcagcctcccaagtagctgggactaaagatgcatgcccagctaatttttgtattttttagtagagacgagttttcgccacattggccaggctggtttcgaactcctgacctcagttgatccgcccgcctcagtctcccaaagtgtcaggattacaggcgtgagccaccacacctggccaagttgtcctattcttaaataaggatagcacatatagaattattatggggattcaggtgtaaccccagggctttgggaggcctaggtgggaggatcacttgatgccaggaatttaagttttcagcctgggcaacaaagtgaaaccccttctgtgagtccattttgtgttgctctagaggaatacctgaggctgggtaacttgataaacaagaggtttatttggcccatagttctgcaggctgtacaagcgtggtaccagcatctgctcagctctcagaggccttaggaaacttttactcctggcagaaggcagaaggagagcaggtatgacacatggcacgagcaggagcaagagagggagaggaggaggtgccagcttcctttgaacaaccagctttcgtgtgaactatcaaaccagacctcactcattgccacagggaaggcaccaagttattcataaggtatccactcccgtgacccaaacacctcccactatgccccatctccagcattgggggtcacatttcaacatgagatttggaggggacaaaacgtccaaaccatatcgccccctccctacaaaaaaaatttagaaatacctaggtgtggttgtgtgcacctgtactcttagctacttgaggggctgaggcgagaagattgtttgagcccaggaatttgaggttacagtgagctgtgattataccactgcagtccagtgagacactgcccaccccaccccgataaaaaaaaaaaaagaactgtgattgggagggtttggggccaaggttgcttaaacaaacacagcccacagctctgtgccaattgaggtttgggattcctgcctcacccctagataaccaataaagtagctatgatacattaagttccttttgttcttaagagaaggtgatgggtgtaactagagtgttgacaacatgaaaaacctaaaatcaggttggagataaatatttaaatctcctctattggatactgataatgatgctcttaagtaaaaataaatatagcaggggcctattaggggagacaggctctggctttcttacagcatgctgttgctgtgtggtttgggtcacgtttcttaacctctctgggatttcctttcctctggtctgaaatgagcagttgttgtacttgccgtataatttctgaggcctcttcttactcagaacttctgactgtttttaaaagatggagcattacctctctatacctgactgtgccgcatgccattcgattttgttatcgaagcaggtcagcccgttgtttttcacatagattcttacaatgcaacaaagcatcacagttactcacaagggaaggcaggggaggagggggaatgtggtgtcagaagccagacccatcctcacgtagtggagctgcacctgcccatctcccagaaagtccttcaagcccctttcagcgcctccacctgcaggcctgttctttgcaagcctggctgtggtctgttttgcataaaagaagattatccagcagtggggtttgctcttctctttttacatggctgccatagcaagccaacaagaaacctgccgtgtggagtgacggtcaggaaccttgcaagatgccgtcgaggctctgtctacaccaggcaaagaatcttccagattcctgctctctaactcagatgaaagtagttgctgcagagtgtgtttgcttctctgtctgcctcagggctgagcttctaaacatacctggtctagtgggttgcacagctgattccaggacaatgggatgagggaaggggaagatagaggctggcagaggtggctttttgtggcatgcatgggaaagcggtagggggtgctcttcacagttgtgggggaggcttagcctgaatctcagggcacagctgaagaaggagagcagcctggaaatgcgtcctaaagagccgctcagccacggcagctgtgagctgtggcccatcagtggctggaggtgggaccatttgagcttttcactgagatagagcctgtgtcaagtgttctgaacaacttgctgtggcctcatgtgagcttggctgtggaatcagggaggccagcacagagcgtggggcagctattcccagttcatcagcatcagccacggtgtgcagaggaggggtgggagtgagggatggtcgagagggagaacctgttgatttgcccgcaagctagttgtggaagacaagcacaggccaagaaatgtgggtggacaccattaatggagatggaaggaggtgttggaatggaggaacacggtcattgactttttgcacatgcttagtctgagatgcctccagggcagtaggataagctaacctgtgggaatgtggagggacgaatccatagctcagaagcaagcggtatctgcaggaatggattatactggctggatcatagggggtcagtgagtcatgagaatgagccctaattgtagagagtaggatgtgtgatgagagaagtggggacgcatcgtcatggggaccatcttgatggagggagggagaaaagagaggagagataggcagtgagcacagaaggaggagaggagaaccaggcaggagctatgccagtgacaccaaggaagggtgcgtttgctgtgatgtgttttcatcacgttttcataattaaccaacagattaatattcctcagaaatacaaagcacctctcaatcatgctataccttcttcccaactttacagtaatacatttcttaactttctagttatgttttagcaccttagaatattgaaaacataaaccaaaccctcatggcacgagcatgggaagcccttgtgatgaaaatcagctcaatgagaggggaaatgcgggaagcatttttagcagaaagtgatgacagcttggagcatcccaaagctatgcattattcagacgtgtcggagcgagagtgcccgatttcaccacccattacctattgggatgccttcttctctgcttgctaatctgaatattactcatttcaaggttttgtttatattatcttgaggggaaacaaacagtacctaattaatcccaccaaacataatattggaaaagcaattattcccaccacgtgtaataaaccatctgtagggaaaataatccattaagtgtgaatcagtgtgaattttaaaactattattaagatcagattggttcctcgttatgagcaccataattttagtatttgttcatgcatactgtgttatgccatgttctgtaaccttaaatccttaatgtccaaacaaataatatctatatgctaattagtgtcaaaaatcacaggtcagccaatcaggtgtttcacagatgagccccttttttgggggttagctcgaatctgtgattaattagaaagtgagtcccctattttgaaattctagtgataattgtagcagagggctgaatttatttgcattttcagtaaatcatccattaactgaaatgaaatctttttgttaaattactgctcctggttcagttaggagggagttttcccttcatttttaaatgtactggagtatccttcagttctccttgagtgagaagcaatcgctttgaccattgtcaaccagaaagaatttccccacggcatttctctctttcccagctgggccataaattgtctcatgactgaggttgctgtctgctcctgagcaagctggaagcaatgatgagctcagagctgggctttattaaatcctaggaagacacataaaaattgttagcagttgatttcgcaggaaacacctagcaaacttgtcggggtttatattacaaagcccagggcctgcagttagcagatcatcttttttgaaaagcatttgggtacctttgtcagagcttttctgcattttgacgtaggaggatacctgagggccatggttgtgagaaaggagagaacccacccaggtgtcctggggattgttttattcataaagtaattcggatgatctcgaggtggtccagggagatgggatagagtcagccaaggtgtctattgtaagatagattgtgaacccctcaaagataggctgaagtccttattcctgtcacctgtgattgtaaccttatttggaaatagggtctttgcagatataatcaggttgaggtgggtgcatgttggagaaggatgggctctttattttttgtttgagaccatgtcttgctctgtcactcaggctggagtacaatagcatgatctcagctcgctgcaacctccacctcccaggttcaagtgattctcgtgcctcagcctcccgagtagctgggattacaggcatgcgccaccacacctggctaatttttttgcatgtattttggtagatacagggtttcaccatgttggccaggctggtattgaactcctgacctcagatgatccacctgcctcggccctccaaagtgctgggattacaggcgtgagccgccgcgcccggccaagaagggtgggctcttaatccaatggctggtctcttataaagaagagaagacacagacacacaggaaaaatgctgtgtgaccgtggaggtggatcagagtgaaacatctgcaagtcaaggagattgccagcaacaccagaaactaagaggaaggcatgggacagagtcttccagacgggcttcagagggagcatcgccttgccagcacctggatttgggacttctggcctcttgaactgcaagaataactttatattgctttaagccccccagcttgtggtcacttgtcatgccagccccaggaaactgacatgtcatctctccgtgtgactggttaagtcttgatgtgatctcctagacctacgtactttggagctagccagggtatgatcagcgagaggcttaggacttggttagttcaaccaagctgttggagcccattcttgcctcaacctagtgaaatcaaaccttgcatccttttctcttgcctttctgaagatgtggatttgaaaaaaagaaaagtattcctgcaaagttccttatctcaggctccatggcatttctcagagcatccggccattgagaactgactccgtttctccaaattcagccttcccatgtgagttctgtcctgagatgtgattggggattggaagccaagcagacccagcaaagggaaggtgaccagtggactccacctgctcagcaaacactgacctggcttttcctttctgggaagttccgcaggccagctggcatcctccccgatggcatttcctggagtcctcacctgaactcttgggaattgccgcctagagaccaccatgcaaagcaggatgttgaagacagattagaaggcttctttcgcgctgcctctcctgtgcggcttctctccgttgtctgtctcctctcttgtgctttctggatctcttctaaagcttcttgggaaaagccaaacaggaaatgagccaccaagagactgggcttagacaatgatggccaagtagaaaagattctatgttctagcattggggactgcagaggagacagctgcccctttccaggacctgtcgaaggacaaagtctaaggtccgtggggatcacccttcaggaagatggcatcaggccacaaaaatagaaaagagatatcgccctcccttttatagcacaaatgttaccagtcatgctagtatcaaaaattatattccagtttactttctgcttccctttcaggcctgagatgcctggttgatccatcttcgaatactttcagggagctagtttttcttgggcctttttccctcttaggggccaccacagaatggcctccccagccgttttctctccctaattctggagcctggcctgcctgtcctcccgagagccccacctgactttctttgctttgctttgcctctgtggctcagcttgtttcatccgttcctccttgccattttgaaggcagtgccagcactggagaaccctatcagtgcttgcaaccccaccacgaggccggcagccgggagggctgggcgcatccgctcactgtaatctccagaacagataccagcttttcctaaccccctagcctgttctaacccttgaactgcttgagagatgtcaaaatcataactctctggggaagaggagtcagtgtttctgtcctagcagcacgcatcagtgcaatcagagctctgtaaaagccaggatccaccaaggggaggatttgtgaagctttttccagttacagtgagaactgggcaggcatcgagtctcagtttcagtgccgcttgaatacagggtgtcagtgtcacttgagtgctaggcggaagtgcaggttaggcctggatcggagggttaatgattaggtttctcccgggctgcttttcacatcagtgctgtgcaataagcacttttacaagtcaggctgcttcctttgtttgagctgctaaccctgtgtattgagcctagctaaataactccgatattaggataatatacaaatgaatgtgtaaaacacacttcagtgagtactgtgctaaccgcttcttttggtggagggaggaaagaagggtgtttacaaaacggcttcgctttgctattgtcatgaggagaacaggaatttctccaggctgtgtggtcaccggtgaatatatgcatctaggttttagtatttatttggaaatcaaatgtattatgggcaagggtatgtaatgaaccagccatttaaagatccctggacataaaatgcaagcttttggctgcgcgctgtggctcatgcctgtaatcccagcactttgagaggccgaggagggcagatcacttgaggtcaggagttcgagaccagcctagccaatatggcaaaaccccacctctactaaaagtagaaaaattagctgggcatggtggcgggtgcctgtagtcccagctactcgggaggctgaggcaggagaatcacttgaacccaggaggtggaggttgcagtgagctgagatcgcaccactgcactccagcctgggtgagagaacgagactccatctcaaaaaaaaaaaaaaagaaaaaaaaatgcaagctttcgacaaagcctgcctgcctgctttgtgtgtgccttccctttttcttgcagtggccctgtgggtttgcatggccctctgtggccagcctcaggatctagggtcctctctgcttgtagtataagctttgaatgctgtggcccggagcttttccacagcctgtgtttcctgcttctggtctgctctagagaaattcaagtcaggtttggcctggcttggccaacccgagcttgccatgtacctgagtcccaagggtgtctgtcccctaactctagccacctgttggggaggtaggaaggtctgggagggagatgctgaggagagcagagtcgtgtgcagaccaggtgggactggactacaggagagaccaggtgggactagactacaggagagccctggggggccactcctggggccaggagctgctccctgagggaattctgaagctggtttgtgattctgtgtcacagccacctgcatcccagtgaaagctatggttgctttccataggtaaaggcaatttgaggacagcaaacatattttcccccacacaatccgtcattgtctggtgatgggctgtcagtccaaaccgtagcctagaaatcgtagctcaggaagtagagtgctgagaggaacaattcaaacaattttgtttcctaaatgtattcttcagttgaagtctttgtggttaatgttgatagtttgtaggcacaatcactattctatgcatagggacagcttttcctaactctggaaaagagggtgtgtgtgtgtgtgtgtgtgtgtgtgtgtgtgtgtgtgtgtgtgtgtattgtcaaaaaccaatggaagagaaacacttcaaaatgggtgagaacagagaacagcatgaaatatggacagcagacagccctgtatgcaatgaaaatgcaggtgcatggtcactagaaaagatgcctcattctttgaatttttggctctttgaaacacctgtgtgacattaaattttttactgaaatgtggtattattaagtcttgcgtttaagtttataatcagaaacaaaaacaccatgtcctgttaaggaaagagttattctgacaacggttagcaggataaagaagattttactcaggagtattgcaataggtgtcaagattccacagaagaggagagagatcagtctcaactcgaaatacagtacaaaacttgggatttatagccaacaacctgggtggggcaggtgacagtcagtggatggaaaattactaagaggacacctcaaggataggaggtgtcttgctaaatgaacctaataggattcttcctgaaaacaggccaatgacttagacagcaaaggtggaggatgagtaatttgatctcatgtcaagggtgtggattcactccaaactctcttagcaggatagagccaaagtcaatgcctagttgagaagagagctcagaggagcctggctaacatttagtcaaaaagagtctctgtcagtgctcgatttagttttattactcaacactgatactttctgagctaggcactgggttaaacacttaaaaaaaagaaaaaaaaaggttggccaggcatgggtggctcacacctgtaatcccaacactttgggaggcccacacctgtaatcccaacactttgggaggccacagtaagagcatcatttgagctctggagtgcaaggccagcttgggcagcatagtgagaccctatctctacaaaaaatttttaaaaattagccggatcatggtgtgtgcccgtagtcccagctacttggaaggctgaggtgggaggatagcttgagcttgagaggttgaggctgcagtgagctgtgatcccaccactgtactccagcctgggcaacagagtgagatcctgtctcagaaagaaatagtttagtggcaggtgagagagcatcatgtaatcgcgatgtgtaaaaacgtgcaagaatggaattgtgcagaaaacccagtgcgggcttatcaacccgaagaattccctctgggccccagggaacattcagcaaagaagctaccttggggattgttcttagattttaacaatttgctgggatgagagtatttgagagtggaaagagcactgggctgagggaacagcacgtgccaagcgatggggaacacaagagccgggttctgtggctgctcagggggcagagctccagccaggcctacaaggcacacaggatgggggtgggggccggagctgaggctgcggagcagtcggggaacctcttccatcattgacaagtgagcccaaaccatgccattccaggagtgttaccctagccgcttgttatgaagccctctgttacttgggatgatctgagtggccttccacgcacttcagaaaataaattccttttttatggtgagcgaaattctaatatatatttgtattttcactaaccttaccaaagagaaaaatgtcagcccttttcctgaagtttcttttgtccacttgtgactttcaattaaattttaaaacctccagagtaggaggaatcccccacagagacaataagttagctgattaattgaaaacgtggaagctatttttatgattaccacataccttgtattttatttttactgaaaacacataagtgaggtcaggtgtgttggctcatgcctgtaatcttagcattttgggaggtgaggtgagaggcttgcttgagcccaggtgtttgagaccagcctgggcaacatagggagacctcatctctacaaaaaataaaattagcttggtgtggtggtgcatgcctgtggtcccagctactcaggaggctgaagtgggagagtcacttgagcccaagagttcaagattgcagagagccatgatcataccactgcactccaacctgggtgacagagtgagactttgtctgaaaaaaaacaaaacaacaacaacaaaaaaactcacataagtgtaccttaggctttttttgttttttgtttgtttgttttgcttaccttttatgtaagtccaatgcttctttttgaacgtggttccactgatgagcttctataatgcctcatcaacagttctgcctacaattttttaaagtggagttagtcacatttttcaggttttccagttgtctcaccccagtctaattttgcatattttttttagctctttacctttattatagcctttgtaaagcattccatttagttttccaaaactggttctttttcatggcactaataattcattttctcatgtcacatttatttgaattacgtaattatagtagcaaggagaattggtattaagtaagttttaggtgaaacccatcgactttgggattgtgcactctgatgagtcgggcagaagagtccaggtgttctaggggagcctgtcactggtcagtggtcagtgtatcccgaggcattgcaaatcctcgcttatctgaaggacttgcttccctggaaatcttgtctgaggatttttgtgttcctcgagtgcccaacacacattgctggaccttaaggggacacttggatatacatgatctggtccagccataagggcacacagtgtgggagacaaggggccattctgggaacagtaaagaaatgagatgtgccctcagggagctcagacaaggagctgctggagaccagcagggaggaacagtgactgtactcaagcctcaacacagatcctcaggaacatcgtgttgggttcattggactctgtatacagtcagaaaagaatccagaggaagcacagctaagagaattgagacagcaatttgctgtggcatctccgcacagaggtagaagtttattgatttgtttcctctgatttcagaagtagtttttcgttttgttttttcagtttctgttcatgtcatagaccagcgacccctgctcctccatgccccttagtctgctgggttgaccagatggctggcacccagcactgtggcatctatgcatttaaatattattattagaggctgagggttttatatggttagctcaagtacgttttatgcattttttttcctggttttttttttttttttttgagacggagtctcgctctgtcacccaagctgcagtgcagtggtgcgatctcagcttactgcaacctccgcctcccaggttcaagcaattcttttgcctcagcctctcaagtagctgggattacgggtgcccaacaccatgcccagctattttttgtatttttagtagagatggggtttcaccatgtttgtcaggctggtctcaaactcctgacttcaggtgatccgcctgccttggccttccagagtgctgggattacaggtgtgagccaccgtgaccggcccattttatgcatatttgatttggagttggtgaatcaactcgaaaacctcaaaagggggctgtgagaacactgggctttttagggataggtttccacgttcaccgatttcatctgaatggactgttgatgcttggtgctgtggccatgcccttggctcctgcatttaggagcagtgaatgtggcgtccatctgcagacgtggctcagcatcatacgttacaagcacagcttttggtacaggagctctcgggtcgctgggagattgaggattatgagaacttccttctttcacacaggggtttatcccctattcagcattacatcagctttctctgactttggcatggtgttaggaatttatcagggaaatacgttctgtttatactgactacattacgggaagcttggataactgtatgggggactttaaaatttatctctctgtgatagtttttcagctattatgaaactaaaccaaacgaaggcagtgggggccattataaaggaagtttgagaatctgaaagtcttgatttcttaaaaggaattttaccataatctctctctcgataagaattaagaaaaatacttacatgtattatgtgcaaagtgtacccgttaaattcaccataattgaaagatgcaatactctgtcaatagtttgggaattgttttaggattaaaagtgagatccatttgtaagaaaatgttttcattttagtaatgttaatttgataacttcattatattacttctcaatatattactttgagagcaggtaaaaagagttttccagagcctactggaactatgctaatcagatttatggtacctcttattttcctggcctttcattttgtttttgtatttaagtcttctgtgttgacagctgtcatttgatgtgagacaggtgaagctccttcctgctttggcccacagttgggcagcattgtccccggcctgggctggcctcatcaagtgaaacatcatgctgccatgtttcgacattttaccttttcaggttctgcactttttctgtgggaccatcccctcttccccgcctgccctcttctctctggggtgttttagattttaacccagcctctaacactggacacacaagtcctcagtggagttctgtcgttcagtccgctgtcttggcaaacagtgcccaatcaagaaacaaacgtgctctgctggctgcaggctgcctcatttctccccgatccgaggaggtgtcacatagtcatgatccttcccgggcctggcctggggcagaacaggatggcaaacacctctgcaacctctgggtttccagtcctgccctgggtgggcctggcttcgcctcatgaaaccccgagtactgtttgactccctgccatagctgagtgcctgccccaaccccactctgagttcagcgcacatcctggtgtgaacgccaccatctcagggacatcctgctgcaaagctcctctctgtctccttggtctcttgccacctacagtctttctcatgggagccccacccctcagaaggctccccgtctctcctgtccgtgagttttcctggaattgtcacaatgcagagaatgagttctgtggggagggtggggaatgtagccctgtggctgtcccagcaagtggcccctgtgggctggtggctggctccatttgagactgccttgaaccatggggtctcctggggaggggctggagctgtcaggcttctttctgctggatgacgttgctgtttctggcagcaccattggctgcatctcagactgtgtcccttccttcaattctgttgatgtctcagtttgtggaaattcggaaaccacatgcctttctctctaggggtgacagcattgttggcctccatcctcctgtcagtccttacgagtgtcttcatgccaggtggtgccgtcatggcatgtgttgggcagctaaccagtcccttcagtgtggggcctggcctcctccttgccacctcgttggtggaggtgacctgggatgctggacccactcttgtttggactcagtgtaggattctctacctctttctcccagttacacagccttgaccaagcttctttattcctctgatcttttttgtttgtttgtttttactttaagttcctggatacaagttcagaaggtgcaggtttgttacataggtatacatttgccatggaggtttgctgtacctatcaacccatcatctaggttttaagccccacatgcattagctatttgtcctaatgctctccctccccttgctgccaaccccctgacaggccctggtacgcgttgttctcctccctgtgcccatgtgttctcattgttcaactcccacttatgagtgagaacatggagtgtttggttttttgttcctgtatgagtttgctgaggatgatggcttccagcttcatccatgtccctgcaaaggacatgaactcattctttttttatggctacatagtattccgtggtgtatatgtgccacattttctttattcagtctatcattgatgggcttttgggttggttccatgtctttgctattgtaaatagtgtcgcaataaacatacgtgtgcatgtgtctttgcagtagaatcatttatattcctttaggtatatacccagtaatgggatggctgggtcaaatggtatttctggttctagatccttgaggaatcaccacagtgtcttccatgatggttgaacaaatttatattcccaccaacagtgtaaaagtcttcctatttctccacagcctcgccagtatctgttgtttcttgactttttaataatcgcccttctgactggcgtgagatgctgtctcgttgtggttttgatttgcatttctctaatgatcagtgatgttgagcttttttttttcacatttgttggcaccatgaatgccttcttttgagaaatgtctgttcatatcctttgcccactttttgatggggttgttcatttttttcttgtaaatttgcttaacttccttgcagattctggatatcagacctttgtcagatgggtagattgcaaaaattttctcccattctgtaggttgcctgttcactctgatgatagtttcttttgctgtgcagaagctctttagtttaattaaatcccggttgtcaattttttgcttttgttgcagttgcttttggcattttgatcatgaagtctttgcccatgcctgtgtcctgagtggtatagcctaggttttcttctagggtttttatcattttgggttttacatgtaagtctttaatccatcttgagttaatttttgtataaggtgtaaggaagggatccagtttccgttttctgcatatggctagccagttctctcagcaccatttattaaatagggaatgctttccccattgcttggcttgttgaagatccctctgatcatttttaaggctggttgagaccagccctgtggaggacttccttaattttcagtggcaatgtttttaatcagtgagatgactcacaacactaaacaattccccatatatcttgtgtgttaggttaagggaataccatgttctttttttttttttttgagacacagtctcactctactacccaggctggagtgcagtggcacgacctcagctcactgcagcctccacctcccaggttcaagcaattcttgtgcctcagcctcccaagtagctgggactacaagcacgtgccaccacacccagcaatttttgtacttttagtagagacagggtttcaccatgttagccaggctggtctcgaactcccaacctcaagtgatccgcctgccttagcctcccaaagtgttgggattataagcgtgagccactgcgcccggcctgctttacactttttacatagatcctggtgagaatcggacctgggatttttctatgaatgagagcctgttgtatgccatacccccaccccacccccttacccccacccctacagccttcctaatataaggaagaaatgaagcagccgagccatcattaagcagatcacctctgaaaatgaaggaaattggatgaaagctctgccccggcagctgagtgctaaattagggagaatcacgggaggccaagggcatggccgggctttgtcgctgccttattatggatttgataagaaacaacttttttgactgtttacattatggaaatgtgataacccgtttgtattacttaaactgtgcattttgtaagtgttgtcaaagggagggagtaatttgtaacagaagcagagtatgtagaaactgttctcgtaaaagcgttctctaaattgctttgcttgcagctgtggaggttgccataaagaatgatttctcatattggattttcaaagccgcaggagtggccacagagcaggcaacggacagcccaatgatttaagattatttaatgccccagttgtcgtgaaatagaaggaaataaactccagtgggctgctagaacacattactacaatctcttaatgccccaaactaggagactgatttatctcctgttatgtcttattaagtgacattcagaagaagaaaagaaaaaaaaggacagccaaagctgatggctgaaaattaccctgaaatgagtgtgatgcaggcaggcttgtatcgttcttaagttcaagaacccaaacttgaactcaacactttttcagtgtgttttatttgttagtacagagatatttgaagatgacagattgggcataagaataggccaaaaggctgtctgccccagtgcttcccagacttcattgagcacacgaatcgcctggggctcttttaaaatgtagattccaatccagaaggtctgggaaggagcctgcaactgcatttctaccaagctcctccatgcttccaaggcagctgttcctggggccatgctttgaaggagcaaagttctcattcatcctgcagaaggaacctgcagaaattctcattcatcctatagaaggaacctgcagaaattctcattcatcctgtagaagggacctgcagaaattcttactcatcctgcagaaggaacatcctccaggcagaaccaaaaacagctcattgtcttcctttatgcagtacacttagggcatccctattccaaacatccgaaatccaaactgttccagtgagcatttcctgtgaatgttatgtcagtgctcaaaaagtttcaggttttggagtattttggaattttggatgttcagattagggatgttcagcctataagcattccaaaatccccgcaaaagaatgaaatctgaaacacttctggttttaagcatttcagatcagggatactcagcctgttgttctttatttcacagtcgtcctttcgtcctttacataactgttgtccctgtctctgcacagctgattgtgagtgatcggatttgaactccctacaccctctatctaacccattcccctcttgcctcatcctcagtgaggacaaagaaggttgctctgggctgcttaaattgactcctacatgctcagtatatatcctgcatgtacctgttttttattttttttatttttattttttttgagatggagtctcactctgtcacccaggctggagtgcagtggggcgatctcatctcattgcaacctccgtctcctgagttcaagtgattctcctgcctcagcctcctgagtagctgggattacaggcccacgctaccacacctggccaatttttgtatttttagtggagacggggtttcaccatgttggccaggctgacaacatatattctcgtggttcaaatggtggcttttgttttcatggcattctgtcatgaacccagagctcttgatgcctaagagctgcctaaggcagacccattactgcctaagaagaagagaattggggctattaaacttgcaggtttgcaggtatcccagccagcactcttgagaggcagtgtccatagaaatagcggtgatgatcaccaggctctccagtacggattcctaggacggggcagcagagccatgcactccccagtgcactggctggtactggggccctcaatgcccctctgggggctgcaaacacaagagatctgggctcccaggccctatgcacttctgcagggcacaggctgcttcttgcattcttaagtccccatggataggaaagcccaatgaattgggatggtctccagtgagggcttcacacttcctttataacatgcagcattttaggttggtgactggtgtgcactgggccaagggtccactctgtctctgtccttacccccgggcttgaggactagcccctgccaaatgtcttacgggctcatcccagtgggcttgttgagtgggctgctgagtttgcaatgcctgtccctcctctatttaccaaaagcaatgttttctctcttcacttgctagggtttcccattctccctgtgcctccacccccatcctcctggcagccagatggtcttccccctcacagccatcactccctccctccttccctccttctctccctcccttccactgaacaactcacctgctggtctctggacctcctgccacataaaccattttccacactgagaccacttctctctcctgctggaaacctttcaaggattgccatttaggagagatgttaagtccactcccctagcctggccattgaggccttggctccctggcccctcccagtcctgggctgcaaacaaactgaagctctgggctcccttgaccctcagccattgcccgtgccatcctctctgctagacatcatgactcagccagacctcagctgtgtgacccactccaaacaccagctactctatgaagtcttcccacctggatgcaagcaccagaccctcgtcttcctctatttccatgaggcaccatgggcacccctcacctcccctcagagtgccacccatatgcgatgcaatcactctcaatagccctgacacacacaagcagggacaatgtcctaagcatctttacatcccaggacaagctcacgagtaggcatgcaatgacggaatggaagagtgggtaaatggacaatagatatcactgcttggtaccttccactacaagcactggacttttagggaacagcatttaagccatagcgagaaaatagctaatgggatttctgaaatccacaatgaaatgtcaagtaaaatgtttcctccttgggtcaatcaatgagctgatttcttattctctgatattgttgtgggcttgctttagacctaaccgtacccttcagggggcttactgcaggtgcacattttcagaaggatggagtcctgagagaaggccctcgttcctggtcctcacccatcctccacccctctcgacccgcagcagacacccccaggtctcctcttttccccccgcctccctggtttccctttggaggtgctttcaggatatgctgcctaatgctggttcctgttagacaggttcgcctgagggctgagggatttcatctagaactacagcccctcgaggggactccaagaactcttggctctttggctcccatctggctcccagcttgctcgtatttgtttgatccgggcctgtgtgtgttacatttttataggatctccctccgatgtgcacatcgatttgttctgttcagatgctttgtgtggaacgtattttatgtggtggtttttggagtgttgcaccctctagagaaaatgacctttcatgcccgtgaataatgaggctggaaatatttctcttaactcagaagcatctgcacgcacttgttttcacacttgagttgatgagcctgctcatggcatgactttcctccaaagacctggggatccgaataatgcctatttttagtgcctcctgaaaacaggaaagggcagaccatggaaatgtttcctttgtgggagtatttagcttcaagtttagcactgggcaggagtgtgtgtgtgtttataagtatgatttgatagatcatttttctcaactacacactgaagaaggggaaaatgaatcataaaggactacctggagaccagtagtggctccagcagtgggttctgggcaagctgtggctgcgcagtgcctgccggcctccagatgagcatcccattcatgctggggagaagccgggacagcttgagcaacttccagtgtaaatgggcttcattcactgtgagttattttgaatgccctcttggccctgtagggagttgcagacggtaatgtatgcatgtacatagaggcaaaacctcatagatcctgttttgtttttgttgaaacactaggtttttgttgaaaattagaggtcacaatgtgacaaaatccctctgttcttaaagtaagaagagccacccaatcccagaagcatattcatgggaagccagttttcatagtcttcccagacttcttcagaaagtagctgttggaaagaaccctgtctgtcagtgtctggaagctcattgccatgtgtgtgctgacctcgcaccctcctaggggaggcagggggctgagaccatctgaagccaccagcattgtaacacacagtagcagtggtgtgttcagaaagcacttggactccaagatcaaggtttctgccactcacatgggcagacagatatctagaaacaaccatgactgtaataacagcagctggtcaccacggagcaggggagtgcctgcaggggaaggagcagcccctgggaaaagcaaatccgctcctcctggcccagggcctgaaacctgggaggctcctcgtcatagggtgggctaagccagctctttcttcctaatgtcagtgaggttatgcacttggcatggcggagagctgccccctcctccgtgagagtgggttagaagatggtggtggtgttaacaaggaaaaataacacctaatgtacacagagctatatccacgggaacctgttctgtggactattaaaaatccaaaattcatgttgaggtcctacctctcagtaccttagaatgtgactgtatttgcagataggacccttaaaaaggtaattaaggttaaagaagatcattaagatatggcctcatcccatctgactggtgtctttatagcaagaagagactaggacacagacacacacagaggagaggccatttgaggacacggggggaagatgaccctctaccagccaaggagagaggcctcagaatgaaaccaacacatctcacaccttgatcttgaacttcagcctccagaactgtgtgaaaagaagtttctgttgtttaagccccactacctgtggccttttgttagggcagccccaacgaactaatacggagtcctattaccaatctttgttatgagagctgcccctgaagtcacatcagttgcatttccggattccaaataccttttccacatagctgggttggggtctctctctgtcgcccaggctgcagtggcgcaatctcggctcactgcaacctccgccctcctgggttgaagtgattctcctgcctcagcctaccgagtagctgggattacaggtgcctgcccccatgccgggccaatttttatatttttagtagagacggggtttcaccatgttgcccaggctggtctcaaactcctgacctcaagtgatccacccacctcagcctcccaaagtactgggattacaggtgtgagccactgcaccccgctggggacaggcttttgaatccttactctttaaaaagaaaaaaaaaaggtgtatatttaaggcctacaatgggatgtgttgatacacgtagtgaagtgatggctaccttccagtaaattcacgtatccatcatctcacatagttacctttcagtttttattttttgtggtcagagcacctaaaatttactcacgtagcaaatttccagcatatgatacaatattattaactctggtcccgtgctgtacctaagagctcttgacttgttcatggacagactgcaactttctaccgtttaacttatatctgcccattttccccactcaccccgcctttatttagaatgtgggggaaacagagactgatgcactgtatctatgtgacgataaaactccatcatattagttagaagggaggagagtaacgttgcttttttatttctggaaatcagaaatcatattgagacaaagttagaaaaagccatctgtgttttgtttggccttgtattggattcattctgaatcgactactaaaaacaaaaggctttgcttcatttcttctttcctttttatatttgaaagcactgtttgggttgtgatttttgtgatgcctttattttattttctgggactgtgggtgattttggcaaagatgtatgacccttaactcaaaagggcgcggtttacaggctaactgagggtgggtttatgagcagcattattctgcaggaacacagaactgtacagacaaggcggaccacagagtggggcctgaagcagcaacctgtcagcctccccttgctgcaaacacctgctctgccccactggatcccaggtacactcgtggccatgtgtgtgggtgggcttgaacattgccactccccctccaagaacaaacaccccctctccaacactaagaaaaatatcagcatggaacataaacgttcccctcagataatcaaataattcaccccaaactgtccactgtgccgtcactggctaaagcgagctgacttttctgtatacacgccatatcattttcctggattatttcccaaaacttgacagaccttaggaaagctatttttgagactttgctgacagtttttctggacccacagtatgtatttcagacatttcagtaataactctgtgacctcattatatgcgtatttttgtatgatcctgtgggtattggtgtgaggacacaccttgtattcttatttaaaaatcccaagttaaaaacagccctggccttttcgagtcacgtccgtacatctgagtttggactaggagagtgacttagttcactacaacattttaccaaaagatattgaagcaatgttttttccaaaatatggcataacacagaattcttggatttgctgaaatcctacagatttttctgtgttcgtttgtttgccatattcatgcaggtgatttgcaggtgtgcaacctggagtccagctgtcttgctcttcatgctgggcactgtttgttctctgctcgcccagcacaatttatattacagaactcacagcgaggtggagagaagacacagtgtccggagtcaggagctctggattcgagtgcacattcacccattgataatactgagcaggcaattcaccaaaaccaccttgtgctgcaccctcttgaatagcaacttaatacatgtccgggagccgcctcatatagttgggttagttgagataatgaacttggccagctttgaaacaggaagtttttgaaacttgccggtgtgcctgcatgttctgtgtgtgccactctcatgctgctagcagtgccttgcctgttcttggtgttcttggaagatacctgagctcttactttgactcctcaaggtgtttggttcgcattcattgacaacagtgcagtttgtacccagaggctctgacttcactctgttgaaggttaaagaagatagtggccttaggggagtcatcaggccattctactgaaggtgggtggcatctttaatgcagctggcagcctgtctggggcatggtccttgctcaggacttatttcccttcttttttctcacctttaagtagaaatgtacataaggacacaactagatattgatttgctaagttcagtgatattcaaagtgaaaatgatacatatacttctggattattttcgttgcaaaatttgttcattctttccctattcggtgtgcattgagtgcctgctaagggctgggcagagtgctagaagacgggaactgtgtgagccagcacaggtgtggagcctgttttctgggagctgagaagttgggggtggagaggaggcacactggacattgcttgagcagccaaatgagatgacaggtgtgatcccagcacactgaaggagaggcacacggttctctaagagtgtgtgaggagacgagtagggctgggatggctgggagctgtgacattggaaggacttaaccatgtgtgcaggaggcagtagcctcctggggagaggcagcagcatgtgcaaggatgggggcccagcactgggttcatcctacaagcatgtgtccgggcctcaaggccactctgatgactgctttccctccctgagcctcctgcagtgagagtgaagctcacgaatgctttgggtgtggcatggcagtgtggtctcattgtgtaaggtgttttgattatgtgtggacttttgcgccaggactattttaaatgctggggatgtcgtgctgaataagcctgaccaagcctctgccttcgtggagtttgccttctacttaggcaggggctcagatagtaatccagcaaacctataactgggccctgcaatgtcagagactatgagtgttatgaatagaaatagatacagtttaacaaggggccagaggggcctgaaaggctgcattgctgtgggcagggaggtctgggaaaggctttggagtgtgggtgctggggctgtcccttgaccagagactggaatgatgaagccagccttgccaaagggtcccctctgtgacttgctctgacaccctaatggcagggatctgcctccttgcctcctctctaccacacaaaactgattgccttccccaaggacaacaaaggagaagaaaagaaaacgaagaaatcagaaaggataaaaccaagagagatcaccaaaggcgcgtggtgcaaatactgatcacatcagtaagaaaactgtttccatccctgatttgcttttcttttaaataggatattcagtcatagcttcactataaaattgatttattgtgttgaaataatttccgtagcaggggaactaattggattgtgtagcataaagaaaatgtatgtgggacaatggggaagaattgagccaaaatgaatccaatatattttaatctctgcaatacagattatattttcaattaagaagcttaacttgcatgtgttcggcgggcgggagcttcccagagcacttctcgcatgtgtttatgggtaataaatcacttagcattaagaaggtagacgatcattagcccatgatcactcagttgcctcctgttaatagcaaagtcaatgcacaccatcactgtggccatattcgggtggtaaaatgtggagttacatggaaagtggaactgttatattggtgaatacgatttactagacggaacaaggaaaacctgaattccatcccctgtgggccatggaaagcccatattcacagtcaagtgtgaaagtggcttttgggccacccgtgccctgcctgaaagcagagcatcatgtggccacgtgtctgctcggctctgccttactaattgtgtttaacctgagctctgctacagacagactttggtctttgctccatgcgtgcttctggcatgacctaggagttgcttgccagtgatgggcagagggcgagggcaagacgctggctagcctttgtccagtggtccacttgtctgggatcgcatttcatcttaaagcaacccatgaggtggaggaaccatgatcatcatattatataggccatggaatctgcctcgtgggctgtcgtagcagagcagtcaacaagttagaagccagagcccttgtgcactcatcggtgcccacaataactcattaggttttttccttttcttcctctcagtcccagtagccgtctaagagcagaagcttctggggcctggccttgcagacactgacctttgactcacctctttatgattaagacaagagcatggaagaaataaaggggtcattaaaaaaaaagaaaaggaatctggcaggaaaagcagaggcagatgtggagctggtttaaaaatctatttcaagtctttccagtggctggctgggtaggcaggggccgccaacacgcaggggccaatgcagccaaggagcagttgcgtaagtccttgcgtaagtagaatgagatgcccagggctcccttgagcgcggccacgtggctgggaacctgtcaggttttatagcatccaatcagacaccgtgcaccaggatggagagcccggaaagaggtcagagctggggaaggcaggtgggggctgtaaacccaacagcagtgtgaggaatgggctcaaggcggatggagtgagcagaggtgtcccagggacagtggcgagcccgaaactagacatggggagagaagagacagagacaagaataacaatggtagtaaggtggcagatcctcagtttaaaatctggccacgatgccattcacttaggcacttgcttgttctagaaatatttattaagcactaggtgtggcaggtgtagaatggatttgcccccaggaaaccctggatctggggctccgagtcatctgtctacgtcctctggagccttccttgtcgattgtcccttcacctccagattcttctactgcagggaagctcccttgacctcaccctcaccctcactgtggacacctctgttttgtccttcacagccagaccacacagagtggtcccctaggtccccagccttcactcactcttcatctccccatgaggctaatgaaatctgttctactgcagttatcaatggtgtcctcatcaataagcccacattaccgccctccccagtctcagacactgttgatggcgcccttgctgttaagtgctcttgtccagtagcttccatgaccccgcgtcttgcgctgtttccctctggcatgtctcattccttctctccctctcgctctatctctctccctctcctctcctcccctcccctccccgtcctccccctctctctcctcccctctcctcccctcggccctatcctcccctcccctctcctctcttccctcccttcctcccttctttccttcctctatcctcccttctctcgctctctctctagctcattttttttttcttctgcccggaagaaatactggcattctccaaggctcttttctcagccttcttttttaggttcttattctaaaatctctcttcagtgctctctcattgatttccaaggatttctttataagtggactgagattgagtacaaaatgtaccttcaactcttgaccttcacctgatcccagaccccactttcacctgggtccccaaggctgagcacaggtccctcctatccccaaggaggtgctctgaacccactccccatggctgtggatggctccccaaccttctgcatgaggtagacacccagttacctctgcagcgtccttcccttcagccaaacccctccccccgccgcccctgctaaatttactttgtcaccctttctagaccaggtcagttccagacatgacctggatgctccttctccttaaagagtgaatgagcaagaggctgggcgcagtggctcacacctgtaatcccagcactttgggaggccaaggcgggccaatcacctgaggtcaggagtacaagaccatcctggtcaacatggtgaaaccctgtccctacaaaaaatacaaaaatcagccagatgtggtgggcacacacttgtaatcccagttacttgggaggctggagcacgaggatcacttgaactcaggaggtggaagattggcaggagcccgaaaccatgccactgcactctagtatgggaagacaagagcgagactctttctccgaaaaagaaaaaaaagagatggaaaatgagccagaatgatgggnnnnnnnnnnnnnnnnnnnnaaaaaaaaagagaatgaataatgagcaagaatgataggccatggcagattggcacacacataattttataatttcccctttttttttttttttcctggagacagagtcttactctgctgcccaggctagagtgcagtggtgtgatctcagctcactgcaacctctgtttccagggttcaagtgatcctcccgccttagcctcctaagtagctgggattacaagcatgtgccaccatgcctggataatttttgtatttttagtagtgatggggtttccccatgttagccaggctgatctcaaactcctgacctcaagtgaaccacccatctcagcctcccaaagtgctggattacaggaatgagccactgcacccagctggcacacacataattttctaaaccaggggttgacaagctgtaactgatgacccaatccagccctccatctgtagtgtgtatgcatgtgtgtgtcccacaagctaggaatagattttatgtttttaaaggattgaaaaaaggcaagaatactattttataacagatgaaaattatatgaatttaaattttgctgtctatacataaagttttattggcacatagtcatacccattcactttttgtattgtcagtggctgcttttgcgctgttataatagcagagtctattagtgaatgcaaaagagaccatatggcctgcaaggcctgacttctttactgtctgatcatttacagaaaaagtgtactgatcccttgactagactgtcaagaatggaaagtgcactgttaagaatgggcacatcttattcacagactgcaatcaataatcaataatcaatcactctgatgtaacctgagaacatactgtgtagaaagcatgctgtagaggatagcgtgtgcttccccttgtgctccccagtctgtttcacaagttctggatgattgatcaatgctcgatcaatgcgagctcccttctccatcatgggaagaatgggaagcctgctcctcccctgtggtgcatctggcatccgagctggtgttcatcgcttccctctctgctgggtgaggacctcgtgggtgaggacttccacataaaaatgaggggtaaggcgcaaacatcagaccagagtcacaggagacattatcttccccgtggccgccctgcctggtgagtttactgatttgcctaagggtggtgctggtgtgtgtcttgcaccatgcctccctccagcctctcagatatgtcctgtccggtggggacgtctctcctgtgtatatttttggtggctgagcaaagtgcttgtggttcctttcagccaattgtgctgaggcaaaggcgggccacttaaattgcagtttctctgatgtatcttctaaaagccaaacgtcgttatccacaaagggtacttttgtgtaacaccaggcactcgagtagatctgtggggtcttccctctgtgggtgatgagtctgggtttcagcatcccgcttccccagaccacatggccactgatccgtggggtgcacagaaggacaggcagtcacatgcctgcttctttgagttctgccacctacgagctgagtaacctgggcaagtggtgaacctcatggattctttgttgccaccagcaaattggggagagtaattgagagggcatttctgagctcctggctcagcaggtagcatgttagagctgcttgatcaatgcgagcccccttctccttcatgggaagaacaggaagcctgctcctcccctgtgctgcatttggcatctgagctggtgttcagtgcttccctcactgctgtgtggttgccaaagcctcctgtggagtaaggccctgcactgcttcatcctcctgggagagcaggcagtggagcaggatgctgcatacagagctggttcttggttcttgaggagggggagcggtggctctgccagctcagctgtgagtggtcccaggatgaaggaacagcaggaaacaaagatactctcaaggccatggagaagaagtgtgaggtagatgctggcgcaggagcccacggtgggggagaatccgcttctgatgtcttccaccctggacctcaagtgtcaaacagcaagagatgggctgagcaaagatcacccgtctcaaattcagttgacaatcagcaccagccacgtctcctgggaaacatgaagtggccttaaccgtcacctgcctgtcatctcaggcttgccattagtcaggcattcgttaaagaattctgtcaataatagaaatcagaaatgcctggaaagtagatttcttgcagggcagatggagaagacagcctctgggtctccaaacccctttggctctcactggggcttctgggcaggactggggacccatgtacatgtcatctcagggcagctttctttctaaacccattttgcagatgtggcggctgaggtctcatccagcacccagtcacgcctctcttgggggagagccccaccgttgggagctgagcaaaggcaatatttcggttttttttttaaaagatactgtgagttggtcatcactagacttgggtgtaagttaactgttatctcaccactttgctaccaggttataatcaaagaaagtcttagatcaaagtcagccacacacacagacatttatgaaaaatagttttgcacaatcagtgcatactgtctgttcttaggcttcataaaacccccttccctgtcatttgaggtgctctgcctgagccttgataaatgattcatcagaagcaaatgagaaagtattctggaggcaagattcaatttgcatggatagtcatcttagggaaccagcatcctccagacccacagcttcttgccactagaacacagggtccagcgttgggcactgtccttcaacactgggcttcctacacacacacatccaatccacgcacagcccgggagagtccctgaaacattttagctcatccacataccttgcatggtgtggaattcaacaaggagaacccatttctcttaatcattacactcattaagaaaacacgaagctcacaacagaaaataatttctaactattattattctgtggtttctgcttttgatcaagataagaatagccgaagcacccacccaggtcactctcatggaatggggttttctgattaaagattggcaagcaactgacaagcttgtagcacatcctttaagctggcactcgctgtttgagtacttgagagttatttgcagacttcctaagtctttcgttttgctaactgtgtgtcaggaactgttctgggcactctatgcaatgtgagcttatttaatggttaccacctaggaggctgatgtgctcttgacacccatttcacagatgcagaatctaaggaaatctgctcagtgtttacacagccaactggtcagtggtacagcctggatttcatctctgggtgtttattcctggagtccctgctttaaccaccatattaacctgcttctgaacaccaaccaaagcttgaatccagccttccaaatctcaagcctgggcttttgttaaggaggacgctcagggtttcttgatagccgaactcctgtatgtccaggaaagaataaagaccagatggtcttgatatgaaaaggcagcagattttaactacaaaatgggaaatgagtaattcgtttacgaggacaaagtagtgaaaactgttcttaggcttagggtaggtgattatatcttaactctttgaatgttcagtcaaagctatatattcaagatattgtgggttccctaccagaccaccacgaaaaagtgaagtttgcaataaagcaagtcacacagattttttggtttcccagtgcatatatgttatgtttacactataaagtattttattaagtgtgaaaagtatgtcttaaaaaaacagtgtatataccttaatagaaatactttattgttaaacaatgctaacaattatctgaggcttcagcaaatctaaatctttctgctgatagagagtcttgcgtcaatgttgatggctgctgactgatcaggatggtggttgctgagggctgaggtggctatgacagttttttaaaataaggcaacagtgaaatttgccacatcatttgatgcttcctttcactcaagatttctctgtagcctgtgatgctgtttggtagcattttacacacactaaaacttcttttcacatgggagtcaatcttctcaaactcggccaactgctttggcaactaactttatgtaatattctaaatcctttgtcatttcaacaatgttatcagaatcttcaccaggagtagattcatctcaagaaaccactttctttgctcacaagcatgagtgggaactccttatccatccaagttgtatcatgagattgcagcaattcagtcacatcttcagagtccacttctaattctagttctctgctatttccactacatctgaatttacttcttcctctgaagtcttgaaccggtcaaagtcaaccatgaagatcagaatccacttcttccaaactccagttaatgttgatattttgacctcctcccatgaatcatgactcttctaaatggcttttagaatgctgaattttttccagaaagttttcaatttactttggtcagatccattagagaaatcactatctctggcagctatagccttataaaatatatttcttaaataataagacttgaaagtcaaaattgctcgtgattaatggactgtggaatggatgttgtgttagcaggcatgaaaacaacattcacctccttgtacatctccatcagagctctgggttgaccaggtgcattgtcaatgagcagtaatatttttgaaaggcatcttgtttctgagtatcaggtcttaacagtgggcttaaaacattcagtaaaccatgctccaaacagatgtgctgtcatccaggctctcttcttgcatttatagagcatatgcagagtagatttagcataattcttaagggcgctaggatgttcagaataacaaataagcattggcttcaacttaaagtcgccagctgccttagcccccggctatagagtcagcctgtcctttgaagttttgaagccaggaattgacttcttctccctaaatatgaaagtcctagatgacatattccaatataaggtggtttcatttacattgaaagtctgctttttagtgtagccaccctcatcaatggtctatcctaggtcttctggagaacttgctgcagcttctccatcagcactttctgttcaccttgcacttttatgttatggagatggcttctttccttaagaatcaacctctggtagcttcaaacttttcccctgcagcttcctcacctctctcagccttcccagaattgaacagagtttagggccttgctctcagttaggctttggcttgagggaatgttgtggctggttggatcttctattcacaccactgaaactttctccgtaaaaaagtttcaccactaaactttgcccactgcaagctgagaagatccttcggagacctctttggaaacacatagcaaagaaaatgacagaagccgccatctcttgtatctttaccatgctttcaacagtagctaccaattattgaacagctggtaggacccagcctctctatagacactgaggcttctaatctccttcttctcaagacctcaataaggaaaatgagttcagagctgttattaacttgaggaaggttgcacagcctataagtgacaggacatgaatcaatatgacctgtcacttatagatcacttatgaccttgaggctcctgctctttctagttcttcatttctttgtgtgtttcctgtagctcttctccaagggcacaccccacatagagagacccaccaggcctggcttgagtgaaactaaatgcgtagtgagtagaagttgccaagcaccagtgagaatgggaaaatgtggacaacgtcaccacctgccaggtagcaagcacctaggctcctacaaatgggcaaaaaaaaaaaaaaaaaaaaaaatcggtctcagttttcagcctatggcaaatgagccttcagcaaatgacatgagcatgctaaatgattgcagtgtccatagcaggtcttgaaaatgaacccggataaattttaagcatcactggtgtatgctgagcgtgaaataccttgaaagcagcattctcttttgtaaggatcctattttctcttaagcatttctgccttgaaccgtatggtttgctcaaggcctctgactacttcctttttttctgggctgactaggattcatttacactgtttttgtaaggatgcgttgctggatgctgtggggaataaagattctgcacagatggaccctcactgtattgttgtagaccaggggccattgcctgcagggacctctgtcctgggtggtgtttggtgatcagaggcttgccagggatggcagggacgccagggacagcaaggacggcagggacgccagggacggcagggatgcgagggacggcagggacgagagggatggcagggatggcagggaggcgaggtctctggttgtcgtgattgggcgtctgggtgtgtgtttgtttatgcttgtttattaatgccccacctacttccagagagatctggttctctgggaagtgaaggttagagattcttattcccgggttgttttgatttattttttaatcatgaaactgagtcacaccaatggtacagatatgaacagaaaaattatgagtcccatgcctgcagtttctgaaacatgccctctttccttcttgtgttttttcttttttattgtgattttatatatataaataaatattatatatatgtaaccacaatagaaaagaaaaaatacatacattacaaagtttgccatttaaccgtttataagtgtatcattcaatggcataattacatccacagtgttgctcagttatcactactgttgatttccagaatgtttgttcaccccaagcagaaactctcaactccctgttcccatcccccatgtatatggaactaggaaaagactccagtggcagctgatgacacacattcctacaccccggcaagcagagcatccaggacaacctgtcctgtgcccgaggggtggggcacggtcaccctgacctcccctgcttcccctgcccatccatggctgtccttcactcacccaattagtgatcataggacaacaggaggagcctgggagaggaaggaggaggcctgagggatggacactggggtgctgaggcggaggtctctggggtgagcagacactggggtgctagggcagggtctctggggtgctgtggtggggatccctggggtgaacggacactggggtgctggggcagaggtctctggggtgagcagacactggggtgctggggcgagcagacactggggtgctggggcggggactctggggcgacccaagacccttctttatttgccgggatggagtcttacagtcaggctttgccctctctcgcggcctcccccagcagtagagacttctcacttcctgatgttcgctgctggacatttctgatgtgtttgtcttggagatggttttttcattacccaagctgctgctaaatccgtcaacatttattttgtgaagttgaaataggtggacgaggcaggattgggaggaggtagaggcgaataagaaggaccaagtagtggagagtagagggagagtgggtggccttatgatattgaaaacacaatcctgaaattagactgttagtgatgacaggcttggtgctctggaggtgaagctgagggtacctgcctaccttgatttccagactggtttatcccaacacttgctaactccacgttagggctcttagtggctaattgtctctaagcttgatttccagactggtttatcctaacacttgctaactccgcgttggggctcctagtggctaatcggctccaagctttggagggagcattttaaggtcttttcaatcaacacattttattttctgatgacctagaaacaggtgtgaactctccgactccccaccaaaagaaagtagatgaagaactcttcaaaatttgtagagaggacatatcagaattgaatcacaacttttcaggccttggcaaaattttctttaaagaaccaacacaggcacacctactcagcactgctagtgtagtggggaaatggctggctaatccctactaaaagagttttgctgtgttctaataaaactttatttaaaccacctcacaccgattaggatggctacatcagaaaaaaaaaaaaacagggaaataacaagtgttgatgagggtgtggagaaattggaacccttgtgtactgttgctgggaatgtaaaatggcacagccactatggaaaatagtaggatggttcctctaaaactttaaaatagaattaccagatgatctggcaattccacttctgggtatcatcaactgaagaatcataaggtacataaatttggaaagcagagctttatttctcataaagggttgcagcctgcaggccagccattccgcagaccaggaagcgtagcctccagcttctgccaagagcaagcacttccagggaggaggaatgagacaggaatttatgctgagtgggttggctaagtatacataatcaataagctatagaagaagtcatgaatattaatgaaggagaaacacacacatgtgtgattgagccatgcctcttcgtgggtcccgtgttcaaaaaaataccagcattaggatgacccaagggtggaggttttggccctctgatgtcaaaagttcaaacagaggccacgaaaaccctcactgcacatcctccttcgactggccagagccaccctgcagttggtagcctctcagcaggagggcatgcagtgtcaaactggcaagctgtcacgtggaaactgcaaagagggagggggagtccacttatggctcagacaagtggctaaaggtgatataggaatgagttgtctgcttcttgttttctagagccagtttctgcttcctccttaggagagaattctggttaaaggctattaaggaaagggtatactgaagcgggtccaacctcccatctcttcatggtcatgggctgactcagtttttgttgttgttgttgtttttgtttttttttgttgttgtttttagacagagtcttgctcttgttacccaggctggagtgcagcggcgcgatccagctctctgcaacttctgcctcccaggttcaagcgattctcctgcttcagcctcccgagtagttgggattacagacgcctgccaccatgcccgggtaatttttgtatttttagtagagatggggtttcaccatgttggccagattggtcttgaactcctggcctctggtgatccacccaccttggcctcccaaagtgctgggattacaggcgtgagccacggcgcccggcccggattcagtttttaagtcttctctggggtccctttggccaagaaggagtctgttcagtccattgggaaacttaggattttatttttatttctcaatatttatccaaaataattgaacataaggacttgaagagagatctgtacactgatgttcatagcaacatttttcacagttgcgaaaaggtagaagtactcaagtgtccatcaacagataaatgggtggtatacacgatgtggcatatgcatcccaaagcctccatttcctcatttgtaaaatattgtgtgattcataccccgcaagacttgtgagcatgaaataacatgatctgtgtgaaagcaatgacagtgtctggaacttagggggtgctcaccaaatgcctagcagcaaagcagcagaaactagaggtggtcgtgtgggagaggatggaggaaccggtggctgggaactgcctactttcaggatttcttacctttggcccacgacaattccttggccaggaatgctgttttggtggaaactgggatggtatgcatccagcacgtcactctgtttattaggcatcagactggtagacaagggcccagtaatctcggctcatggagacccaagtggggatgacacggcctcaggctagagcagacgcaccctgggaatcctctgtattcttgttggcatcacagcccaagcctgtgtccagcagggctgaccagaagaaaggtctggggcattttaggttttagttaagagtttgatggaggcttaagcttttattgatttgaaaaagaaaagaaagggaatcttggaaaaaagtaactcgctgtagtgcagacaggaaataatagcaatgaaatcttttggcttccctgctcctgaccccagaggtcccttcctcgctttaaaatcctcaggcaccccctccacccctgttgcccacaagcaaatatgcagactccagagccccacatccccgtctctcacggtctggcccagttgatctctctcacctcattccgaaaactttctagtgacattggtcttcccaccgtttcccaaatcccaaagacacgaggcagatcccacccagtcccccagctttgcattactttgcccttgtgatactgggggacgttcttagaagtcacttctttccacatatatggtttttgtttcccagtcaaggtcccaaggtaggaagtttctggccatgtgagtcaccacctggatgaaggagccaccctgccaagtgtggggaggtgccaggagacggagcggctgagatgaagcattcattatctctccttcccatggaactgaagtgacattctctgcatctctattatcacttcacctcaacttgcctcttcccagcatccctgaattatgcagaaatcatttgaaggcaaattcccagctactgttgctagactcatttttctgcagggatggaggaatgtgttgctagactcatttttctgcagggatggaggaatgtgtcacttttaatttgtttccttttttcccacccattttgggtaaaacattgtgttaaaagatacatcgtctccacccccaaagcagcctgtcttcatgcccaagggatttaaatgccctcatattgaagtgtacaagctaattatgtaacttaaagtaagtttagggaaggaatttaaatacccccacagcttcacaatgtgagaaatggggctgtgcaagcccctggaagttccctgcctttctccacattctccctctgtagtaatgaggctcctcatctttctgttttattggcagcaaacactgggtaacaggggtgctagaagggcctgagggtctgtcataagcaagggcctataattgtgccaggagcctggaatagttaaattggttcctgattacttttcactcgctaagttcccctcagctcaattaacatataattatttaggactatgctacttttgttactggcacatggctttccaaataggcagctttgggggatgatctccctctggagcccacgcactgcatccatccacccgccctttttgttcaagaacaaaagcaaggctggcgggacctcctccagaaccttcatgctgcagagaggcttggaccttggcaggtgcctcctgcaggcagagcctcgccggccacaccagcctgtctcccaaagacgcgcagaactgcagaattcacagggcttgtctttctcttttaccaaatgcgactttacattttgtaaggtgtcagtggagatcatatcagtgttcagataactttgtatcatgtggtgatgcctcttccttacctttaatctcaaaaataaaaaaacaaaacctgtaggttcaaagttccagggagcttagaggcactggggttgagtgctttcatttgtcagtggagaagatgagggtctcgaaaacttgagcaacattttttttgttttaacatttttaaaattctattgtaaattgacaaataataattgtgtatgtgtatggtatgcagtcgatgttgtgatacatgcattcattgtggaatgattaaatcaaatgaattaacatgtctgttccctcacatacttctcatttcttggtggtgttgaacaacgttccgaaggtcaggtagctccacgtttaaatggacatgaagccattgatagatagatagacatacttgaattaagactttaattgtacaaatgtgtgtatgtgtaggctacaattaaactcatatttgacactgtcaagaattagtagtttttgttgctaatggggttaaatgtccaggataggaaagcttactggtttgttgttgctttaattgcattggcttgggagtgaacccatctccctttcttattgacctcacatttttttaagtggataatgttatgacaagtttgataaaaatgatgcttctgactttctggagacaggaatcaattaccaagaagagataacatttctctccattgagccattaaaaataaaattcacaggcttctagaccttacggctttttgaatctttttaggttgacataatttgcctgtgattctttctggattatttatttgtatgtttggttttatctcctgaattttagattacaaataatccttccttagattttgaccatttttaggacagcattcctgaaagcatttaattctcacagcatttgttattgttttttagaaattaattaattaattctcctggctcagaataagacataatttgtgtggttcacaaggtggttgatcccttccccctgagtttctggcatttctggtggaatccctaatgagaagtttgcataagaagaacctgaagagagctgaatcccaccgcagaaaacctacacggttttctgcaaggactcagggagagccaggggcaaccaaatactctagcctccctgaggcctctcatttgggccagagcctgaccttctgagccagctctttcatccattcattcattcacttactcttccatccacttattcattcattcctgtgtcagttacctagtgagcatatactgtgtaccaaatgctgacttggcactgaggacacttaggtgaacaagcaggtgttgccactgccttcgagatacctatgctttactcacaatctggagggcttctcttacctaaacccaactccagcagtgtccagcacagatagagttgtcaggatgcagagtcaggcgcattcataccccacacgccctcgaattgcctgctgggcaaaggactatgatcctgcactgtgtggagcccctcatttcatttggcaaggcatcctcccatccaaacacttggcttagcttgcaatccttctcatattcctctgtaacagaaagcggattggtatgcaaaagcttctaatatgattttcttattttccctactttcacatttattagaaataacttatgaattacagtaactaatagattttttttttttttgagatggagtcttgctctgtcacccaggctggagtgcagtggtgcagtctcggctcactgcaacctctgcctcccgggttccagtgattctcctgcctcagcctcctgagtagctgggattacaggtgcacaccaccaggcccagctaatttttttttttttttcttgagatggagtctcactctgtcgcctaggctggagtgcagtggtgcaatctcggctcattgcaagctccacctcccaggttcatgccattctcctgcctcagcctcccgagtagctgggactacgggcacctaccaccatgcccggctaatttttttgtattttttagtagagacggggtttcaccatgttagccaggatggtttcgatctcctgaccttgtgatccgcctgccttggcctcccaaagtgctgggattacaggtgtgagccaccatgcccagcctgtaattttttttttttagtacagacggggtttcaccatgttggccaggctggtcttgaactcctgacctcaggtgatctgcccgcctcagcctcccacaccacactcggccgactaatagattttcttacctaaaagttagtctctggttatgtttctccttgcctcattgggtgattggcccggggcatagctgtgtttccgtcccgtcaggtgtgggctgtaggatatcatttatgcatgtcctggaagtttctgtgcaagtgacgcagcccttgatgcattgagcccaagcatcatctgatctttgtttactgcactgattatggttttatttgatctttccttcagctttcctcatgctacttgaatttccacgttgtttttgtcccggcatttaaaaaaatttatagggaatctgaattacagaatctacctctcagccctgcactttctcagtcgtcagtttcttaaaaggtttttgttcagccttcacattattttagcatgacatacatagttttttttttttttttttaatttgagacaagtctcactctgtcacccaggctggagtgcagtggcgcaatcctggctcactgcaagctccgcctcccaggttcgcaccattctcctgcctcagcctcccaagtagctgggactgcaggtgcccgccaccacacccagctaattttttgtatttttagtagaaacggggtttcactgtgttagccaggatggtctcaatctcctgacctcgtgattcacccaccttggcctcccaaagtgctgggattacaggcgtgagccaccgcgcccagctgacatatttctttaagtcattttgagaactgtctttatttaactagctgcagttgtcccagagcttaattcgaagcagcatattgcaactgtttgggtgctatcttgaggcacaataattaccctataataataatgtgtgttttagtaaactggtcattattgtcatagagggctggaaagagtgtcttcttaaagctcataaggaccctagggtactctgcaaatagcagagttctaaacctgaaggaaaaaattaaggggaaaaaaaattgtgttagtggtcagaagccccgtgtccttatgcatcacggcacagcccaccctgtaatgacaagaaggtgttgtattccactgacacttgggggcttttctgtgatctctggggttgctgcatgtacatcctcagaggctctctcaacacagttaccaagggtcaggtgggttacttagaccatctctctagctcatactttgtacttctgggggctgaaggtgacaggacagaccccatcccaagactggggggctgattagagttgccaggcatcccgtatatgcaaagcatgtcctgaattttgcaacttttgtcctggatcctttattaatttgtcaggatgctctaaatgtcctgtattccgctttttttttctaatcaattacagaattcagcaataagagctttattcaaatttaactgggcatcctatatttgcaaaatctggcaaccctgcggctgaggaatgttgctgcccagcctgtgttcttggttaatggacaaggcagcaatgcctgcgtccctccattaatagtcacttagaaacactaattcctcctttctggttatattttaatgtccccggggaagaagtcaaataactccacctgcagttttctttagtgaccaaaattgcaaactctgtcacaggccctttgtcacagctgttttggtcccagagctagccgataggtttcttgatgaaataatgtctgcgaatccctttctcagagcggcacgcagtgtgagcgtgagagaatctgcagtgacagcgggtgatgggcgggaggtggtggtggcaggtggcgatggagacctccttaaaaccccaggtggtgaatttcttcttccctcctccctggctcactgccttttagcggctgtgacatggccagggcgtggggagcttctccaggcacgcttggctgaagagataatgctgtcagaggacagcagttactagtaagtaacctacatttcccttctactctggctgctccttgctgtctaaatagagaaagtggaattaggtttatcatctgtgacctaatactaattcctcttacatcctgcctttgtgcaaagggaaaagggccatttaaaaagtagtggacgaagctttagtattgtaagcactttcaagcgttataaaacaaatctgttgaatgaacaagcatgtgagagttggtattctagagtcacgtgtgatcgcccaaattgtatatttcattacaaaaagtatataaagtcatggtattatagagtgttaaaattatactttatcaatgaatcaagaaattaaaatttctgagaaaattcttgtcaaatcactttcatgtctactaaagcttttaacttcttctctagtaaaatagtggtcaaaattagcatgtggaaagtaggccaatgatactgaagtcgtaagccatgcttccaagcctggagatattgcagcaacctcttccaagcctgacagctccttgcgaagagtgctttcaactgggtagcttgaaaaagccagctaagcaaagatcagtggaatcatagaacattaagacatggcaacttgagaaaacgatttaatttgcacctttttttttcttttttttaattagattttgttttaagtcatacttttcaaatgttactttcagaagctgttattttggtctgtttctttcatcctgcatgtgctaatttccttgattaatttggagaacatctgcatataattccgtgatcttttcgttggcaaaacctcacagctttgcgcaagacttggagagttcacattccagacagtctgggattgtatctaattgaaatgccaaacctaccgaagtgccagagcgtaagtgtgtaattatgtaattttctcttgatctttcagagtcttcctgcgagcaattaatcagtatgcagatatgctgaacaaaaaatttctggatcaagccaactttgagctacaggtaagagaagaggtagacacgacctttgtggagaaatcatgttaaaacaaattgctggtccgagccagtatcttacagtatttctaatccttgaacttaattggtctcccatccaagatgcggaaacggaatttgtagtatgtactattggaacctgaggagtgaaaattatacttttggagtattcgcttaatttagcaaggaaagagatagagttgtttcagagagaagctattgaatcagagtgacaagaagggactcttcaagcagggaggccaccaagtcccggtgtgtgtatctgccaagattgtctcagcccatcttactgtggagggaggatcagcagaggaggagacccaggtctgcacctcgagctcagcttgcttttataactctgtgttccctccatatcctctctcggccttgtgctactagcagtggcttttaccaggccagagaccctgccccccagaccccatggtcctcagaaatgctcctttggtgaatgcagtgtgtgagagagagagagagtgtgtgtgtttgtgtgtgtgtgtgtgtgtgtgtgcgcgcgcgcatgcatgctgtaaggattgattttgcctggcctgatttgtgtgtgtgtgtgtgtgtgtgtgtgtgtgtgtgtgtgtgtgtgcatgcatgctgtaaggattgattttgcctggcctgatttcttactgtgcatccaaaatgtgtggctctcacttccattgtactctggatgtgtttctgctaataatgattttatctgtcattattattacttagtttattttagtaaagtatacaaatttttgaaaagcatgcagatacaaatggcatgtttatttcctgggcaagatgattcactctctcaaaaggaacccgaaggatttttgttcacccattgggtgatccaaccccaaaataagttacccaatagcaaataataagtttacccaatgctctttcatttgcattgcccttatttttataattttttaattttaagtgtttgttgtattggcattacaggatataattagataataatatatcaggtgccatatatctaaacatgttacttgtttataaaattttttatcattttctctgctgaatgcctgttttcatatgtcataataacatactttctctttatacaatatatatgtgctgaatatcagtttagcaggtaaaataggaaacattccttcctaaccctttgctgcctctcactgcccctctgcagggataacttttaactcattgttctgaattctttgtcacgctttcagcatttatatgggcctgtgtgtgttttttttcagcctttaacatgaactggatcataccctgtgtttttcagctctgtcatattccacgatatgaatgtaccaacatttattcagccatttctgcactgataacctagaggctgtttccaggtgtttacaatcacaggctgtgctaccgtgagggctgtgatacatgtgtctcttagtacacgcattgctatggaaaaggttgatctctaggccaaatgatatgacattttaagtttgatggaaaatgatcaatttccttcctaacatgattttagcaatttgccaccccaccaaccttgagagcagccactttctatctagaatcttcttcaacactgatttaaaatgattgatttttgtttttattgtcatttttctgatgattatttaggctaagaatacttagtggccatgtgggtttctgctgtgaattctctgatcatttcttctcctaacattcgtatttggctgtcttttttataagttggaattcttgatataggctaggcatgggtttaggcttatcatatagaaatatttcatttttctgtagtgaaatctgttatttcttttacagctatctggtttcatgttttacttggcaaatctctccttgccttaatattatatacttctaaattttactgttttgtgttagttaggatctgctaatacctgtgtggttttgtgtttttgtttttatctttcaggtgtttaatccatttgggatttctgtagttagtataggggtaaggatctaacttcactttttcccacgtcatttcatgaatagatgactctttccccaatgattggaaatgctacaattaacataattataaatgtatgtgtgtataaattccattttctgtgttattatcctagaggcttaatccttatacctttgtacccagctagcagagtcgctacttttccactcgttttctactgcagaattatcttggctgtttttgtgcatttcctgttccatttggagtttaaaatcagatagctgagtttctcttttaaaaacatactgcttggattttagctggaatcccattgaattgataaataaatttggagtaagtttatggtatttgagggaatactttgcagtatttttttccccatctcatactagactatttaagtatttgttttgccatttttctggtttttttctaggtcaggtctcacacatgacttgctgggtagattcccgtgtgttttagttgtggctgctctggtgggggagcctgtttctcaacatgttggttctccctggctttcgtcctgtttcatgaggatggccccttggactctcaccgtgagcccgcacaccttacaagccacgtgcttcagggcccacatcgagcgtcgccccttggcaggtgtgacacacatatttattgttgtttgaggagggtttagcaggaatcgctgcctgctgtcggctgcattctgagagtcacagtcaggggcccatctagcatacgacccatgtctgcatgtacccagcacagatcttaatttaaacaccaccgtcaccaccatgagtgctctggctcaaaggcagccctggtcctatgtaggaaaagaaagaattaggagttggtgaagctgtcatttaaaaagaagcattcgtgttttgttgttgttgctgctgctgttgctgttgctgttgttgttgctgctgctgctgctgctgttgttgttaaagggagcaggtagaaatgaagatctattgtgagtcctcgcaggcatgggtcctattctggctgagcccctgaccatgattctcagaatacaggtggctgcagccagtgattcctgccggtgctgtggcaaggctgaaatcggtgggaggtgtcagtcccaaaaacaaaaggaacgacttgtattttattgactggcactcccctttctttataaagggggctaaaaaaaagagagccccattgtgggctctgaggttgggggtgcctggctcagacccccattctgcttcatgtgttacctgtagctttgggctggtctctaaatctcagctctgcaatggggataacagcacctacttggttattctgtggtaatcaaatgagctggtgtattactatagaaagtgtgctgttcatgggaagtgttggataaatgcaagcccaacagacttttctcaaatcctacaaatgctcttaaatttccccttacttctcaggtaattaaaaatagagtcaatataatgttcacactttatttttatagaactctttgcagctatctcctttgatataatacatattatccctggtttgtaaatgagaaaactgagacctacaactttcttcttctaaaggccgttgtcttttaaaccgcatatatgtagtccataaacccttgaaatatgggtttattgaaagaagaaatgtttgatctctttacatttgttttccttgtctagtgtatgtgtgatttgggggtaaagagtcctaaattatggaaatctatactattcttaagtgaggagcttcataattacattaataaaagttaacattggccaggcatggtggctcacacttgtaatcccagcactttgggaggctgagggaggtggatcacttgaggtcaggagttcaagaccagcctggccaacatggtgaaaccccatctctactaaaaatacaaaaattatccaggcatggtggtgcacacctgtagtcccagctactcaggaggctgaggcaggagaattgcttgaacccagaaggcagaggttgcagtgagccaagatcatgccactgcattccagcctgggcaacagagggagactccatctcaataaaaaagagctaacattgatgaagtgcttacacatgctctgtaccgccttaaattctgtgcatatatttacttctttgatcttctgagcactcctataagatagatactcttgaaattcacattttatccatgaggaaactgaggcagagagaggttagagtctgagtaaatggcagacccgggatttgaatatgtgcaccgtgacctctgagcccacacgctaaggcctgaattacaccgtgggtggctggttagcaacatgtatagagtgagtgtgggttttttttttaacttttcagaagtgtgtgctgagcaaatgataaatgtctgagagcattgttgagatcctatatcaagctgttcaacaacttagcatctcctcctttttggttttcagctgtggaacaactactttcacctggctgttgctttccttactcaagagtccctgcaactggagaatttttcaagtgccaagagagccaaaatccttaacaagtaagttctcatctagctctgaaactgcaggcaggagcctccaactctaatcgcataattttcatgtcatttctaagccaacttgatacaaattgagatgtaatcacggtgtaatgaaagggtggttttaaatcaccaatcaggtattgccttttctaacccatgaatcaagatctaaaattgcaggactcatcctggaaggttccaggtcagtgtaatccaagactattagtgcaacacagaatttcagcttccggagataattccttttgctatgcactattctgatgtcatttcacatgtggttgactttattgcttaattcttcaattcgaaaggagcttctgatgaaagctcttggctctattgggattgttgaacagctcactggggagttagagctatcggggttccttcttggcagcagataacccctgtcttcttccgggcaggagctttgaatggactgaagcggcaccttctatcattgtaaataaacctctccaaagctccatgaaagccgagatccttgccggcccctccagctctgtaaccccagtttgcatcatgcaccgctcatgactcagtatcaagaagcaccattgttgcatgggtttccttcccctgtttggacacccggagggtcttgcttcgtctctttctgcctccgtttcactaatttctcactgctgtcggtgttcctttcataagtccttttgagaagagttctgaaattgcattggtgttgccacgtcatcagtctctgtttgtcattttataaatacctctgcaatatctcgactgttctaaggcttggccaactccatgctgctagctgaggttagagattccagaaagagtttcagaaggtggcagctgctcttatatcctgtgagtctgtatctcactttcaaggcaaatccaaagcacatcatctctggagagtaagaattatagtcataagctgggctctggtgctcagccagtagtggtaataccagctacttaggaggctgaggcaggaagatcacttgagcccaggaggtcaaggctgcagtgcaccacgatcatacctgtgaattgccatgcactccagcctgggcaacatggcaagaccccctttcaaaaaaaaagagaagaaagaaagaattatagtcacgtactgcataaccacagactacatgctgtatttttactgtaacttttctttgtttagatacacaaatactcaccattgtgttacatttgcctgtggtatttattgtagtcacatggtacattacaaacatgttgtacgggtttgtagactagtaacagtaggctataccgtatggccgatgtgtgtagtaggctgtagtatctcagtttgtgtaagttcactcagcagcgttcacacgacgacaaaatcacccagtgacatatttctcagaacatatccctgtcattaagcaaagcatgagtatatttcagcaaatcatttactcagcctgtactttatgtcagtgactttctaagcatttcatgtgcatttttcttctataatcattaaaaagcaaaaccattccttaggccctcgtatctgccctagtttctagatgaggaaggtcacacacagtgaccgagccacttggccagtcccacacctagaatgtggcaaagcagcattctaatctaggcgattcagggcccacgattttcacctgggctgcttttagaaccttcgagcttttggtctgcacctatctaagtaaagatcacctttcacctggccatctttccttcaggcctcctcagctgggtgattcctgcctgacagccatctgtgtaaacagtgatcattgttcagaaacaagaaatgcacttgctgagccaagcactgagaatggtgtaggcagagtgggtgctcgcctgtgactaccgaagcggcacgcagcagctgcagcccaccaccttggggcctgcacaggtgtctgtcgctcgtcctggcttccagcatcaagagacagacttctccaggctgcatcttctggagactggctcagcaggggcgcgggctcctgctttgtggaatgcacgctccctcagggcccaggggaagggagggatggtgctttgtaattgttgctgttcttgttgatttgcctttgtgctgggaattgtagtgcagacggtagtgaccaacacacacaaagcacagtgcggcacaacgcacttcaacgcactgtaatccaccaggtgcggacacacctccttcagcacacgccccttgttgtcccgtccagcaaaaggacagctcggccacagcaggtgaagccacctgcccaagtgtccagcgcccgctattgggtgaagctgggacccgagcccagccacagctcctggcctcggagatgcctgcgggagaagagaggtgaatttaaactggaaatctgcctcaaaagagctggcatcttcttagtggtggggccgagcaccccgcaagccccagcagggcagctgtgtgctgggcccttccttctgttggtgtgagcgttaagagcctaaggcaacatcaagacatgcactaacagcggtgcggtggctcatacctgtaatcccagcactttggaaggccaagatgggaggatcacttgagtccaggagtttgagaccagcctggacaacacaacaacacccccttctccacaaaaaatacaaaaattagccaggtgtggtggcgcgcacctgtggtgccagctactcaggaggctgaagtgggaggatttcttgagcccagggggtcggggctgcagtgagccatgatcacacgactgcgctccagcctggctgacagagtgagaccgtctgtctcaaaaaccaaaacgaaaagaaaaaaaaacattaacctcgaagggccttggctactaaagaaaacgtttgcttcccacgtagtggcgtggattcagaatcttcaaagccacggaaaattacacacagccagctggtgtcgccccctcaggagccacccagggcctctgcctagggctttcgtattctctttgtcacaacgatagcaacaggagactctggatttcccccaggaaagtccccaggcagttcagaagttgtctttgcaagacactggcaggacagcctcagggctttgtgctgtctgaggggcctctccaggggcatgagttctgctccgcttgtggaggtgacaggagatccaggacaaagcccccggagcctgagataaggctgccttgaccttcaggccacgcggcacacacgtgtggagggtcagccctatttgttgtagtcttcatgccacttgataagccttcagcccttcatagtccatttgcaaattttatttctaaatagcaaaacctgcataagaaatacatgacgatgtcctaccccaatgcttaaattttctcaggcacatacagtgcctagaaatgtgatttgtttaaaattgtccgcataaaagggattcagtgcccactctgtgctcagtcgggccatggtcccggtgccggggacaaagacacagacctcgtgacgaagaaggtcatggtctagtggggtaaatggagaagcaaaaatcatgagtggagtggggcacgcatgcagtggtgacggagggccttggcagcccggagacggcccgtggggctcagccgtgggagacagaggcctcctggcagcttgggcttcccggctgggtggtgaaggcagctgagaggtttgccacgggacatcgagtgccaaagggcatggcgccatctacatatgagcagagacatgatctgggttgtcgaagtgtaagggagcagcttggagcttggggcggggtgtgggggctcgtggtctgggagtcaacctcacactctgggcaaacgatgggcgctgacttggagccccgtggagcttgatgcatgcacctgtctgtttctcgggggaaaggcatgtggtataaaggtggagccatgacacacccacttagtaggctcagcactgcctccatctggggcctgtctcttactctagggcttgtgaatccaacctaaggcatctgagggagcatccccaacccctcagccttcccttcccttcccttcccttcccttcccttcccttcccttcccttcccatcccttcccttcccccttgctaagcccttgcagctcctcacatctgcttggtccacagctttgtggctcaaaacaatagaaattccagcatcaggaaacctgcctgctccatcctcctaatgactgaggttggggagataattaggattttcattctaaagacattccccaaagtgcatgggagtaaataaaagaatgggccataccacgcagagaactgattatgtcagacccaaattgagtatgagattcgccagtgtaccacaaaataaataacccctaggaatcaagtccataatatgaaaatttaactggctcaaccttcagacatccttggtgctagtgactcccaaggaaggacagagatgtcaacagaattctaagcctgaccagcagctcttcctcccatcccagccccctagccttttttacattattggggtgcaggaaatatgtctaaaatgtaaaaggaatgacttttgattagcagccagcttgataattttgttatgtaagacacgtgcatcctggtgtgggacagtgtgttgaatgactgcaaaggagcttctgtgttcaggaccggaagaggaacagggttcatgaattgggcctcccacatatctaagcataaaatgctcacttaaaatttcagcgcaagaggttaagtttgatggcaaagtccagctcagtgcagagagaccatccacaaagacctccccacctggtccctaggctgttttcagttttggcgggggtgggtgggttgtttttgtttttgtttttttgtaattatagaagtctgcagtgttctaagaggataggtttcacaatgggaccaaaatatccccatctgaccaaacactgggttctgcagaatcttctccagaagattatgtcaaactctagatactacctttaaggaaactaacaggaaataaacatgccatgcatgccgttttgcagcgtgacctaatcagaagctgcaattgtatattcctgattataacaggagatacgatcaatttaatttgtgtctgtgctcatttttttcaagagactgaaattattcaaaattaaattcacttattagaaggagactcagggagttagacttaacaagtggtgacctgtgccaacttcaagtcagaaaagctcactgtgtcccacatgcaccggtggtgttgtttttgatgtcccaccccctctcacctctttaggaacccaccagtctttcccatgaagttaaaaatgcctcaccccagccatgagctccctccagcttcctttaggtccatctcagccctttccttgtctcctttccccacctcccacccactccgatgctggctctgggcactgcattgccccagaacctcagccaggtcctggctgcccccaagcagatggagggtattcagctccctagatgttctccccacatcctcaacatgtttcttctttccctccatctcagaacatgcttttcttcgctctcaggactctcctgagcttttctccaagctttttggtgtctgctctctcttgtcagattcctacccctgcaccccagcatcaagtggcggtgggggttccgcacaccttggtcttaggccttcacactctattctctttccttaggaaagcatttttcaaactgcaggtctcaacctttgattgggtcagaatattcacttaaagggccatcatatccatttcctaggctggtctgccataacagtgaacacaaaccgggtggcttgaattgattgtctcacagttatggagggcagaattcccaaatcaaggtgtgggcagtgttggttccttctggaggttctgagggagaagctattccctgcctctctcctggcttccggtggctgccccggtctttggcattccgtggcttgtggctgttttactccaatccctgccccatcttcctgtggccttcttctttgtgtcttcctatgtgtctgtgtctctcaatctccctctccttataaggacagaggtcactggatctagaggccactctactccagtatgacttcatcttaccttgagtacatctgcaaagactctatttccaaataaggtcacagtcatggataccagggtttaggacttcaacatagctttaaaggggagacaatccaacccacactagtcatgaccaatagacttttcttttcttttttcagtgaaatagaatctaggaaaaaatatcagcattcattgcaggcagtaaggttaagcatcatttcataaaactttatacacatgcatgtatattaatatatgtgctggttaatacatgtattttttatgtcagaaaagtttatgaaacttaaaaaaaaagtggcggcagcggggacgctttaaaaaaaacctgcctcctgcagcctctgctcacggtgcaccccctcaccccctggtctctcaaacaggagccagctctgtgttctgtagccccacccaccaggcactcccctactccctccctgccatggggccttggcgcctgctggtcctcctgcccagaatgctcttccctaccctcttcgtccagatttcgtctctccttcaaatctcagagcaaatattattgtcctagagaactcctgccagagccaagctgagcccactgttacattttctcacagttcccatgttttccctataaagccatgatcctggcttttgcagaaacaattcctctatgtatctatccgtgtttatcttgtgtgattattttattaatgttcgtctctcctaccatgctcatagcccactgtggtttgtgagtcttgtctgttctccatatcatagtaatattaatattccaatatgaatattcatatttccacattagctttgtgtctggcccaagtgctcaataaatgttcactaaatgaatcgatctaaatgaccattgcaaccatgagaggaatattgtgcccagcctgagattttaaaggaaggacctagagtggctccagtgcttgccagatagacagggacatcatcactctcttgttgttcacaaaagcctaggattgagcaccatgcaccattctggcagcactacagatgaggagactgagggtcagagtggtcaagtaaattgcccggtgtgcttagattcaggctcaggctggccttacccccaagcctgagctatcactcgggggtatgtttcttggagtgaaggtgcaagaaaccaggtgctaagattaggccacagggaccaaattcacacgattttatgtccgggttacagcctggatgtgggatcccagatctccctggacgataggaagtgtgcctcctaagcgtaggttctcctgctcactcacaccgtgggtgggctcaggtaagaagctctgggcagagcacggtgaccccagctctaggccatcctggctcggtggagtcgggcatgtgtgttccccactgtgaatctcagctcttattgagaaaatgggcacagaaatgtcagcttgctcagctcatagtcttattccaaaatcaagtgaaaggaaagcactttgaaagatgtgacgctgtgtcgtgctgtggaggcatggaaagtccctgtcctgggggtgcgtgctgtgggtgtgggagtctgaggacttggattctctactctccttcccggtgaggatggccatgtcattttgcttctctcctgtatgactagtgcagtccccttggctgtttattgctagagaggaacttagttatggtccccaggactgccaccagcccggggttctgcttccaggcaataagctttattagccctacgctctcaattatccttttttcctcctccatgggaagaactaagaaatggcttgggaagcccccttgaggtctggtgacagctgtgactttatttggggattactctggggcatgtatagattcatcaaagctcccttcttattaaaaccaaggaaaagatccctctcactgccagggacctccagccggcccttcccctcacagctccccactcttcctcactgctgctgctcccttgtcctatttgacaattaaaaccgcatctttagcaccttgatgcccgcaggcccggctctcctgaggggtgggctcttgtatccttgctaatcccccagttctcaaatactaccagcaactgtcatcttccacctacaggacagtaaagtctatctgagaatggaaatccctcacccctcagcctccttcaccacccaagggagaagcactgtgcagggaggcggggaggggtggggagcatcggggaggggtggggaggagcagcatccgggagaggtggggagcatcggggaggggtggggaggggtggggagaagtggggagcatcggggaggggtggggaggggtgggaagcatcggggaggggtgaagaggagcggggaggggtggggaggggcaaagaggatggggaggagcggatgcacctggcctcccaaatccagattgtggtgccagctctggaaacacagcaagtcactcctgaattacccaaaccgcaagtggaaaatccactgcagctgagtatcatgtactttaggatgtctgaactttaggatttccctgggatcattatcattctaatcattctgggacctgagagaagtaactgagtcgggggccagcaaggcacagacactgatgaagttcagcctagcagtggccagtttttttttcttgatacagagtctttctctgtcgcccaggctggagtgcagtggcgagatctcagctcgctacaacctccgccgcccaggttcaagcaattcttctgcctcagactcccaagtagctgggattacagacatgtgccaccacgcccagctaatttttgtatttttagtggagacggggtttcaccatgttggccaggctggtcttgacttcctgacctcaggtgatccacctgcctcggcctcccaaagtgctgggattacagacgtgagccaccgcacctggcctgggccttcctattttgagggaatcatcccagaatgagaagaactctgtgtagctgggatgtgagaagcatgtgcagagcttgagtgggtcagtacatgctaggccgatcccactgtgagcatttcacctctgctgggggacatgggcgcagggggtgtttgtgttcaggggggccacctctttctgatgccactttcctgggcttgtccaacccctgcttggctggaaggggactcacccacctgcacatcgagaacctcaccaacctcagaggaaagattagaacagggcttcaccacagttttgctttctgtgtgtcccacccctgggaaatgctgcaaggacgtcagcctgccaggtcaccctgcagccaactgcatcctttcccagccctggccgcagcagctgctgggatccctttgtcattagtgcaggagcaaaatgggaatgggggagccagcactacaagcctccaagcagtgttcaggtcgtgtgtttcctgggcaattggggggcgtgagttatgcagggcgctttcctctctcccacccacccaagtccagtagctttgctgcctgcgtgctttccccaaccatggacgggcctctcctaccatggcctcaatgctgggccgtctccccagctgagatgccccctccttaaccgagtctgcctgcatcagtgctcacctggtttagggctgcgcttagagctagcgtgtcctggtagggagtggcctaggctccagttccttttcttcaccagcactgtgggccaaggcgcatggcctcccacgcaccacagcagagctgccaggtgagattgatcttctgtggttgagatgatcactcttggctgtagcccactcatgccgtgagtgacagacaggtgcttagggcaccagagtcttctctaataaggtggcagctggccgcggttgttgatttaccggccaggatcttcgcctcaagaaccacagtgcgctcttctgtaatcagtgctttccttctcacatctcctgacacgaggatgagcagagcaggctcgatgacacagctgctcaactgtaatcctgtatgataattttgcaaattattatttttaatatcagctttttccttaggcaataaaagaaaaagttaaattgctcacaaactaataaaggtttatcttctggagcatcaaattctgtttactcatgaaacacacacctcctctatgcacccatcgagaggaaaattagcatttattttccctgataaacaaaaacagtggaagatttgttggcatcttttggtgttaagcccttccttacatttaaaatgacatagaggaatgcaagaactttggaagaggtctgccctgactctggatttaattttaactttggaaagcaacctgttgtgtgcagtaggatgttatgtggtgtctgcagtgcctagacgctaacaacatgcatggaaccaagctcccccttgggcccaggagccaagagattgaagaaagggaaatgctttcatgactctccacaagttcctccacgttcccaccggggggaagatgttgtgtaaccctcagtgatgagaaagtgagatttcccccagctagattcctcctcctttgattcattttggtggcaagagaagttgaagctttgacactctctttatttgcctcagtgctagaaggctttaattgcacttaaaaataattccagtccgattttcaaatgccttccggagtgattcagcgtttttcttttccctgatttccaggtacggagatatgaggagacagattggctttgaaatcagagacatgtggtacaaccttggtgagtagcctggatgtgggggcatagtgaatatcttgcatccctggtgggtcatggcactggccgtgttcatcagtgttgggatgtcttaagatcttaatggcttctgttccttggacagcagttgctactctttgtagtaactgttttcaggaattaagagatagaagaccaaaggcaaggaaagaaaatctcacgggtggggcaaaaagaaaaatccacagagcaccctcttgtgttgtgtggacacgtggcttggagctcctccctccctggtgttgcctccctccctcagttgcctcagttccttctgcgtcaaataggaagctcatcctgctgtgacatttgccatcacttaccatattcagttttacagactctgccttctaaagggttaattcccctcctcaaaaccagatctacctggtggcagcctaacatgctcctgcactcaaagcagtgaagggtctgtgtgtgtatatgaaattaataggagtttatttgtaaattaagtaattttttccaactacttttatcatgaacagtaagaataaattctctattaaaattttaaccaatgtgacatgtaattcttatagataagccccttcaagaaatcaatgactgacaataacttggtatcttcccagcatctttacactaccctctaggaatctggcctcactcctcgttgagatgaagctctctctggctcctgccgtcagccctcgggcttgctttgtgccgaggtgtcctaggccatggggtgctggtggccttgcctcagtcctgagcaaagcatcagttgcttttctgccccaggatctccaggcctctgcttccttccttcaaatggacacgagaagcctgcattggcctgttgcaagaaaccctccactctcccctctacctcagagaatcttttcctactagaaggaggcaggggtctgtccgcatcactctgttagcctcgtagcattagggtttcacttgttgcaccagggttgggacaacttagctgcaccccagcctgcttacttcccaagcagctgtgactccctgcagtggctggagagcatggcaagaaagaagcagaacccagcgagccacgcttcacttctagctcactgtttgcttttgcatcttccttgccattctttggtttgacatgaggcccagttaggttctcaggaatggaaagccacagcagatgctcctgggtggggatgaagagcgggtcagagtggccctgtctgcctgtgccctcccagtacaaagagaacctgcaccattgcatcctttctgcgtgtcagtcctggagtcagtggaggactcctcgaggaagctctgtgctaggtctctgcacatgattttgctgcagtagctcctatgtccagaatctgagtactgggtctcagctgtcaaagggcctgctgatctctgcaacatgatacctaccaggcaccatcctgtccttggccttcctgccatcccagggaggaaggtaggggctctaggctcagagtcaagagagatgataagtcccaccttgaagttttcatcctctcccactcctgcctccccgtgaggcctgattcacatggctcagtctttctgggccgttagataaagtggttggactgaatttttcaagagccttccaattccaaaactcaataattctatgacatatatatacgatgatctcagtaataacgtgctaaggcttttagaacagggaggaggaccatccgtgattcattccaattgatctctctgtgttctttgttaaaatcctgctctgacagatgcatctgtcatttgctctgttaggccagacggcaggccccacaccaggcagggacccagtgtggtcccatgagagagagagagaggcaggagacgggggagggctttcacagcaatggcatggaggggggctgttctctgttggaactcagtgagtccaggacttttataggcaccaacgttcatgaaggaggtgatatgagctccacctgccacagttgggctctcagggcagaccccagacctcttctctggacacaggctctctctgaggccatcttttaccctggcccctcctaaaagagtgagtccattttcttctgtgttgttccatttcaactctaaagtatagacagggaattgcctatttcccccaagaggacacttgcacatatactttcaaatgaaggttctcattctggaatggctcggtaacatttcacatcatttatgataattagagacaccaccctagcggagggtctgatgggtcattacatactgaaatgcttccttctccccgtacacaactgcagccaccatttgactcaccctggcccctgagcacccccaggatcctccactgctctccatgtgccaaggtcattgcctagcaccaagggagcctctaaaactcagctcgagccacagctggccagaggtcaccctgactgatgggtgctcctgcctttctagttttctgatttgggattgtttttgtttttgtttgcaagtatagttaatgtcacctctgtagtccctgagattgatcaccactgaaagtggctccatttcaatttgtgctacgtgccatgataacaatgaaggaaggaaaggcgggcccagaaagggtgagtttctccgcgtgccctctccaagtgcttgggcaggcctggccttctgaggatacacttgggtctgacacagagcacttggttctcttgacgttatctgtcatgctccagataggccaagtcaagcgacaggagacttttgatttggaaaaggttgcagtgaagtgagcaagctccccccttccctcctatcagtggctgatttgaatatggtgattaatgcatgaggtgtgtgttttgcagctttttagccaggaacactgactgtggcctgagaagcggccaagaggtcaaaagtaaaccaaagccaattagggtcagggacttggaaacaacaagaagtaacagtcagccaccagacttgggttccttgctggtaaaataagttatctttcaaagtgagggaggtgatcttaaaagcacctgcagcccacaggatcctccccaagcagcccctcaggatggctaaggatagcaccacggggtggcctccttcctgccatggtgccaggtgcctgagtgtctttgccaaggctgtcacactccaaatttatgacagcacatctcagtttcccaggatgtatacaacctactttctacatagtttttttttttttattttaattttactttttgtaaatgggtgcaggtttgggaacatattggcaggatgatagcaccgactctgccaagaaaatagaaatggaaatcagatctatttatctgcttacaattaataaactgtcacttgagcagaccttcagctgaatgctccatgagtctcctccttcagtctttccaatagtatgcatggcccatagagaggagcatctcagctcttgcctcctccttgcccagcctcagagcaaggatctggggtctgttttgctcaatttaatgcaagggcaaacatggcactgccccatgggacagagtgatgtgtttctttccctcccaaacctgtcatattttgagtctgaaaggggaaatcaaaagcaggctctctctcaaaagaaaaaaggggggaaaatgtgcttatttacccagctcctgagttatttatcaaagcgcactctgtgcagcagcctgccggagcacctgatctccttgcctgtgccgcctcaatttacattttgtttattacatccagcacactggagcgagcactagaccccagccagccagaacgaatgtgcttggagcaagatctttatccaccgcgttgggtttgggatatttttcatgcagggattcccttcatgggtgttttttggcgactgggcaaattgtgtgcttttcattaaaacccgtatacattgtggcctaatgggtgtggccaggtggtggaagcttttgctctgcctgctcttgtgtatacagagatttttctgggataagtctatgtttaatgtcccagatttttgaacaccagtgattgcaaagagataatttaaacacccacagggaggcttctgactagggaggccttggcttcgtgagaaaacaagatgttgttcccaggggaaagagctccacgttctgtaactaaaatagactctagatgggctatgagaccggcaaggactggaagtaaaatattctcctcgtcaccttcctttggctcaaaagtgtgtcctctttttctttaagtctacactgcaggagtcaccttggtcctcattggttccaaacctgagttcatcattaaatttgagcaagatatgctccaggggaaatctataatgcaaatgtcaaaaaaaaaaaaggtggctaccagagaacattccccacccactcctgctcaccttggggaccactggtttacgaagagtcagtgcccagggctgtcactatccatagaacccagtaccagctccaggccagtgtgtcttctgtactaataaggagggtgataataaaaggttaagctactgtcgttttggtagcttctttttccaatccctgcttctacaaccacttgtgactgctttctatgtttttcccagcttggaacaataaaacctgttggtgacagacagaactttatgacgctgaaattgtggttgatgaacaactcgctgtcaccatcatctgttttctgaaacattggctctgacattttttaggcataatacaaggaaagtgtcacctgagagatggaatataatagcattttcaagagaatgctttgcagcagttacaggcctttcagaaacattaagcatttgggaaagtggtgagaatcacacaatgatagccttagtcaaaatattaattatttagtaaaagttgaaaataagatgttaattacattttgtgtgtatgtccacccaataaaaagtaattcagtctaattatgaggattacgtattctcttaagtatcgttatagtagccacatttctttaatgattctctttacagaaatgtatattcactgagttgcaaagaaaactaaagaatttggtttcctgattgtgtagaaatattaataagattggttaattcgggatacattgctggtgttaaaatactgcacatattttattcaaacatttaatttctcaggcattcttctgttatatgttggaaatgaaatggttttagttgcagtggggtgaaatgaaaacaaaatcaagatttctgaaagacaagagggtcagcttttaaaagatcacctttttgataggacctgcctctgagtttcattatgtcaccttaactaaggttcgcagccccatttttagaaaggagtcttccaggagcttcattccagaggtgcagtgtccaggcagtgaaagaagcttggcagttgctgtggtttcctccctctcccatctctctgaacttgcctggttcacttcaagctctttaggagctcaccctgatcctcaggagtaccgcagccacgcacccacaggatatggggtccccggctggggtgagcacaatggcggccaacccacaactagcaggagggggaggggctggccaccacatcaggcccagctgccagctgctctgcccagtcgccagatttcctgatggtgatcctgcgctagcatctttctaagtcagcgacagagacccaggaaggtatgataccaagatttccaacaaaaaccattgaaattaaaaacataaattgagtgcttgtgagaagccagtctctaccttctgggggcttatttagcattgtgatgtctcaacagtgagggataaaacgatggaaaatgacagatcactgacctctctgttcattttgcaattaggggggacaaataagggagtggacagctcaaacgatttctctttcagagagtcgggtagggtccgagtgccatgcaaagatcctgagacaagcaaacagggaaggaatttgtaaaatgagggtcacagctaagccttcataatctcagacccaggttcaaatcctgcttctccacttctctgaacagctcacagaacagctttgggtacagcccactttcctcgtctgtttaacaggttaagaaggtaaccatctcgtaaggttaccgtgaaaattcagtgagatgatgctttatcttgagcttgtcatgtaaattgtaaatgctaactaatatgatcatattcagtattattcacatttgaaaaacttttgagaaacatttttctgagttctttaaaaatcatatctggaacaagataggtgaaatgagattaataaagtagttctttttttttttttttttttttttttgagacagagtcttgctctgtcgcccaggctggagtgcactggcgtgatcttggctcactgcgacctcttcctcccaggttcacgccattctcctgcctcagcctcccaggtagctgggactacaggcgcccgctaccacgcccagctgatttttttgtatttttagtagagacggtgtctcaccgtgttagccaggatggtctcgatctcctgacctcgtgatctgcccgccttggcctcccaaagtgctgggattacaggcgtgagccaccacacccggcctaaagtagttatttaaataagcattttcctatcaaacaatagctcaaaaaggtagaatcactgctgtttttagggtttcagcctcagattccggcgccttgatttactttgattggagtcgtttggcatgttgcagaaatcaccctgcattatttacagaggtgtcagatggcaaactcatcttcataagatgtgggaaataaagaggacccaagagactatctgctctctctcatttgtcggctcctgttcctgtcgctgtgcacagagttagaggctgagacccccgactcgcagcccctgctctattcagaattgggaattagctgcatgtgttctgaatctgtgtgatggaactggctacttataaaacagtgttcatcttctctgacagagaagtcatgattacaggcttataccgcgcggatctttgaagagcttcacttataacatgtggaatacaggccacttcttatactaatggctgggaaagttcaaaatcatcatctgcagacgcgaaatggatgcacattttcgggatcctgctgctcaaagtcacagtgatctgtgttgtgttgttttatccatttaagcccattttagaattctatttttctttatttctgaatattgtacctcttttttccaaggtcaacacaagataaagttcattccagaaatggtgggcccaatattagaaatgacattaattcccgagacggagctgcgcaaagccaccatccccatcttctttgatatgatgcagtgtgaattccattcgacccgaagcttccaaatggtaaggacgtagatgtgcagcgagtggccgggggacatgagggaggcaaacctgaaaaccttcaaagaaacctgtagacagttctagagttaaaggtgccaacgtggaaaacacattttcctacagcttgagagagaaaaagcctatgattttccttattgaagaagcttatcatcccttgcactcaatttttgggaggattattctcaatttttagctcttacttacttcttttaatctgggtttacttacacattgcaccctggataaaagtctcttgctcccacttcttggtacgtgctcttgtagagcgtttaatcaaatgttatgtgttacattctctcagaccggctgcttattgcagaattgtggtattttgaaagctaaagtctttgcttttattctcttaagtgtgtgtcttgttcttttgcctgtgcaatggaactgatgaaaattctctaagaaagtgtatataaagtgctcaaaacatactgtgacaaacagcatgagggacaaactctgctgcataacttatgctcaagaagtaacaaaatctccttctggatcccaagaaaataagtatactgtttatgtattcttgggttggcacccacacccacacatacacatgcacgtccccacacacacacatacacatacacatccccccacacacacatacacatgtacatctccacacacacacatacacatccccacacacacatacacatgcacgtccccccacacacatacacatgcacatccccacacacacacacacacacgcgcatccccacacacacacacatacacatacacatcccccacacacacacgcacatcccgacacacacgtacacatgcacatccccacacacacatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacatacacatccccacacacacacacatgtacatctccacacacacatatacacatgcacatccccccacacacatacacatgtgcatccccacatacacatacacatacacatccccccccacacacacacgcacatccccacacacacacatacacatgcacctccccccacacacacacacgtacatccccacatatacacatatgtgcacacatacacacacatgcacatgctatgactttctccttagtgtactaatggtttggccatgatgctttgcaggagacctgggagaagcccaagtactagggagtcctctgaattgaaagataccttttaaaaatcattatactggaccggatgtggttgcccacgcctgtaatcctagcactttgagaggccaaggcaggcagatcacttgagctcaggagttcgagaccagcctgggaaacatggtgagactccgtctctacaaaaaatacaaaaattagtgaggcatggtggtgcacacctgtggtcagggaagtcaaggctgcagtgagctgtgatcacgccactgcactcccgcctaggtgacagagccagaccctgtctctaaataaataaataaataaatattaaaaattattatagcaattcaagtaagtcaacatactaagcattttacatagattttagaggaatttggagaaaaattcctataatgaaaggaaatcaaaacttcatcaatcaagatagcttaatgttggtgagatctaatattaaagggtatattatccttacccacctctacagtttatcatttaagggagctttgagtagtttatagattttcattggtcatcttcatcatatcacatgaaggcggtatccacgaagaatgattttgctgtttcctagaacagaaaagagagatacgaaaccaaaacagtctccacactgtgagttgagtttagatactgagggcagggagactgagattcacaggcttagccaggtattatctgggtcctcagcaaatcactcaacatcttttaagtctccaattcaagcttgtaacattggcatgaaatagaatctaccagaaaggcgtgttgtgagaatgaaataaaatcagacctgtacaatccctagcacggtgcctggcactataaaaggtggctgtggatgcttctcttctctcaaggccggaacctcccttggtctgggtgtttgtggagtgcagggggcagcctgcagggtgagcccccagtgtctgcaggaccatggggcccaacgctgcatacaaacctgggcatggccatttcgtcagggttgttccggaagccggggaggagcacacaggagatgaacagagtctgactgctggagccgtttcctttaacctctacacacccacagctgtgcttgaaaacccattgcagaggagcctaacacctggctcggagatcattatttgttttttgcactttgctccactaggcagttttttaattttttttttatttttttgagacggagtctcgctctgttgccaggcaggaatgcagtgacgcgatctcagctcactacagcctccacatcccgggttcaagtgattctcctgcctcagcctctgagtagctgggattacaggtgcgtgccaccacgcctggctaatttttgtatttttagtagagacggtgtttcaccacgttggccaggatgatcttgatctcttgacctcatgatccactcgcctcagcctcccaaagtgctgtgattacaggcgtgagccaccgtgcccagccctaggcagttttttataaggtgactggtgactgttattttcacattattccaaccgtggacagtagagagggctttagtttaacttccccagtgtaatgtcagttggactggaatgagtggtgttagtacctcctcccttcttccttcctccctccctccctttcttccttctttcctcccttccttctttcctcccgttctctctctttttttccatgatagcagaaggtctccctgtatttatttttaataatattaaagataattcatttttgaaagaacagctgtttttgtttctctggctcactgtcagtctgtgtatatacaaagtctttgtataaagactgtactaatacaacattgtaaatattatacctagattttttttattaatgttctttctgtttgataatatatcaaggagctttcccttaattacaacatagcaaccatgatattaatgatggcataaaattaactatcactttcttatccatcgcctataaatgggcatgtaagttgtttgcagattttcactgctgtgaataactgtgcagtgaacacattcatgcatatagcttgaatttattttgaaaattttcccagtatacattcttataaatgtaattacggatttcaaatatttttgtaacttttgaaattattgccaaatggtttgatgttaatacgataagatttgccccatctccattgctgctggcactatatcatggccccagtttcactgccaactcattggaactacaaattataatttaaatgctttttcctaggcagaaaattcatttgactttttgaattttatataaatctagcccaaagaaggactttgtgaaaaattgctattaaagaatcaggttaagggggaaagtgtatttatatagataaatgtcactggcacagaaaactaaggtcaaaagtgtttaaaacatcattctatttgtcattttttaatcagtctttgggtcaaaataaggtcaagggcagttagaataaagaagaatgagagtttggtttctgaattgttccccttttccctcacattcttttgtctcatggctgccttgtggtagtttaaaaaatcttacaacaatcttctgaggaagtgcttcattttctccagtttgcaggggccccaggtttgctaggaaatggtccgaagttaacgagagccacagaatttgtgccaccattttaaacaccgccttcccattggggcttcaacattgacccagcgtcaggagacatctttccagaaaaccaaattgtttttgagtaatatcatgaagtaattggcacatttagttccatctcataaacaacaaactatttcactagcatgaaacatgccgtgcttggatgtatgtaaatccaagcataagcctgaagacacagattcacccacaagaaggacccactgtcaggctgagcgtggtcagctacctgaactgttggttcagagtcacctgtttctctgtgttgtcatctgcttgaacctctgcagacgagggatagcgtacattaaagatctttaaaatgagggcagaaaaactaacccttgttttaaaaaaatccctcttgtatgttaatctgcttctgtaattgggaaaagatcagttttcttctgtttgatgtgcccacctcagcttcccagctggaatctcccaagcctgcagcatcatccccttttctgccagtctccttgtcactgggttttccggctgcgggtcatgctggactggcctttgcttgctcccctggcctccgtggcagtcggttgtgaagcttcatcagtcctccctctgtctcatctgcagcctccgtcctctgcgcaatcaccattgcactagtccaggattattcctgggccacagtatttgtctcttgacttgctctatctatgttttctaagtcctttctgactccagttccacctgtccctctcagctggtcttcctaaagcacaagggatggcccctattgtcggtgatgtgggcgaatgtgtagagtggacatgtgtgtggcacattggtgcagggttggccccacctgcttctccatccacgagcttctgggatggggatggtcggctgctgcctaactcctctgccataagcccagttacctcaccttattagtcacgtcagcaggggcttaagttttttttatagcttttatagcagatgtgcaaaccctactggagtagggggaagatattagggggatttgtttttacaacactttagtgttttgaacccgtgatagagcttatgttttaaaggttgctgtgtcttttggagtagagctgtcaatatgctactgtttatggaatatgaaataatatatatgtccaggtgtattttactcttacaattggagtagagaggagacctgctggattcagaagaaaaacctgctattttactcaggattaaactgcaccaaaccattactggaattttaaaagcatgtgttacaaattggcttttctaacgttgcccggagtttctgctcttgtgctcgtgctcttcagccgcagtggcgggcatttcattagaacgttctttcccttacacctccccaagagcctactcctttcctgtctccacttgtgcaagaaagagcacaaatgttccttcggaataggctcagccttgcccttatcctgcttctccagggtccatgtgttgaatgggctctcttggtggcgggatggggtggcatggagttatcctttcatgggccatgtcctccttgtggcctgggactctctgtccagcgctgcagtgagtgccttaggtcagcttgacagcactcgctctggggaggtggcgatgaagctccacaaaaggctccaggctgaaggtccctgatgctagtggaagcctgctgtgaagtgtcgtgttctgcaggagctgggccagacagaagcctgtgagatgggaggccccagatgtgcacagcggccttgaattctttttagaagtccctcctaccttcaaagtcatatgcttcactgtgggctgggtccatagccatagagctccggtccgttgacaggaaggcgttcccagcgactggacgctgcatgacgctcttgcaatctcacacctctctgccatcccatccctgtttgtgtacggccaggaggctgctgcctgtggggtttcttttcctcctagtgcttgcagtgtggatactccaagccaggggaggtggggatacatgtgggaagccccagtggatgcccactgcagccatgcccctggggtggcccccagccctgtggccactgtcagccaccccctccatcactgggcactcttgtgccacttccctgccctgtccatactcaaggccactgtggacatctggggcctcctatctcataggcatctgtctggccaagctcctgccagaacatggcccttcacaggggaagttccattagcatcagagaccttccgtctggaggccttggcagagcttcatcaccacctccccagagccagctctgtcaagctgacctaaggcactcactgcagctcctcaacaaaaacccatttcttatttcttctgcctcttttgtctctgggtgctccagctgtctgtggtcatcctggctcttccagcactttctatgaatcttttatgatccggatgccccagccattctcctaaatcatcctcccctgctgcttcttcctgtcctggtgcctaagggcacattctctgccccctttccttacagctggccaactcctcgagacaccaccacagctgcgttcatcccaccccctcgccctgtgcccaccccaatccagagagtagcatgcttacccctaaactcaggactctaggaatctccatttgtttgaaaggagaggtcctacttgggaagatttcaggactgataagctggcaggggaaatgtggagaggcattggggtcttcgcgccccttatcccatccacctggatgagcctgcccttggtcacaggagatgagccctctcctggccttaagctgactctccctgcctcaccaagaaccctgccctcccgtggaccgcactccaagtctcaccctcatactggattttgcttcataataaaaagcatacttttaaattccctcctggcatctttttaaagaattccatttgttacgcctttggaaaatacagaactaacagctgagaattgcagcaaatgaccatatgggccatagaccattaataaaaatggaatggaaaaagctgcccagcaaaaataatattttcaatcatggagctattttctgtcatctttgtgaggctcagtaaaatgctgcacaacttccagaaattcccatttagttgtaacagtattagaacatgaataatctttgtgtcatcagtgttgccgagctcctgtttgaataatctcttcacactgcccatgccagtaaccggaagccagtaattgaatagccgggtgaatgtcagcggctctgccacttggtggaaaggccaatgtattttccactgtaatatgaatgtgaatgagtttggtagcaattctatcttgtgtattctttaattcattaggattttatttgttggtttgtttatttttgctttcaatgtcaaaataattcttgcctaaagaggaaatatggcacaagaggcttctgtttcattgaatccagacccaaagatggtctgagaggccatggaaaccaagatccttgactccaggagctgcgattatattgaatttcattcttaaaagccctccagcaaagagattcttccataatcccctttaaccagattaaacaggactaattttgaggccatgttcccagagtcctctggaattgcatgcagccctaaagtcactctttaatctgtgtcatgtagacataaggagccgctgcacctgtctcaggcatcagcaaggtgtcatggcctgcgatgcagccatgcatccccagccaggcagctccaagtgagtggctctgggtcctccaggctcatgagtgtttcacaggagctccaaggtcagcaagccccttgcttgacggacgtaggaggatgtggaggtttttgaatgtgggatgaagtgccaccgattaattagtgtgtaattaagtttccagagcagttaggcaagaggaatgctctatacataaagatatgaatgtgtctgagcacaggtactcaaggctgagtgatggatcgggagggaccagtcacttgtaggatgtcagcatgggcgcctagagccccaagggttgtgcggtgtcacacttctctctgctgaaccttgcctgtttcatcttcttaaccatgttttccacccagatacagtccagcaactttctcccacccacctccccctgcacatgctcagggggtaaggtgtggttgcgcagtttcatcagattggccccgacccagggagagaaggcagagagagtctgattccttggtgccctctgcctgcagtatcttctgagcatttcttctttaaatacaggagaaactagagcactctgggcaaagagcagcattgtactaaggtttatttttaaagggtcaaataagcccttctgctaatgtacttagcagatcatgtccatagatttcagatctcacccggctcttgataacctcggagccctccatcaaggcggtgagtggtctgtgcaaacctttccaccctggcccagcctcctgctgcgctcccacagaaccctagagctcttctggtatataaagcatggtcctggatgtctggcaagtgcaggctgattttatacattacagatgtataaaattatagatgcattagagtaagaatagtaaatctcacccaaaacaaaaattatgcgttccaaaccaaatataattggcttttggattagctactactgggatccttctctccatgatctttcaaataggtgccaatagcctatggttagctgtggcagtgagtggtaaaagcagtgtttcctttttaagttaattgaattaacaagacgtcaatatcgcttcgagcacagccccctgactccgtcacgtcaatttaacagcaactttccgaaaggccttctattcataagtgttctcttgtttcatgttctcagagggctgctggtatcagacactgagagactctctgttcagtattttcagttggacaccctgtgaatatttttggagcaatattagtgattcagaaaagagaagaaaatataatggttttgcttattacgtgagtgagcctctgccaccttttgagcaacacagtaaacccttgctaattttatcccagccatagagaaccttgttgcaaatcaccagacaatgtgcatttatgaggaagataataagcatgattttgataaaaccagctctgctctatcagcaaatgtactatctccaatttagtgggacaggatcatttaattctgattatagtaacagttcatagcacactagcgaatcaattcgagtgtattctataaaaatgaacgaggatcctggaattagaggctagctgtggatctctggtactgaatccttgctaataaacagatcagggtggccaggtgtttgtgtaaattacttagtttggactagggttagtaaaattagaatcagctgtgttgtgatttacttaccactcatccacctttgttggaaatcattaagttcatcagtcagaatttgatcagcagcatacctaggtagctgtagcttcctcattgcctgtgtttgtgacagctagatttacatggaagcagagaaaacatgccgttttcataacctacactctgtgttcagatccctttggcttgaccattgatgggcattttaaatgcctgtatgtttgcccatgtcaggagaaggcacatttctctgcattctctgtacctttcttgttgtctgtactcattaaacatacatgaaattgaatcatgttttgattaaatttaatttaattttgtgtctctattatttgtcctgaagcatcagccctcatcaaacatttaatctttgaagtctgtctggatcatggcaccatctgggagatggcactgccttgaaatgccaacttttgggctactaccaagcgatctcccttgtatgtgattccaaaaagaactaccttttgcagaattcttttctgtaaagggcaggatagcagtggttagtatcaaaaggttgttattttacagtaaaaatcgttaatgtgagatttcaggagaaaaaaaatctaaagcaattcattcctccttcttcaatagaaccatctgtctgtgctgctaaaatccttgaacttcttaggccagacagaatcaaaaagaagtgtttatttgggggaggagaccatggagaagatcaagaagaaaattggagagattcactaaggtccgggttctggggatgttgctgagtccttgatgtcaggcaagaatcagtacttctctccagccctgaaagcctttgtttcatctgtagctgtggctttgggcagtgtgtactgatcgaggacaggcagggcgtctgtgtccatttggaggcccctccttgggtttcaccgttccttgctaattgcttctcaggggtccacagtcagctgctcctgcaggggcatccccaagtctctggtgcccacagtgtctgtcacaggcactctggatgagcagttttcacgactgggcttggcctggccaagaatgcaggttgtgatttatcaaccctctagaccgctcctttgctgacatattaagccctctccagctttatccagtctaagcactttaatccaatctaagttggtctaagaccaactgtattcagtagtttatgtgcacacagcacattcattccattagagcatcaaaggcactgtttgaggttttggggctggctagagcaatgaccaaagaaaaattcttcctctcactcagcttaaattccactgggatcctaataacagcaggcggcttgagaattgttgcctgagaaagtaggtgattgaacatggctttagagagatcctggagacccttgcatacatgcccatggcgtacttgctttctgaaccctggattcagctttcttcaattcttcctttgtccatcttccttcagtttagagtgtgcatgtctcatctttatgggaatgaacaatctcacagcccctccttgctactggcacaagttgatggtaacctcagggccccctgcagcatggctagtcaccaggccggagtcccagtactcagatggctatgaactctgccagagatggggaactgggcagtgaggatggggaaaacatgtccattgttatcgaggtttttttcagcctgatcagacacttgaagacattttagagatttccaccccccagaatttagagtttttctaaaagcatggatctgagacataattagctggtactggcgacccttctgcaccctgattcccaggaaatttaatcagaagctttggggatggaggataggctggagatggaccttcttgaggtgcctgctggtctgtctttagggacattgctcctcttgctctttagaacattttttcagccagagtgaggtatttcactaggatctatcaaggaatggcagctaagtggcccctaggatgttttcagattgccgagaactcttcactggcaggggaaacaccatctgttcatttcaggaaccaacaagctattttagatgttacgtgtttgtagagatgaagtttgagactttttttcatgctgcgctttgatttttttttccccctatggtttccttgtctttcttcccctggttcttgctcctgctatcaggacgtgcaggttcaggctccattaaccagaaaaggaaatgagaggtccccctatggcaagggatcatcagaaacctccaggggttctgtgttggcaactcttaaatgaggcttcaaaggcagagggtagccatctatgatgatctctcttgccgatttatgttctattgacactcaagtcataaaatgaaatactcgccatgctgattatttacgcttcctctgtttaattatagtttgaaaatgagatcatcaccaagctggatcatgaagtcgaaggaggcagaggagacgaacagtacaaagtgttatttgataaaatgtaagtgttgattagcagtgggatttatgtctgagagatacagagacagagagaccgtaattagactacaatgaactttgtaacccagaaataattaaaatgtgttaataatggaaaatagttaaaattgcacctctgttgagtttctttttctgagtgtgattaacaaggtgtgtataattatttttcagccttctggaacactgcaggaagcacaaatacctcgccaaaacaggagaaacttttgtaaaactcgttgtgcgcttaatggaaaggcttttggattatagaaccatcatgcacgacgagaacaaagaaaaccgcatgagctgcaccgtcaatgtgctggtgagtgaaagcttaatcacgttttttcagttttcacagcacaccagaaactgaagcggggattgccccagcccttatctatgacagtcagccacgaagctttccaccgcagaacaatctccttcgcttgtttcctcatctgctgcagggaaggaatcatgaagtcgtccactctgaataagtctgtaaaattgtcccatctctggacgttttaatgtcgctctccttgtcgttgtgaatgatgactcaccgtatcttgcagccagggtagtgcctcatggattacggccttaaggctttgtgattaggagaccataaacgcgtgctatgtagtacataggctgaatggtggcctcaaaggtagagcaataccccagtccttagaacctgtgaatgagaccttatttggaaacaagaggccctgcaaatataattaaaaagaatctcagatgggattatcctggattacctgcaaggggaggggagaggtactaactccaatgacaggtgtcctcataagagacaaaagagaagacacagaaacaggctagaccttgtgaagatggaggcagagattggagggacccagtctcaagccaaggaatgcctggagccaccagaagcctgcggaggccaggaaggatccccccctagagctttctaggggaacgttgtcctactcacaccttgatttcagattctggcctctggaactgtgagaagaaacatatctgttgttttaggtttatggtaatttgttacagcagccacaggaaaccagatctgggcaccatggagaacagacgcctgggcgaccttggctgctgccatctgtctgccttttgcattcctgctgttgccctgatacagctgggttctgtggacacccccttcctgatgtcattgtggtccctaatccaggaaatccattagtaccaatgagcttttgggaagctttaccacaagctcagatcccggccagcctcatggctctcagcagcgttgtgattcccacagcctggctccagagctctctgcttctccctttgctgcttctcttataaagaaacacaagggctgactcgtggccatagtagggctttcctcaagtttccttgcctgtcccatggcaagaatgcaagaaaacactactcctgctttgctctacttacctcccttctctgcccagccactggcctcaggatttcagagtcgccaacaacatgtggatacatagtcctcactgccacatccaccccttgtgtggacttgtgggtgctttatgctcatggaaatggactttcatgccaggaggaacatgacacatcattcactctttaaaaagccagagttgtgtggattaaaaagataaacgaaaaggaatgctttcacttttcatcgactatggtatcagtgctggatctgtgctttgccatgaggaacttcacagctgaaagctcatgagcagtcttcgccccttcattgcatggctggacagcttgtttaggctaatgataaacatttctgtaacaagttttcttttccttaaaaatctaaatataggggaccagtttttggtccagcatgtaaagagcttgcaaattgtcactcctgtcctcacaacaagaaaaaagctgaacaaattgaaaacaatcaacaattattagttccgtcttcttagatctgtagataaacttctgaccccaaagtcaaagaaacaggaggatacagagaaccacagagtggaagcccaaacagaaaccaccactggagccagtactagattccttttacccagtccatcatattcactttcaacgcattagtacaatgcacgctaaagacaaaaacacagtgaaggggcagagcaggcattagaaccagactctgatacggcagaggttttgaaatcatcagacctgcaatttaaaacagctgtgatgaatatcctaagggctctaatgggaaaagtagataaaacataaaagaaggtgggtaaactacgtagaaactcacagaaatcatcaagaagaaattctggaaatctaaaacactgtaacagtgtgaagaatgcctctgatggtctcatcaatcaactggacacagaatctgtggacttgaaaaatctgaatgtttgcagatgcatcatgtgtcttaggctactgtagaaattactggtctctgatgtctggccctgaggtctgggctgtggctgtgtttgtctttatattcacctggagactgaccaagtggtacagcagcaagctctgccccaggtcagttggtctgatcttacagacagaaaagaacctggcgcttacttcactgtcttcttgcattctgaccaacgttcaaagtaatttgttgtcatggtgccaatgtgattgacgtgaaataggaactattatttttctatgggaaagaaatggagaactttacaaaatccttccctactatggacataactttatagtgttccttctaatccttaaggggatctaagaggctgataagtgcccagaaggaagaattatcaataagtttattagtcttccaactttgatgattgagacttttatttgttttaagcaagatctcttatgctcaccaggacatgaaacagtggagaaatggtggtgtgctctgaatatgggctcttactacctgaatctagggtcaggaaacaaactcttgtaataaaacctacaatcacggtttctaatgtgaacctgtgttcctctttaattcagagccagactcagtgcccacgtacttttactgtggtcagcacttgctcagttttaactaagaaacacaccctgggttctcaaggttatctgacattattaactttcttcaaatgggaacgtcctgaatcatttgatgaaaaatcaaatgttctgctcttaaccatttcctggggatgataaaatggatcccaactgtcacagttttttcatttagaaaataaatctgtggaataaagggaaacaagaaaccagagttttaaagataggtagataggtgtcctaaccatagatactcactgcccagctcaatttcctggtcagtttttcccttttctcctggtacttttattacagaaacagagtgtaatagagatgggtatgtataaccatctctaaatgaatatagatgtatacatattggagatgtataaaatatactctgttagtcactaagaagaaatgaagcctaaagttaaaaaattaaattaataaaataaagaacatagaatttaccaatgctctgtaagtctgttgccaagtttcctttagaaccagcttcgtggtttcttacaaaacacagttagtggaacattgtaagttgtgtaggctccttcatgtcctattttcttgcccttaaaaaaacaaaaataggtccgggtgtggtggctcacgcctgttgcactttgggaggccaaggagggaggatcacttgaggtcaggagtttgataccagcctggccaacatggtaaaaccccatctctactaaaaatacaaaaattagctgggcatggtgttgggtgcctgtaatcccaggtactcgggaggctgaggcaacagaatagcttgaactcgggaggcggaggttgcagtgagcctagatcacaccactgcactccagcctgggcaacagaggtagactctgtctcaaaaaaaaaaaaaaaaaagaagaaagaaaatgaaaaagtaagagacgcagcagtcactctgcttggccacctaagtccccaggacatctcctgcaaggatgtctgcatgtatgttggaacttggatgtatatttgtaattctttaactagaatttcactgacagctcataatcgagcatctttaattattggtcactaatgttgctgagtgtcacttagtgcttctgtgcagtcatccacacgtcccatctctgtgactggtaggcgcatcattactttgcacatgccagttacttctcttcatagccccttggcaaggctaattaaatgcagagtggggtccagtatttttaaaatcttggtatctgttttagtccaaaatggaaatataatgcagatgtctgcgttctaaaagatcaatgcctagcggtggattggagttggggggccggtcccaatggggttcctctgggagctgagctgcaagcttggcacagatgtcagtcagcgctggtgtggggggacttgagagacaaggctgcccgcggagcccaggaggagtgggagcaccgcgtgaacctttacgtaagaaacacaaaggttttatatagaaattgggattggagatgagtgtacttcggttgtggagaggttttgaagtcctaggaagggaacaggactcagcacaggcagaaaatagaagacatttcgtatctccgagagaggaatgaaggtcgcatgatattcccgttgtgaaattgtaaagaaaaatgatcaaaaccttagaaaggattaaaaatatgagtacaaaaggggatggtgtgaaaccgtagcttgtaaatactggcaactttgagttggaaatgaagggcttatcctctgcctttgatgcagattctctttgttgcgacagtgagttgtcagctgaaaatatcctcattactgagccgtgtcatatgaactggaggacagtaaagtgtcagaggcaacagaacttgaaaatcttggtgcatttttctaaatgtgcccccgcttattttctagacttagttatcatttcttttcagagacatcaattgtagaagcaatgctgggttttgctcatgaaattaaagagcctatgccatttcttggataattgtatgtctctgtaatggtgatattcactagttacttcaggctccgattctagagggctaacatcatttttaggtgctaaatttcacattgaaagtgactctgatgtttccttaccttaggccttgtgaggtgacttctgtgcctctctggtggctcctgtgtgaaaaagattttaaagtgtttatggagatgttcaccttaagaaatataattttgatagaaatgttattgctcaaccagacgatattttccagtaaatatgtagaaataatccattggttttaatctactaattaagctttctccatcagtgtttatacacagggggctttttcagaggcagccctctttttttaactgtggtttggaaggtttgcctgtctggaacagtgctatctaccagaaagttctgggataatggaaatgtcttgtgtagactgtttgatacagtagactagccgcatgtggctgttaagcgctccaagtgtggcaagtgcagctggggaagtgaattatttattcaatgttagttaaatttactttaccttttaatatatgtggctactggctagtgtattgcataactcaggtctgtattatcatattgtctttgtagctcttgctgaggctgggcccagaaagctttaaatcatgttgatgatgcttatttgcttattcccaaatttgggatatttatttatgtattcatttattctgatgagattactatggctaagatatcatgtcttcatgtctttttgggcaataccttgttttaattgaagacaagtgactttcaagtgacagaagttgattttagtcatcacagtgttcagtgtagaaatgtaattgtgtttgactagcaaaaaaaaaagtgaagaactgtgtaagatggttttgcaatttatgtgaatttatggttctgatccaaagagctgggtccatttggctgtgtttgacacaagatgaagtatcttgaatttttattgtgcatgtgataccttttgtggaacagatttcttaaaacagtattatggtttaacttttcagaatttctacaaagaaattgaaagagaagaaatgtatataaggtatgtatgcatcacgcttgtctgcatgttaattataaataataatatatgttgtatgtttacgtatgctaagaaatgtgttatagccgcaaaggtttattttgtagaaaattgtgaaacgtataaggtagagtttggtggagctcccagatacattctcagctcttgcatagcttgtccacaccagtgcagagttcttggtggtcaccattagccaactcaaaagcaaaactacaaataattgtttcacagcgttttgtacctgttgaccaactcatgtggcccttttgcaaaaagataagcacataaattttaatgtttcacagtaagttatatgatccagtgagaaatccagttataactttaccagacataggggagttataatttttcagtctgctcttagttaactgacgccatagtcccgtgttttttatgtctttcttccatgaagaagagaaacattttgcattgcctgctggattttgcttccctactcgccttgctccctggagtgagggactgtgattgagcccttctctcttggttacttctaaagtctcgtgtcaaataattagcaagattaccactctggagactaggagaaggatgtaacctacacagcatgagtttttagtgatgtgtttattacactgagggtgattgtctaattttctatttctaagattgtttttacttctcctttttaagaacatactatgtgaatttaataactcagttacctttatttctttatggcaaagaaattctttcgatcacattgactgtaatcattggagctctttattctgatggatttgtatttttacggatttttttgtgcatttggactcagtagaaatgcagaaaatcacaatcaagtattgtgtgtctcattaaaaatgtttaagggaaaatgaaaaggaatgaaaaatttgaaggaaaattctacctttgtgtatcatctttatttttttcctgagtttttcttagtgctttctgtaccaaaagtttttaaggcattttgaattatgaacattgtaaaaaggaagtgtagccatgatttactgttgaacatagaatttagctcttgcaatcctcaacacaaattatttagtgacattttaagaacatacctctgttttattgtctcaggtatttgtacaagctctgtgacctgcacaaggagtgtgataactacaccgaagcggcttacaccttgcttctccatgcaaagcttcttaaggtaatgtcaattaccagtcaccttgatgattctattgttataaattctaacaatattcagaattgtatttttccatggcaaattttagtaggcctataacttaaggttttatgaaattgactaaataaatgcaaggatatgaacaaaaatatttaggaagtactttgattagagatttgtccctgctgaatgcagatttaattagatgtcatagcaggtgatcactgagcattataaactcccatcacttggctgtgagctgacagcaagttagagattctacaattccttgttcaggactacaggactccaggatggtggagaacaatatcaagaaggaattttcctggtagaacagctaagagataggatgagacatacccctaattgtcttagtaaagagttagggaccagatcatgacttttcactctatcagttcacgttgagacctcctgctagtgctctctgcctgattcttctaaggagtgttgctcctagcacaagtctggcatgacaactgtctactcttagtggttcttttattactcagatagcttcagacattgactttctttgtttacagtgacgtatggatggatggatggatggatggatggatggatggacaaattgctatacagcctctagttttatatttcacaacctcagtaagttattagatgatcttgctcatgacatccttataaaaatttgaaaaattatgaactggataaataagaacagttacaagaattagaatttagtttggtggcattccacaaagactgctcattcaaggagtcatgtttccaaatccaagccagcctcccaaaaaccaaaaatgtaatgaaagaaaaccagagaaaattacattaaatgggcattcagtagtgtcaattaggtaataggagttaaggaagacattgtgttatggagtaaaactctggtaagactctttccatctttggcccgatcctgaaatttctgatagtttctgtgacacaaatatacacaggctgccctagagacctgcgagtatggaaatttgcctctgcctggaaacagcagtgtctgttacaaataaaacacacaaagctcagctcagtctggagggacctcatcagttgtcctcctgaggctggctgtctgaggacccattttgccccgtgccacgtgggctctcccaaggagcataatttataaggatggaaatttcagttggtacatctgataccagctatcccactatgaattctgatggccttcatttattcaaaactcaaatttcagtagcaaggtgttttttgcaaatgtgaagctatttcttttaccccagggaaattaaaatggggttgacaaactgctcactcaacccttactccgtccctcatagaacgtaaacttttatatgcatgtgtgaatgtaaaacatatatatgtgcataaaggcatcatttgtttaatcattggatttattgagtacagatgggtttgtcacaaactgcatgatggtttgtttcacaactcaaatcgataggcccaattgcattgctgtttcccctgggcttctgaattttccagtttaatggggaatgctacataatctctctccatatcttttgccccgttacattttgcaattttttctaaatatgttttgatattactgtaaatgtgaattcatgctaatcacctcactaaagaacatgatttatgttgttgcgaaaattcttcagtatgacagatatattattgtttattaactgaaaatcctcaaatagaatcttcttttttggttaggcatatctttcgtcaaaaccaagagcaataaaaactttagtttttcgcctagcaatcaaattattacatctccatgtggaagtggaaggtagagaggatttttgcttccctagtccatgttttcatttgcaaaagtgatttaaaaatgcaaggaagtcatttggattctgaacttgcttgttcttaatttattttattgtggttacatttcagaatctagttttgcttttattctccatcctccaataaaagtagaccaattatgttgtacaaacttcaaagttaaagagtttgtccaattgtgatggagatatgcaagttcaattttaaggtgaaaaatcttgcagaccgcttaaaggcttctcactcttgcctgacctttctggaaaggcagagccatacagggcccgtgccctgtgcctgggagccctgatgtccagcgggaggtgctccccagcccgtggtttcaggaaagtggggcgggacctttgctaagacagtaagcagctgacagagccttgccccgttgcccggaccccagcttcccacttagtgcctttgcagcaccctccctggcctggctgaaaacagggtcaagctccctctcctagggccagcaataagcaagcccatgctcaccgtgtcctcccgtgagcctccaggctgcccagtgggagcacatgcctcctgcccgtaggtgcccatggagtctttttcacagtgttctttttcttgttctgtttttttttcttcttcttcctgtagaagggtcttgctctgttgtccaggctagagtgcagtagcccggtcctagctcacgcagtgttgttctgtgtcattattctctaatgtagaatcgcaccatcctgggggtcaggcatcttccgcctcctctttgacctagtttgtggcacacagcaggtcctcatcaaatagctgctgaattttattgaaccttatacttaatgccactgatgtgttgagcccaagttcaggagctgacacgttgtatctgttaagtggccttgccttccctctggcatgtctcctcgtgcatcttcagctcacacgccgactgcaccaatgcttccaggaatactggccaaaccctgactctgtgcccagcaccttgcctatggctgatggtgcaaagacacctccccatctttaaggagcttgacagcctttctagtccctttctgggtgacttgtgtgttccatgtaccatctttgctgttgattaaaatgccaacccacgcagcactgagaccagagccctggggtgccgctcttgggatggccctggatcacctggctcctgatttgtcccggaatgttaggaggtgtcatttgcaagctgccagttccgtgctttgcagaacctgctgggtttttcttttgtctgaaccccactgcagctatgcctcccctgtgtcttttatgcctgtcggtatgtccggacagaggctctgccctggcagtccccagcctgttgacagcagccacacatgtctccagaactgcggcccacacgcgtgtccgatgcgaagctcacaccattctgacgtccctgggtgtgtccgcctcgggtccgctcatgctatgcttctcccttagtggtcggaggatgtgtgtgtggcccacctcacccagcgggacgggtaccaggccaccacgcagggacagctgaaggagcagctctaccaggaaatcatccactacttcgacaaaggcaaggtaaaacacaaaaagcaattgtccttgttttcctctttccatgcacctacctgcagtgttgtaaacacgttttttagcgtgtgatttttgcagaaccagaaatttgttacaagttgtatattgaaatgttttatgcatgttccttcagcttgcacttaaaagtagaaatcttcttttaaaaaaaatcaatagcccttttatagatgctctaaaaaagcaccaagtatttttataacccttaccagagggaactaagtctggaacactgattcggaggtgtttccgtgcccacagagctaatgtattcctttgacatcctgcatttttctgttggcacggaagaattaatcccatggtaggatggatattgctccatcctggtggctcctagtttaattggcttaaacaaaattatagattccacttgacttccactaaaaggaaacctgctgtcattttaatcagccagtattatatctgatcactgtagttcttctgattaaggtatgcagtaactatttaaaaaaaaaagctgtttcagtttcagaagtttttaaaacctgccaccgaagtgacattggaactccttctttggtttcatcaagattcctaactcatttcagaacctgttttatttttctttttttcctttgagaaaactgactagcacactttatgaaggtaccgacgttcacatcctagggctgctgtagcacaaactgggtggctttcaacaacgggaatgtattctcatagcttagtgctgggagctgcaagcctgatgtcacagtgttggcgtggccgccccctctgaaggctgcaggggaaaatctgccccgtgccttttcctttgcgtgtgttgctggtggtctctggcactggtcatctgtaaccacatcgctccaagcccttcctccgtcatcacaggccttctcctcatgcgagtttctgtctcagtctccttctccttaggaggtaccagcggttagacgagggcccactctcctccagcaggtcctcatcttcccttgattacatccaaataccctgtttccaaataaggtcagattcagaaatatcaggggttaggactttaaatatttctggggacacagtcctacccacaattgtactgatgcccgggagtgatgatggctgcccctttttgtggctgttgacgtaaaccaaaccccattgaaaacaatgactcgacagagtccccgtggtcacgagcttgggattctgctcacatttggagtaagcgatgcggcatcctttatttgtccctgccattcttgacacagggagaaagtctgacgttttcagaatggcatgtgggctcccaaaggctggttggaaataaggattggaaatgttctgtgaattacacccagtcctgtagtttaggggtccccaaaccccaggtcctcagcctctggtacaggtcgtggcctgttaggaaccaggctgcacagcagcaggtgagcaacgggtgagcaagcaaagcttcatctgtgtttacagccgttccccatcgcccgcattaccacctgagctccacctcctgccagatcagcagcaccattagattctcacaggagaatgatacctattgtgaactgtgcgtgtgagggatctaggtgccatactcctcatgagaacctaatgcctgatgatctgtcactgtctcccatcttcccctgatgggatcatctagttgcaagaaaacaagttcaggctcccactgattctacatgatggtgagttgtataattatttcgttatgtattacaatgtaataataatagaaataaagtacacgatcaatgtaatgcccgtgaatcatcctgaaaccatcccccaccccggtccatggaaaaattttcctccctgaaaccagtccctggtgccaaaaaggttggggaccgctgctgtagtggaacaggatatatttttgttctctggaatgagaagctttgaggattagggccaattactataattgtactaggttagccaggagaatcctgtttctcagcaaactggtaaagaaatggagcaaatgcagccatcccttcccggcagtggcttcttggctccagggtgagcagtgctacagaatgggcagggcagggcagggcaggaggcagggaccctggggtggccgggaggcccgagggccagaggtcacgggactgaaggaatgtgcgcatttgttgatggctgttgccgggctctctttgtggcagcacatcctctgaccagcgttggctcccgcgacctctccaccctcattccctcccttgccctctgcattccagccacactggcccttctgcgtcctgaaatgcaccagccctctctgccactgcccagcgggtttctgctgcactgccttgaggacgttgcttgagtcagttttccttttgctgcctgtaccattttgtcacttgaattagctttttctaagccaggctttctcaatctgggcatgattggcattctgggctacctgttactttgtggtagaggaccacgcgtgcatggtggactcaaggaatgtctccctgcagtgccctgggcatactccttcctgtctcagcttaaatgtcacctgttctccagccacggaaacatcctcttttctcctttatggcacccactatcatttgcaatgatagatttgcttgtgtgtttctttaatgagttccccagtaggctctgagctctgtgaagatagaacctcacgcgtcaattccccaccatgcatctaatgctcggaacagtgcctggcacacagcacatgctcattacattatggacgtgtgtggaaagaatgaacaaatgaatgaaaagtcagcatttaacagtgcttcctgacagatgagaaatgctcatgtatggcaggacaggtggccttcaataaatgataaatcaaaaaacagagtctttttttttttttagcaaaggtagccaaatatcttttcctacattgtgatagttcatcaaaaaaatcatatggaggggcaaaacgaatgtgttcggttcagtacagtggttctcaactgagatctgcaggaggcattgtgggttctcctgactgggggaagagaaggtgctgttaaccctccagcagtgcacacatggcccccacaccacaaagaaatagcccagaatccctgtcgtgtccaggttgagaaagccctccttagaaaaaatgaattcaagtgatgaaatggaatgggcagctaaagcaaaacagactcaaggaatgtcctcagatgtccctgtgttttggtggagacagaacaaaggctatggcaaagtgatcattggctggccttgaatcagaatgagttttaggaggattttcttcgtagtagctgcattgataaaaccgatggaaaagccacttctgaatatccataatatttccacgagaatgttaaaaaggaacaaagcctccttatccctctaaaactaaagtaagatgaagaacaggtgctggaaagaatttgataaaatgaaatttgaagtatctgagtgatcagctgcaaggcaaaaaattcattttaacatcaacaagcattacattttctgggagaaagagcagtaggaaataattcatcttccgtaacaatctggatggcctgcactagagtttgaacctctccgaatctccatggctccaaacagcacaggtgtgtttctcacacatgctccgaatcctccttttggctcggaacccaggtgaacagaggttccgccacagaggaacacagccggagaggacagcaaagagtcccccgccctggggcttctgccccaaaatgacagtgttcatgtcattggctgaaggagatcacatgatcaccccagacttcaaggggtggagaagtgcacttaggggcaggtgagtgtgagcggcacccacgtgcaccacacagcttgttagacaggtgagtctaacaatcaagggcaccatccaatctagattaacaaaagttcatctagaaatcccctaagtatgcatgtattctgagaaagacgacgtccacactagtctcccaaataactcggcttccccacaactagagatgtgagaataacatctcataaaacttgttgggcctcaatcctcgtttctctgtcgtggagtttccttcttccgttaaagagggggcttaggtaggcagaaccctgcaggagaagcagcctgagagaatgggctcctgacccccgtgactgcgatgtggggaatcccaccaggtggccagtgcaggaggaagggggcacacagtagaagctcgaagtgtgatgttttgtgccggacttagaatcacttttgtttaagaaacaaggctgaggcctgagtatccccggctgctttggggatgtgccatcatttgagaaataacgtcctcctgcctttcctaaatgcagtggaatgacaaaggccacggctgaaggttgagaagcttgaagttgggagggcccagggcacacctttccacactccattcccagactgtaattatcttgggggaaaaatactttttaaatggtccacaggtcatcacaggccttagtgggcaggtgacacagcccaaggaaacttgaaggagggccttgattggtgtggagccctgatatggtttcgatctgggtccctgcccaaatctgaagtcgttgtaatctccaatgttggaggtggggcctggtgggaggtgattgggtcataagggtggatttcctccttggtgctgtgtcgtgagagtgagtgagttcttgtgagatctgggttgttcaaaagtgtgtgggaccggccgggcgtggtggctcatgcctgtaatcccagcacttcgggctgaggcggggcagatcacctgaggtcaggagtttgagaccagcctggccaatatgacaaaaccccgtttctactgaaaatacaaaaattagcccatcgtggtggcaggcacctgtaatcccagctacttgggaggctgaggcatgagaatcgcttgaacctgggaggcggagattgcagtgagccgagattgagccactgcactccagcctgggcgacaggaactctgtctcaaacaaaaaaaaaaaagaggggctgtgagacctccctgccttctgctctcggtcctgtgcctgctttgccttccgccgtgagtataagctccctgacgcctccccagaagtggctgctgccatgcttcctgtacagcctatggaactgtgagctgattaaacctcttttctttatacattactcagtctcagatatttctttaagccctctgagcagctgagcaccagagaaaccaactctcaattaattggtaggactctaaccctcactgttgtccagtactgagtcctgagccacatgcggccattgggcccacgtgaaccatctttctaagaccaagtacaaaaaaacaaatgttcttatgggctgagttgcatccccccaaaattcctatgttgaaatcctaaccttcagtatttcaaaatatggctatatttggagatagggtctttaaagaggtaattaaggtaaaatgaggtcattagggtgggccctaatcgaatctgactggtgtccttataagaagggggattaggatacagacacacacagggaagaccatattgaggatacagcaagaaggcagccatctacaagccaacgagagaggactcagaggaaaccagccctgcagacactttgatcgcagaatcctggcctccagaacagtgaggaagtgaatgaatgtgacttgacgcccccagcacctactcagtgcttcattatggcagccctggcaaactaataccaataccaggtgtctcattcatttgtttgtatagatttcatgttgaaatagtaatattttagatagagtcaatattactacaattaattttactctttaaaaggtagcagctaggaaatgcaacattcacggatgtggctcctattggacggtggttcctgttggacggtgctgctctgagtcaaagactttgctcttgttgagcgccaagaacatcgtcagaccagcactgccgcccacatgcggctgggaagcggaagctgcccactgtcctgtggggcctcacaggcagtagaattgcctgcctgcctgttggtatctactccttagactacaggaatatttaaacagcgaaaatatttctgaaagagttacaaaatggggactcaagtctggaaagaataaaatgtatgtcgaaatggcaaggaaaaaagcatgatcacaagcaccaagatatgatgtttttttcctgtgactcaatttcatttctgtagtggtgaaacagctgtcaagactacggcagttaccagcgggaacctggagggaagggtgacttgggagttctcacatggcccttaaggaaatacagatgaggcaaataggagagaggtagaaacaggcagctgccaagataaggtgtaagaaatcaagaaaaagcagcatcttcttgttggagcaagacagagttttccgatacctattttattattaaaatttagaattatgcgcctcggtgatgttgttttcatttgtgctttggataaatcccattataatctcatttttcatttcccgggcttagcaaggataagtcacgtttgctcctcaggatctgtctatgcacgtgccttagggaatagcgagccttccccgctgacagactggctctaagatctgcaccatcttgacccacttctacctgggccacttctgaacaactcgggcctctgggcagaagccctgctgctagatccagttcactttgtgtctccttgtaagctctcggtccctctcacctgggtctgtctgagatccctacccactctcctccccaaggccccatgcctgtctccacccttccgctcctgcagatagatagcagtctggtttctaataaagtggcctctggatcacagcgtgaactgcttcaaagatgcccaaacctcagggattctcccatctcctctgcaggcgatccaggcctctcacctggcatgaggccccttagagtaggaatcgagcctccagatgtaccctctcatcacccacagcatctggccttctgaacatgccctctgttccccaagcccttgcaccttcccatggtctgccccggcgtggaccggctgcttcttgctgctgtctcgtgtgacggctgccatgacagctgccttcctgccttctgggcatatttcactgctctcaaactttcgtggcttttggagttcaccggggaatcttgttaaaatccagattttgattcagctggtctggggtgggcctcgaggctctgcatttctgagaagctcccaggtgatgtcccagctgctccagggaccatccctgagtccccagggcctgtgctgacttaagctcctgagagcagaggcagtggctgtggctgccacctctggatctccctctgagggagctgtaccgtggcctgggctccactccatttttttaaatagctttttaagagtggttttaggctcacagcaacatggaacagtgagtacagccaggtcccagacaccccctgcccacacacatacacaggcacggggctttcagggtggtcatttgttagtgagttgagcacattctggccagcacttgagcaaacagcacacaatcaagaaggtggccgtcacccagactttccacaaagttccttatttggggcatattttgtttgttaacggatcttgcatcctgactcagactgagcccctgggagagcgaaaggccatgcctcccacctccccacccccagcgccgggtcgggggcagatcccaccccactctgccacgtgccgcatcacagttgggttttgtcagtgtgctcctttcccaaggctaacactaacttgactttagcacgacattcactgcaaaggttatggatcagacggagacaaattcttgcaagagcagggctggattttcctgtctagaatcttgtatgttaaaaataacaatcttccgtccaaatgactacagcagtttattaagtgaccgaacgggcagacaagcatgcagggagggccgtcagcatccacagaacttaccgacctgactgagagcgccacgtgcaccaggctcacgtcctgagcgtgtgcccacagcccttggagtgtttacaagaatttccttggttcgatcttacatgtatttcattttaggggaaacaacgcaattccagttttacaaatgtattggggtaaggagacttaagacctcagttaagcttggagaccagtgattaccggggcttgcaagatgataaaatggaagccaggtgggacgtcagtctggcaaaaccatgacccggctacagctccactgatccagcctgtctcctcgtggcccatttccatatgcaattaaggaaatcttcattacgtacttactctgtgggaaggatatacaccctagagctcattcactgtttgaaatgtctacagcttcctacgggaaataggggcttccagaatccaggacaagcttgcctctggacaaggctgagcaggctgttaagggagcaggggtccccatcccaggccccctgcgatggcatctctctgtgctccccgggagagcgggcgggggcagggagagacgggaatcgggtgatattaaagtttctctgcctttgtgcttggaaaccagcaaggcaaaatggatttgctgctgttttatattggacacgggcttttgaatgatgttctgttatctttctgtatttcttccccacggaatcattcttctgtttttgcctttccaccgttttttaaagttttgaatgtctttcagcctagctcttggtttcttaatctttttctttctctctgcaaaatgtcatttccatctgtttccattttcattcttttacgtttcttccttcccgagctaataatgactccttgctctttttccattccattcttgccgcccgcctgagtgtgccccaaaagccttctgtttggttttatcatggcagaccagtgttcttttctgaagatgctctgaattgtctgtcttattgtgtttggttgaggcctagtaattttcgataaagcccttaatccaagtacttgactgaaaattaccaggcttctctgtggaggatgagggtcaaaaatagaagtccttctatgaggaagatgcagtcagagtgagacagtcagtattagccaacaccagccacctctgaaatcaagaaacagcctggcaggttgacaaatgcgatacataatttgtagcccaagtgatatatgaagccctgtgactattttcagctggagctctgttgtattttcccttaaaataaccttcccttgacaaagttcacactttgccttgcaccaatgtaaaaaaaaaaaaaaaaaagcgttttacatcattgtgtaaactaaaaataggagtttggagcaaatttccatttttggtcaaatgtttgcatctcttttccaagtatttggggtgaaattttcacatcttctaagtttccctttggaaacacagttgttattaagagggactgcaggtcaacataatgaagccctcatatgggtttcttgttggcatttctagaatttttgaaaatgtgatattagcagaacctattcagccagaatttggcctgaatattcaaagagatcatatgttcattatgatttgctcctatgcagtaattgatcatcaaagcatgagaaagtccattttcgagtcagtaacaacaatgctcccttagcttatgtgggatcactaacaagcttttccacccaaagcccacagtgtgcccagtgccgtcctgcgccgtgaaataccgagatggagccaggcccacctcgaggcgattctagcatcagggctctcatatgagcagataaataacaaaacccaccttccgcccatcacacaggtgggcgctgggtctccctatcccacaggtgcaggagtgatgccttcttttggagagctagagaagacttcacagaggtggttacatttcgtgcttcttgaagagtaaaattaagtttgccagatgatggctgggaggaacaggaatttcagagtgtgagaatagcgccagaaggggaagagctcctgatgacatctcgcttttccggggaagtagagccattctgggagatagcagtgcaggggactgtcttcgtcccttcatgctcctataacaaaatgccacagactgggtggtttataaaccacagattcatttctcaccattctggacctgggaattcctagatcaaggcactcacagatttggtgtctggagagggccctctgcctgctccacataagtagtgccttctctgagtagtcatgtcctggcaggtgtggcggcgctcttccgggcctctgttttgaggccactcatcccattcatgagggctccaccgtcatgacctaatcaccttcgaaggcctcatctcctaatgccaacaccttgaaggtgaggatttcaacccgtgaatttgagggagacacaaatattcagagcatagcaaagacattggagctagtttgtcagtggccctgtattgtctcctgaagatttggcttacaaggacccaatggaaatttcgtgaaagtagaaaataatgatttcattttcctcttttcagggggtaattctggcaacatggtggcagcagacttagaggagggagggtgggagccagagacgagacgaggggtggggcattgggccaggcctgagccccataaagccagtggcagatggaagtgatgtcatgagacttcaagttagcagattccacagtgtcaaagacccttgaacagggttaaagccagaaaagcaagtgccaggggtggctggggcacccactggcctagaagccaagagttcttgccgggaggaagatgtaggaagggaatgcttcacttgctgcagagagcagatggaggtcctttcatcctttcagcattgagcaaggcagcgagggtgcacactgagcagtcctgtgcagggcatttaatggagggtgtcaaggaaagggagaaatgagcagggtcacagctgcagtgatgctgggtgcatagagagccctgggccagttcacagctgcagtgatgctgggtgtatagagagtcctgggctaggtcacagctgcagtgatgctggctgcattcaagaatcccgggccaggttacggctgcagtgatgctggctgcattcaagaatcctgggccagttcacagctgcagtgatgctgggtgcatagagagtcctgggccaggtcacagctgcagtgatgtttgttgactccccagcctgtgccctggatccccctatcccaggacatctcaccagcaagtctgcactctccctttgcagcacccatgtgttgttctctgtcagctcccaccctcccacctgcaaccatgccattattgctctcacctttaagaagagttctttcttgttccaactcccctgtccagccactgcccatttctcctcctctttctacaacactccgtaaaggatggtctgcacttgctgttcctctcctcctgttgtctctggagtccactccctcaccagtggccagtagctgcctgtggaaggcaggagtgagcagcacggtgtctctttctgtccagttaaagcaccgagcaagaggcaactgtatctcttgctgcctgctttagtcttttcaaggtctttctttgcaaaactacaaatgtcctggcctaaagaaaaaatgtcatatctctgttacaaaaaaaaaaaaaaaaaaatcttcatttttttatctagggcattacaagctcagtgagtagttttctgttttgactaataaggacttgccgtggaataaaggagacatgttgatgaacataagtgacccgggcagtgactcctatgtgatctgagcatgagttacacgggcagcgactcctatgtgatctgagcatgagttacacgggcagcgtctcctgtgatctgagcatcagttacacgggcagcgactcctatgtgatctgagcatgagttacacgggcggcgactcctatgtgatctgagcatgagttacacgggcagcgactcctatgtgatctgagcatcagttacacgggcggtgtctcctatgtgatctgagcatcagttacacgggcagcgactcctatgtgatctgagcatgagttacacgggcagcgtctcctgtgatctgagcatcagttacacgggcagcgactcctatgtgatctgagcatgagttacacgggcggcgactcctatgtgatctgagcatgagttacacgggcggcaactcctatgtgatctgagcatgagttacacgggcggtgtctcctatgtgatctgagcatgagttacacgggcagtgtctcctatgtgatctgagcatgagttacatgggcagcgactcctatgtgatctgagcatgagttacaagggcagtgtctcctatgtgatctgagcatgagttacacgggcagcaactcctatgtgatctgagcatgagttacacgggcggtgtctcctatgtgatctgagcatgagttacatgggcagtgtgtcctttgtgatctgagcatgagttacacgggcagcgtctcctatgtgatctgagcatgagttacacgggcagcgactcctatgtgatctcagcagcgtctcctgcatgacacaggtagtagctcctctatgacccgggcagcgactcctgtgtgacccgggcagcgactcctgtatgacacgggcagcgactcctgtatgacacgggcagtgactcctgtatgacacgggcagtgactcctgtatgacccgggcagcgactcctgtgtgacctgtgcatgtcctgggtagtgggtgctgcatgtcctgggcagtgactcctctatgacatgggtcatggctcctggatgacacaaatagtggctcctggatgacacaggaagcgactcctgtattacacaacagtgactccgatttggcaaggcagaggttcccgtgtgatggggctcctgtgtgacatgcagtggctccagtatgacattgaagtggctgatccatcttgtgcacacttggggtgactttggcatcattactgcaagatcagtcagctttgagctgcagaccgtctttgctggtgcagggaatcaggcctgagtctgtgtcagaaaggtctttgcaaaaagtcaatcctgcacccacatcagtcagtgccggttgagcactccaggaggaccaaggatgaggcttggctcaaggaaaaagcgaggggcctggagagagtggtgatgcttgcaaagggtctccattccttgcagcgtagttgcaggcaacaccaagactagctgggcccttggaatcatccaggcccacctcaccagggccgccagccccacacctggaagggatgctgtcactcagcacgcattgagcaaagaacggactgaacgcagcctcctgctagtcctgggcctccctggctcctgtgctgctgagggacctcccccagagttccagattcttccgcaccagtgattttaatccattttgatgtcagagacctgtgtgggactctggaaattcagaaggtaattgagtatgactcttttcccaataactgctgtgaaaaaacagaacagatgaattttagaagaatgtctgaaattcaagcatcctgtgaggtatctccactggtgagttacttacagctagtcagcaaatgaaaccagagtcgcccaccagtatcctggtgagtcatcgccagcctgaattattagaaagggatggctgtcccggctggcatctttcctttcatctgctgctgttcccttgtcctgtgacatccgtgttgtcatcctatcagaattgtcaacatcacctcatgggtaagaaatcaattcctgctgtgttctctacagctgcttctgtctgggaactaaggaaggagctttattataaaagaaaatttttattcaagtttctattcatggaacttgaagaaatggaacttcctgaaaccaagaggttcagaagaatagagagaagattatcatctcaagagaacacgtctcgtatcatctgggggaaagcagggtggggagaccgtgctccgtgctgcaagtcaaccggcaatttcaagaatgccgtaaattggattaaggatttcgcatcagaaaataaagctttctgctgatatggggctttttcatttggggctgtggcaaacctcataagcctgtagcacttctgagaacggagccaaaccagggtgttcaatcgcagaggttaaagtgattctttcactgagataatctaaatctagatcatattgaatctgccttctctctggcacggaaacattttccaaggtattcacgttggaagtatgaattacccacactctctttaaagccccatccaattaaaagtagatgaaaatctccttaatgcagagtcctttagaacatgccaggggtagcagggagggatgagagatatatatttataggaaatctgatagaagataccaccatgcaacctgagggtgagtctgagaagatatttactcatgacttgtatttcttttaaaaacaattacttttgatatgtatctaaagtatcttctctgtcatttaggataaaaacagattaggcttttactcaggaatgaattagaagccctggcattctaggcagctacagagtttgtatccgcttgcagaaaatttaaaaaaaaataagaagaagaatccagtgtaagagacctacaaggaaaggtaatgttctctttgaaatggaaatctgctcagagaggaagtggtcactggagctttaaaaaaacgttaaaagtagggaagttctcccttcctagaaaatgtgagccggggctctggcagaggacatacgaaagacttagagcagcagactgagatattccaggaatgggaggcaactttaaaccttcagcaggatgggggagacagacagatggggactctgggaagggaccaggtagcagagcagggaccgtaggcaggatgtcttgggccacctcctaccctccctggacactggtcccagctctgaaacctttgtcttctttgggcttacttttattttgttattcaaagtattaaaatgcagctctgattgtagaataacttttactctcatcaaaaaaaaaaaaaagcagatggtttctttacgtcgtggctatgacaagagtactttgggagcatttaagtaaaacagtgttcttaagtttattgggtggctctgaagtgagtgaggacttcagtggggtcatcctggaaaggaaaggcaaaggccagtgagcgggtgggggctcagtgccatgggtgacccaggtctggggcttggcagtctgcctcccctgtgggaacctgcagttcaaggccagcctggactcttttcaaatccatcctggcaggaggtggggaagcagcttggaagtgctgctatgtggccatcaggagcaaggactttcaaaaaggccacgctgggtcaagcccaccgcttatctgctgtgtgtccttggcaagctacttaccagtctgatccctagattccttatctgcaaaatgggtataatgcagatgcccacctgacaaggtgattggaggccttaaaccggagagcacaggtggctggacatagagtaagctgggaaaagccaaaatcacctttgcaaaaaaaattaacagtgaggaaatgatggcagtaaaagagatctgatctaaatcctcacccacctcccacccccagtcatgcctctcctgtaatcattcctgggctttggctaagccaactttgggagacctctagtttaaggtttaaatgataataggccttccctaaaactcagctgccttgataaagctaatgaaaggccatcaggctaggaagaggggagaaacctgaattctgctaaggtgtagactgctcacaaaatatacaacttcactatcgtagatgagccttttgagatcttttcaggttttttgcatgtctgacacctggctctacccagaccaccagccccactcctatggcccacctagaagcaactcagctcaagaggacagctctgaccccctgtgatttcatcagcagcaagcatccattacctggccgccaccaccccttctcccaaactgcctttgaaaagcccctcccctaggaacctttggggagattgatttgagtaatgacaccgtctcccacgtggcggtgttactggccgcaaatctgtatagctctgcagcaacctcagttctcaccttgtcagaagaaggaattcgattgaggggcataacgcagaagaagagaccgaggcaagtttcagagcaggagtgaaagtttattaaaaagttttagagcaggaatgaaaagaaagtacacttggaagagggccaagcagacatcttggaggtcaagtgccccatttgaccttggacttagggtttgatatgctggcctacttccagcgtcgtgcaccccttttccggtggaatgcccctggaaggttaccagttaaactccgccattttgcctctcaattcacatgcttgggcccactcacccagctcctgagatcttatcaggaagctgctgatcaccagcttgtgtttctagctcttgggaaactgcctttccctggcactgtctgtgaccaattattattttagagagacagtgtacacctgcctgaccatcatctgacggtcacctgactttcctggtagggtgtcaggacagccctctcctgccccgctcatgcctgactagctacctgctgtaacagcatggctggccttatgtcaattaaactctttctttactgcaatgccttgatctttttttgtgcagcaggcgggtgggggctcagtgccaagggtagtctagattcgcggcctagaaagcctggcctgttgggtggttccaaagctgcgtggttcccctcaggactggcgctaccgtcttgtgggaatgatggaagttgaatgcagcatataggaagctttcctgattgtaactcagcatcctgcagttctgttcactaaaccttgttaagcaggccctggattaaggtccagaggttttacaggttgataaagctgagcccctgtcctcaagggcttatattctctgaggaggaatgacaaagggtcatgctagtttcagtaccttaccaaaagttttgaggcagcaggatcctgggtctttgtgggagcacagaggaggagagtgggcggcagctaggaaggcttcctggaagaggtggttcctcttacttttccatggttttctccagtaatccgctttgtttttcccaagaaaaataagggaaattcaggccaactatctatcaaaaaattattccacatgtgtcaaaagcttatcaacattttaatcacttatttggaaagttacttaccttacaaagttcccccttttcaaaatgataacaggctttatatccatagcatagtcacacacatacatcaaactttctgcaagctttagtttagagtcgaagtctgccctgttatttctgatcattggtgatattcgacatagcattttttaggtggacagcttgggaaaagagccaagtcaggcgcccagtttctacataaatggcaccccacagcctctcttcaccctacggttccttttccctggctccaaggctgctccgacagacgggcttcgggccacagctggcagcaggagagcaaagacaggagcagtgaggactggctgacagactgctgttaccatggccagaggcctgcgtgattgacatgccagtgattgacctctttggccagctgatgccgcaggtcacgagccaaaagacatgagactcaagaaaatatttgtattttttcggtgttattcccataatgtttcattcaaatgtacttctacactgttttattttgaatgattgcattcctgtttgactctttgcacaattcaggcctcggcttctctttcttttctttattttaactcacagatgtgggaggaggccattgccttgggcaaggagctagccgagcagtatgagaacgaaatgtttgattatgagcaactcagcgaattgctggtgagtctttatttctttttatttaaatgaacacaggcaatctcagctggtttttcaggaatctctctttccatgtcaatgttagggttcaccccaggcactctgggaccttggccatgtccctccgttttgcctaggaagatggttttagttaatttgctggttgatatttggcccataaatatttactttttagtcccaagtcagctcttataaccaaactcttaaggcttctatgaacaaattgtacgtaaacaactgctgaccttgtgtatagcggtcttgacagcccaggagtctgtgaacatttgtactagtttaaaactgaccccaggccaggcgcactggctcacgcctgtaatcccagcactttgggaggctaaggcaggcggatcacgaggtcaggagatcaagaccatcctggctaacacggtgaaaccccatctctactaaaaatacaacaaagtagccgggcgtggtagcacacgcctgtagtcctggctacttgggaggctgaggctggagaatcgcttgaacccaggaggtggaagttgcagtgagctgagatcgcgccaatgcactccagcctgggcaacagagtgagagtccgtctcaaaaaacaaaaaaacctgaccccttctatgagagagggatggatagataatgaccagacctttcttctgccatgggaatgctgttagtttctaattgctacctcctccaccttgtcatttttgtattcagcagatcaccttaatgatgtgggaatgtctgtcatgaatttagaacagaacgattctgttcctttaaattctctttgaacgtatcccactatctgacctataccttttaaaaaatactaagggccagccatttctatggcacttctttggttattgaaaacacccataagtcacaactttttgctgaatttgggctagttggttcagattcccttgcggaatgatggagaatgagtgaaaaataatgtcaaaacgatggagtgagatgaaattcaggtgcaagcctcagtaccctctcccaccatctccctctcccaccatctccccctcccaccctatagaagttgccagagcttttaaagagcccgcaagaagaatccagaggcacacatgcttgaatactcaaacctgaaatgcattttcttttttccttccagaaaaaacaggctcagttttatgaaaacatcgtcaaagtgatcaggcccaagcctgactattttgctgttggctactacggacaagggttccccacattcctgcgggtaaagtttggttctgcctaatctgagccatgattgttcccccagcagaaaatccccttcccgttctgaggaagggtggggagtttgcatccgcgtgggatcgtgcaactctctacactgccatagctcggtggttagcccggggggcagagaggggttgacaggattttatttggttgcatataacctttctatctgatttttccgtaaaaggaccctccttcagagatttacacgtattattttaattgaggtgtgatatatgatatgtgatactatttgccatcttagccatttttaggtgtgtagttcggtggcattaatacagtcacgttgttgtgcggccagcaccaccatctaccttcagaactttttcatcttgcaaaactgagattctgcatccattaaacacgaactccccattctccctcctgccagccccagcagccaccgttctactttgtgtctctatgaatctgactgttgtagggaccttgtattagtggaattgtacagtgttcgcccttctgtgtttggcttgtttcactcggccgaatgtcttccagtttcatccaggttgtagcatgtgtcagaactttatcctttttgaggctgaatggtatttcattgcatggagaggccacattttatttattcattgatccactgatgaacatttgggttgtccccgcccaatgtgctgctatgaagatgtatgtttttaattatatgggaaattggaaatggatctgtatggccacggtgctagaaactccaaaccaggctccatccctgagacaggcatgtgctttcagacatgtaattgaagcagtaaccgtgatcacctgccaggtgcccatttcccagtattcacatgaggccaaaggagaagttacataaatattaatagtgctgcctggcctaccatagaattgtttatacattttctcaagaacacattctttggatgccattgaccagtgggtcatgatttcctgatatttcttatgactttttttttttttttttggacacttggttttctcttatcctaggagactatgtgtgattgctctggctttaggaagcagaagctctgtgtcttgagcacagccgtctggggcagttgaaaccagttgggagattcccctggttccagacgttgttcatttggggtcctgtgtttccgactccacgggagtcactaatagtgtgacatctcttcatcacggcacccagaggatacagacctccccttaggaagggcatgtcactgttgacaggggagcaccacagttctggcctgctctaggaggtgaggctggctgcccactcagtgtcctgcctggtgacggaggcgtctggccctgtcctggtcactcctggtcactgctggtcagcttctcctcttgccttcatcgtgcagcaaagacagcggttgatcagaagcacagattctgaacaaagtcttcccttccaaagaatgaataaaggaggcttagttacaagctctaaattagagacaaatttgaaattagcttcattctcaataaaaaacaaagctgaagggtggaatgagcttggagttaaagccacttactgttgctaaaggctttaattcgagtgtgtgtgtgctccggaacatacatctttaggaaagggaggcaggtggaccctaagccatgcagccttgtgcagtgcttggtgttagatggtgcgtgtggcccctgtggatggagatctacctctggtatgtaggcaccaactctggatccgtgcaggatggttatcccagaatccagagcaagggagcagcctgcgtggaatattatgtgagggcagtgccgggtgcggaggacacgttgcagctcccgagccaatagatgccaggttgtgccaggagctcacacacagcaggctccaggggcggtgctgggtcatctccaccaccaaaaggacaaaatgaaaagtccgaatggaggttaacaggctcgattaatattgaactgactttcccgccacacctggatcattctgtgggtctgcagcaatatatttatcacacttcacagatgagctggcaggggtcaatctgccaatgacactggcagttaccaaaacgtgggcagaatgtttgcgtgcttcatgccctgctggagaggagcctccaagaactgactagctgtcccttttgctttgtttttctctaaaaattggtctcactgttttttgtgctcatgttgatatttatagaccttacaaggaataaatatctttgactatatgtacatttcccccttgttttcatgttcaaaaggatcacttcagaatgcaaagtaactgacattttcagaaaatgttattcgtgtttttacctataactcactagcttttttctattaaagtctttatatacatttttattattatgttttctcatgtaaagcataagaaaaatgcttgctagtttgatagtagtctgttatccattaaatcttactgaattttggaagtgcgtggctttatatagaagccttagaagttgctcagactgtatttaagatgacatattatctggtttctgcttgacttttttttttcgggggggcggtggggagaaatagagcatttttcttccataatggtacttctaagacatatctaagcacaaagtgaaaaagaattcaattcttaaactggttctttttttagcgatttaggagaactcagaataagctggggcaagggaaggggactgtcttagtccactggggctgctgtaacaaaataccttagactgggtactttataaacaacaggaatgtattgttcacagttccggaggctgggaagtccaagatcaaggtgccagcagatttggagtctggggagggccattcctcatagatggcgccttccacctgttctcatggggtggaaagggcaggcagctctctggggcctcttttctgaggcactgatgactttcctaagggtggagcctttccagaggccccaccttctaatactatcaccttggtgattaggtttcaacatctgaattttggggactacaaacgttctgaccacagcagggatcaattgattcagtgtcatagaatctctcttaatccttttgaaaatcctttagttagacaaattttaatttgacttcaatcttagtctttagggggtaagtgtaaaaatatgcagcaaaatgctgtcctctctgtctgtctctgtctctgttcgtctccctctctggcacctgtccaggaatgactgcagatggggcagggctgcagctgacttgggagcagccaacctggaggttcttcccccgtgtcccctgatcaaagaacagaagcacctcagcaaccacgccccgtcctggaaagtgttacccccccaaccccagacttctgtttcttgtacccctgtggcttctgctcgctgtcttctccttgtggcagttttcatttcggttgagacagccccagatgggacaggatgggtggggggaggcagaaggcttccaaaaccagcagcagcattacactaggtactcattggcccctttctgtgaccgagttcacactcagaacacacgtgttgaaatcgggaaaaaaacggagacctgttgtatcttgcaaggaaaacgttccttacaggtatatttacagaggactgtgtcacactcaggcagaaatgacctcaacaagacagcctcgtggaaggaagaacacttacctacttaactcccctccccgccccggactgcctagtctagcctagccgtctataacaaccccagtggactgacattccatcttggaatttatggaggtgacaaaagtgtcatttgagatggaccaaacccagcccttccaagaagagctctgtatgttttatcttgacatgtgttgatgaataatgacctgcacacacattctgaatgcaggaagggaagtcctgctctccgtccatcgccagtcactcactcgggggaggccaggaacttagtagctctcggctctggtctgcatcccttcccctcgggttctgctcgcctcggctgtgtctcacaggagtcagcgcccggcggccgtgtgcaggtgctggggccccaccttagctcaagctctcttaaattccttatggcagaatgaaaacaacttcattagggcctacctgagaagaaaacaaaaacaagaaaaagtgtggacatcattatccacttgtcctggctgccttgcccccttctaaccatttcatgcccattctagtgtgggcttctgagtgctcatttggtttttcatatagtttttaaatcagttgttactgtcaagatgaaaacatatcacagatgttagtagcgcagtgctgagtgcttcttaaacagtattaacttacatgcttgatgaccatgtgttcttgattaacaaagccaacgcaagtacaaaaaaaaataaaaattacaagttgttcttaaatttaatgacattttgtaagaacccgtaaggcatattttaaggccagcatattgcatgtgaactcttcctggccctttctctgtggtgttatgaaatgaatgtcacccttttcagggaaaagttttcatttaccgagggaaagagtatgagcgccgggaagattttgaggctcggctcttaactcagtttccaaacgccgagaaaatgaagacaacatctccaccaggcgacgatattaaaaactctcctggccagtgtatcctttaagacaacctcatcaactctgaaaccatggtgatgccattcatttgggtggttgggtgtggtggggggcctctctcatggttgatgtctatgctgccttagtgatccttaaccccctcacctcagatattcagtgcttcacagtgaagcccaaactcgatctgcctcctaagtttcacaggccagtgtcagagcagattgtaaggtaataatcccatttttcttacccaacgtgagggttgtaagaggctgtgtacagatctcttgctaataattccaccttttaaaggacggactttggccatggattcgctttccaaatgctctttctgtcctctttgaagagcaagggaagctaattattttcagcatccaaaaaaagtgacaggagatgttaatccatgtgctgggagcgtgcaaagcctattcctttcccaaagtcagctgacagcaaaaacctaagagggcagtggaggccgtctggtctcctttatagacctgccctgtggggtacaatcccctagggaacttcacagcagtgcacaagtcctgcctgttcccagcaaagccaagttcatacatgtgagtgtggcctgaatgtttgcattttagaaggcgggaaatgggatttgcacatttgctcctggtgacacacaggagaacccttcagccttacagcacagcaattccataatgtagggttatgagggggcttttaaacctcctgagtcaactgtccatatttgagtgagattttctgcctgtcagttgtatcgcacctgacttagcaatggcatagaaagacctgctttagcagatgtgtttgatattaagacttttctgttctgtttgatccatgttctggtgaaaatattaatctctttgatgacctcatattccttaggatcagcttcattttgcttcctgaagtttggtggtttctttaacctttcatcgtttctttgaccttgcatcagcaataatgggaaataaactgggaccctgtttatttacaaatgattgctctcgcaaggcatacattttaagggttgcaacattttttttcagaggccttaagcaaatagtgacgcttagagccttctcagatgcagtagtttcttttgctgtggaagcctgcctgcatttcagtgcaggggagaaatcagtctcagtctctccacgccctgccctgtgcatgcggaaagcctgcctcgtaccccgaccgcggaggcaggttacttatgtttcctgtgtgtcactcttggggtggttgcaaaatctgtgctttgtagatctgaaactaaggtatgtaatacttttttaaaataataataaacacatacgttgaacacaaaagcttttttctctctccttcgcttcacctttcctctgtttttgctcatttcactcttactcagcttctgttttccctcgagggttggcggggacagggaagaggcaaaaactcaagttaatttttccacctgccaacatttccctggctgggagaggacaccaaggcgatggcttcaggtcaaggttagggacattttacaggaggcagtgacatgttctaaggccagaccccgtgtccaaaagcaaattggctatttgccgggttaaatatctaatgatctgtctgtctctgtacagtttttacagggtgaacgaggtccagcgatttgaatattctcggccaatccggaagggagagaaaaacccagacaatgaatttgcggtaaaaaacaaacaaaccaccaaaccaaacaacaaaaaatatcattccgccaccagtagaactgccactggagaagcgtggcctcagaggcagccacggagccatattaaatgtctttgtgtattatgtgcagaaatcttaatctattaccccctccaaagttagaaaaactaattgccatttcactaacaatatgactaaggtcactgagatatttaataaggagactgtgccgtccaaatgccggagctcccatatgagtagcgcactgccttccctgcgagccccaggtgagagagcaggtgcctgtcatctctagttaaaaatggacccaccgagtgctgaggtgcggggtgctgacgtggctttctgcaggtgacacagcagtcagcacatgaactggatctggacccgggtgctcattcctcattcagtatccagcacctgaacttcagtggagcacaacacacaactgcagggttgaccccagcactactagcaatacggaccgggttattctctgtggtggggaccatccagtgcatccagggatgtttggcagcatccctgaacactgcctactaggtgccagtgccaccaccccagttgggacaaccaatcaaaaagatttccaggccaggcatggtggctcacacctgtaatcccaacactttgggaggctgaggcaggtagatcaaattagttcaggagttcgagaccagcctgaccaacatggtaaaacactgtctctactaaaagtacaacattagccgggcgtggtggtgcacgcctgtaatcccagctatttgggaggctgaggcgggagaatcgcttgaacccaggaggcagaggttgcagtgagccaagatcgctccattgcactccagcctggggaacgagagtgaaactccatcaaaaaaataaagtttccagacattgcaaaataaaacatctgccccttgttgcaaaccacggcattcgagttgtagaaataacagcaaacatctttagagccttttttctttatttttttatttttatttgtttattttttttgagacagagcctcgctctgtcgcccaagctggaatgcagtgccatgatctcggctcactgcaagctccgcctcccaggttcacgccattctcctgcctcaccctcccaagtagctgggactacaggtgcccgccaccacgcccggctaattttttgtatttttagtagagacggggtttcacggtgttagccagaatggtctcaatctcctgacctcgtgatccccccgcctcagcctcccaaagtgctgggattacaggcgtgagccaccgcgcctggccctagagccttttaaaaattctacatacaaactgctttcatggattcatttgtatttttattttatttatttttttatatagaggtggggtctatgttgctcaggctggtcttgaactcctgggctcaagtgagtggatccatgttgaaaaggcatcaaataagccataatttttttaaaatgttaatgtttatccgtcttgcctgggaaacctccggaaatccttctgtactcctgtattgcaaggaggcattagcccggggacccccaaggaggaccggctctgctgagaatggcttctcttgtgtgccgtccgaaggcatctaggctgcaaaggtcaaaggtgaattaacaccctactcctgaccagagcaaagctcggaacccttccagcagggttgcctcaagtaaagagtggtggctacccagtctccctcccaatccctcaggggtctgccagtcatgggatcctcagggcagtacctgtgagtctcctagctcagctcttaagagccatggggaagttccttccagccccgaggccagattccttgtgtgtcaccaaggagcacaaaggagcttggagttggtgaaatctgcagtattgtgcagtcccagcaggctggttgtttgaagattatgttcaccctatttgttggtgaacccagcaccctggacctcctccaggactggtcactacagtgtccattgtctgcaacagtgcgggcagaacctaggcacgtccaacctggacaccctcgctaagggcagtggctttcagagcagactgcacctgttactgtcatcataagcactaacgctagtgtttatatggagtccctcaactgtgggatttataggcagttcttgaatttccctcacacctctcccatctggcaagtagatatattcttagactataaagaaatagacacaaggaggtcaagtgagccactggagggtgcgcggccagttgggtgcagagctaagaataacgaaggctcttgacattttgagctatgctgagcctcagaggctatgcttcttctaaatggccctgaaatcccctaatggccctgttgaggtccgggcacttggacaaagtgttcggaagctgcaggatttggtccttcacatgccccacaaagccttagataagtgcaacgtcttttgctctactgggaagccagcctcggcccctccagcggggagcctggctccaagtgcagggggctggggaagctgcccaccaggccgagagcagtgcgaggtggctcatccctgcagacctggcaaggggtgactgatgtgctggggagtgagggcactgacgaggaggaagatgagacagggcctgcgtgaggaggagctggccgtaaagcccaggatggaacccagaggtccgtctcagggcatgttgacatgagagaaagcactggaatctggtctagaggtggatgtgagagggccagacctgtttccattgccaggacaaaaacctgagggagccgtccccatggggcaaagaggactggtgtgggacacggaggccttgcctgtgtccttatggcttcagccagctccttccctttcctcctatggaacgtaagaagtttgggataaatgctttccaagatccaagtcagttttctgaaaattttttttttttgagagagagtcttgctctgttgcctaggctgaagtgcagtggtgtaatgtcagctccctgcaacctccgcctcccgagttcaagcgattctcatgcctcagcctcctgagtagctgagactataggcacatgccaccacatctggctaatttttgtatttttagtagagacgggattttgccacgttgcccggcctggtctcgaagtcctgagctcaggcaatctgcccgccctggcctcccaaagtgctgggattacagacgtgagccccccacgcttgtcccagttttctggaatgactggcattccattatcccatctgcttaagtctagattcctgttgacactcagactgctcagtgaccctgcagtgcagggaggttggaatggcagaagattgttgcaagctagacagtacgaacgaggcagtaggataaaggatttccagttgacccctgcattggagtttttgtgcaatccttaaagagtagtagaattgtatttattgggttagaacagtttcctgcaataggtaatatactgttttacaaagaacacattgtcaaatgatgtttttatttaaaatatgcatagacacactttttaatacttagtaagaagtcttgaacaatagatactaaagcatataggttatcagcttcaggtaggggatggtttttcctcctgctctttccatatctttatgttctcatataaacatatattagttacgtcaaaacattttaaagtttaaaataccgactggttttatcagaacatcagaggtcactttgattaaatccagtctcccaaagatgtatttgccccttttagtttcttatgaacactgtagctaatgtaagacttctttggagccttcctcaaaatctgtttgctcaagaggggctccccatacctcattttggagtatacacatctttctcactcacctagtatactttcattgtcaaataccagagtggtgggcaatgttggctaggggacaggggatactttgatgtatcctgagcgaccgttaggtagagcgtggcttgtgaggtgctacctgaaggcacacatgccctgtgctgagcaccacagaccctgtcctgctgaaggacctgactcctttggagttattctataaatcccccttagggcagagctgtccacctgctgacatccttctaacccgtgttgtgtgtgtgtgtttcctttgcagaatatgtggatcgagagaaccatatatacaactgcatataaattacctggaattttaaggtggtttgaggtcaagtctgttttcatggtaaggatggccccaccccagaaggaattgtccgttcccttcctcaatacagtctgccacgccttcttcacctgctcatgccccgtggtcactgtggcagcgtgcacacagcagactctacagttcccataaccaccccacctgttcttgagagcatcgatatctcctcgcctagccatattttagtggaaatgctgtgtaatcacgaccaactctagcttatcaaaaaaccagaatgaagatttcatttcttcttacaatgtatttaaattcagtcatagctgtgctgttttgacaatgctttgtgttaaccaagtgaaaagttgaagacaaattccagtctacataaacttttttaaagatttttttcctgatggttttattgccatttacatgacaaacaactattaattaatagtccttgcccatttcaagtaaaaatagcctgagaacatacccctccctgaccctttttaaagaaataacgatttccagctctcaacaaagctaaactttgctttgagatggggcagtttcatttacgtgaaactcacatttgcagtgagctattggacagtttcatttacatgaaccagagttgggctgcagatttattgacagtattgaaatgtcagggccaaggcaactggcaatataaaaacatctgattgaaatctgtacgtttttgttcatgtgtctcagtgccttttgttttcacctggcaagaactcactgagggggtggcacttgccatttagttttcaatgagtccccccgaaacacctgattatttgtctctaggggccggcatctctctgcccagctgcgtgtccagcgccgagccttctcctttgcccacaccagcatgagctatgggcagctatgggccactctctgagaggttgcccgcagtcagagccactgctttatactcaaagcacccagggctcttcacctacccctcctggggtcactttctgctctggagttccctttctgtgcccctagcagccaggcagtgcctgacagatagaaggctgtgggagttatgtgtcaggtggtaaaaatgcactccctttgctgggtccctttgtagctagtgaggcattgtacatgtgagagacaacagaagagcaggccctccacctaaacaggccgtgatcctcttaatcaccctctgcccatgagccctttgtaatcggggcctgccagccaacagctgccggatgcaggagcttagggaggtggagaggggagccctgacctttcgtgaggatgcagcttctcctcgggctgctttggccattttgaacagactaagagggcaggaaggcaaataatcccagaatggcaggactcacgtcctgctaccaaaccctgatgccctcctcgtgccacctgggaccaacccccgtgggatatctgtgggagcagcagctaaccttcttcaataaaaataggaagggattctttctcagtgcaaatgagattagtaacagggaggtaacagtcagtcctggtggaatactgccctggagtgtgcatttgttgaagctgtgtgcccgggatgaaatgtcgtagggcctggcaaagtaagttgtggggtcaggacagcatggctatgcctgctgtccaggacaccggacaaggggccctctcagcagggtgcacgtggctggccacaccagtgcatcacaatctccccaaggctgtccctccatcagtgcaaggacagtgacatcagtgggcagacaacctctgttatgtccacagccacctaggagtgccagtctagggttgctgacggacagaatcgcccattcgctgttcatctctgccctgccccacccccagctcccaggcagtccgctagaggctgtagcaggaagaaagccggacatgaagataccaagggctcttgggcatgggtgggggcccatcacgcttcctttggaaggagcaaagttattgctgaggtcaccctgggacatggtccccgtggcccagtgtgaggaggaggtttggtctgctcaagcaagacctcagggcagctgtggtccctgccttagacccagccacgttgccctggcaccttagggctgagctggagggcactgggctgggactcggccaggccaggccctgtggggccctcagagaaagagggtggaggtccctgagagacacgcactggagccaggaggacagtggtcagtcccctacctcctgcactgaaggtgtcattaaccatggcaagtgtgcaaatgaagcctgtgagggtggcctggagtgctccaagcagccttttcctcccgaccccaggggccatgagctctctttgttgttgtttgtttgttttttggagtctcactctgttgcccagcctgaatacagtggctcaatctcggctcactgcaacccctgcctcctgggttcaagtaattatcctgccttagcctcccgagtagctgggattacaggcatgcaccaccacacctggctaatttttgtgtttttagtagagacaaggttttgctatgttggccaggctggtcttgaactcctgacctcaggtgacccgcccacctcagcctcccaaagtgctaggattgcaggcaggagccaccacgcctgcccatcactcttccttcacatgatggtgtgtggtgccatggcggagccctgccttgacctcctttgccctccctaaccggacaggtagtgcaggctgcccgggcttagattcctcaaaattcccgaacatcttctccctcagcacaacaagcagagaacaagaacaggattggaagtgtctgttctgaagcaggtgtattcaagcactcaaggctgcgtgttttcctgggatgaccacatatgtgcatagccacatgcacacacacagccccgcccccagagctgagcagcagctttgctttgttcctttggaattttcatctctgggaacaaacaataataataaaatgcccagccacccaaaaattctgtttggaagaaaggttcacggaggagcaggaagcctgccccagagcacgtggctcctctggtgagaccctgggagtggaggcagctgtggggctgacatcgggctctcctctctctttgcaggtggaaatcagccccctggagaatgccattgagaccatgcagctgacgaacgacaagatcaacagcatggtgcagcagcacctggatgaccccagcctgcccatcaacccgctctccatgctcctgaacggcatcgtggacccagctgtcatggggggcttcgcaaactacgaaaaggtacgggacccaccagcttgctctgggcaagcagtcctgcccggggacagactgaaaattcccgagagtccccaaagcccagaaacgcccctggtctcattgagcaatctcagcagtggcccagccaaggccaggcagcagcagccagtggcggcccctgaagcctgcagcaaggtcaaggccggagtcccggcaaggctcccctgggcatccccagacagccaggaagcccccactgacccacccaggctgggcttatctgcacccaggcctccagtggcttttacaaggtctgggatcttacaggccaaaagataaagttagacaaaaacaccagaatatcaggactagggaggtagcgctttgacggtggagggggcccggccagctggtctccctggatcctagctctgtaggaatgggcagaagttgaaggacacagggtgtatcctagaccacccctgcctgtgtttgtaactgcagttcttttggaagaaggccacgcctgtgcacttacttacgcctgaggctgttttcctgatactgtaactggcgagttgagtagtggcagcattgagtagttgtgatagagacctgtatggtccacaacacctaaaatgtttaccatctggcctttcacaaaaaaagcttgttgacccctgatctagacagagcaaaaactgagacaaaaaggatactgcctgagagaaggctgcgaggagatgattacccacccttgcacaaagaagtttgttgccttcaggtgtaggtcaggcctgggcaggtgcaggggctaggcaggaggcatgggcgtgtgagtagctgggagggctgtattcactgccacccagcaggaccaagccaccaggtcagctgtggccttcctggaccccaagaactggggttgctgctgtagacagccctgttagctccacttacagtgtttgaccttgtgggacattttgtcctgggtgctgcgaagggtgtgaccctgagtctgcagtgagcttcgtgtggatctgttttatgcacagctctattctcagggcctggcacacagtaagtgtgcaaaaacctgtgtttgctgagcaggtgcactgagcaactctccttgtctccaccaggccttctttacagaccggtacctgcaggagcaccctgaggcccatgaaaagatcgagaagctcaaggacctgattgcttggcaggtaaagtgtccagcaagagtcctgcatggctggagggaaggaaagctaggagggtctaggctcagcacacacaccagccagcatggaggtccctgggctgcagtcctgatgcacgtggctgtgattgtccctgggtgaacccacccactgctgtcgtgatcaactcagctcctgggctgcagtcaggaatttgaacacccagaaaattatctcttgcaaatgaacaaggtctctttcctccccttggtcaattctgccggctgctggaaaactttttctctgtctgtattgatagaacattgaggtgagctcagagccatgaagccttgagctctagcctgtgccaggaaaggcgctcgggccagtgcagtccctgtgaaacgcatgtacgtcagaagctgcagtgcaccctctccctgttctccgtgcacctctggcggtggtgtgcgtcctcatctgtgttttcccagctgaagttgtgcaagttatttcactgttctacttatgctcctggggcctcgggagcctttcccagagggccagcatcttgaaagggcagaccctgggtgccttgggtttaagtgtcagaaccggacggatgcatctgtgcttctcagagccttcctgagcctggaagtgtaggggtcaagagccagtcctcacaagagcttggccggcaccagcctgctctgctgctttaggccactgcctctttaggcttccttttcacatgtgggaggcaaggagggtgctgtccccgagatcttgccacactgtgtaaagagagttgagggaggtgggggcaaaggcctgcatgggtttggaccaggtgtcgtagcccaggccactttgctaagctggggtcccaggctcccagtcaaggcccagagatgctgtgcagttgatctgcacccagtccagaacagggcaagatacaaaattagctgggcggggtggtgcacgcctataatcccagctactcaggaggctgaggcaggagaatcgcttgaacccgggaggcggaggttgcagtgagctgagatcacgccactgcactccagcctgggtaacgagcaaaactgtctaaaaaacaaaaaaaaaaggaacagggcaaggctgttcctcttatgagacatcaccgtgagcagtttatttgtttgtttgtttgtttgtttgtttgttttggaggtgaagtctcgctctgttgcccagactggagtgcagtagcgtgacctcagcttactgcaacctcctcctccggggttcaagtgattctcctgccttagccttccaagtagctgggactgcaagtgtgcaccaccatgcccggctaatttttttgtacttgtaatggagatggggttttgccatgttggccaggctggtcttgaactcctgacctcaggtgatccgcccaccttggcctaagtgctgggattacaggcatgagccactgcaccaggccactgtgagcatttttattctgacatcccagcagggcctcttcttagtggcctctctgtcatcagcacattggccaatgagacgtcttagagtggagcaaggctgagctttggttgtgagccaaggtacgagtcctcttaaatttgtgtttagatatataggatgggttggatttttataattctaagtgcttatactgatatgtaaacataatatacattatgtatatattataaataattgtgataaaatatacataacataaaatttcccatcttaaacatttttaagtgtccagttcagaggcaataagtacattcacactgttgtacaaccagcaccgccaccatccatctccagagccttgtcatcttgcaaagctccaactctctacccattgaacgacttccccattcctccctccacccacctcctggtcaccaccattctactttgtgtctctatgaatttgcctactctagatagcttatatgagtggaatcatgtaatacttgtccttctgtgtctggcttgtttctcttagcagaatgtcttccagattcatccatgttgtagcgtgtgtcagaacttcattcctttttaaggctgagtaatactccattatagggctagaccgcaatgtgtttctccacggatctgtcaaggaacaacatgtgggttgtttctaccttttggctggtgtgaacaatgctgctgtgaatgtgggtgtataaatacctgctcaagtccctgctttcaatactcccatagtttggggtatatacccaaatttagaattgctggctcatgtggtattctgtgttttctttttcacgaaactgccaaactcttctacggtcacagcaccatttgacattcccaccagcagtaatgcatgattccaacttctctgcacccccaacaagacttgttattttgtttgtctttttttttttttttttttttttttttgagatggagtctcgctctgtcaccagcctggagtgcagtggcgtgatcttggctcactgcaacctccacctcccgggttcaagcgattctcctgcctcggcctcccgagtagctgggactacagatgtgtgccaccacacctggctaatttttgtatttttggtagagatggggtttcaccatgttggccaggatggtctcgatttcttgacctcgtgatccgcccacctcagcctcccaaagtgctgggattacaggtgtgagccaccgtgcctggcctgtttatcttttaagtaatagccattttaatgagtgagaagttttatttatatgtatatataaacaaaaattatattaaaagggaagaaatcagactttgtcacaaatctgcatttgaaatctgtttgctttggaattatggttttgaacgtcctcagagtttgactgaaagggacattgttggccaactttggcttctttgtatggattgtaagcctcatgtagacagtctccctctgtaactaaaaaagtgggagagagtttaaaattgtgaatgattccattttagatgttgtagattttttactaaagggtacgaaattcaaaattcctctgcaggctataaaactattgctatacaaaaactagtttggtctgcaaaagttctattgattttttttttcctataagcttttacagcaaattggattttaagagtttcaagtcctacagaggaaaataatttgttccccagagagcagctttatgtcagcactatgtcatcattcctaataactatattaaaggatgaattttaaagcaggtcacaggaaaggtaaaagaatcagttttctagtaacttcattaaatcaaagagtgatgaaaaatgcatattccaaacattacctgtgattttgctttcatttgcaaatgtttggaaaacccgtatcttggtattggcaactgagtcatatgttcattaaaaataagaagtttgaatttatcagaatgctttgttctctttttgtttattagttcatctggtttggttttttcctgaaactatcagggcagagtgaggtttttctcctgggagtcccaggactcatgtgcagagttttcatcaccgatatataataagctcagctctgatgcataaaatggtttgtgaaggttggttaataagtcccaggcagctcctcctcagccctgcttgctgcctcagaaacagaggatgggctgacctgctcctcgctgggtgggaggtggcagtcagggtgcacactgtgtggtgcctcttgtaggtttgcggctggcaccaggtcatgagtcactttctcaaaggcacaattccatctttctccatacacagctgtcattgtggagcatccctgccgagtatccaaagacaaatccatacagtctcatattaaactgctgtgatgtatacatatttctcttttgaaatgtacgaagatgaaaggctgaactcagccatcatccccagctgatgacaagcatgactgttgtgtccaggggtggtgctcctggagcattaagcaaggcttccagatgttctgtgctgctttcagggcatgaatctgtgcaggggacagacaggagcaaacttcaaatacggcccatcaggagggcgtctttgtagagcaggctgcaggctcgctttgattaattagaggtgtgacttagggaaagtcctctcccatctctgggctctgagaaactctttaggaatgcagattcctgggatctgcctacagcaaatcagggctctggaggtggggttcaggaatccacctgagattctgatgcttagccagagtggaacccactcaactacagggtctccagagaccatttcagaccctcggtctatgttaagtgctttttgtgcattggaatgtgtttactcagggcatcctcttatcttctttcatttagaatcacacctgcagttcagccccaagtagacatataacagggaaccagttcctgtcctatcagaaggttatttcccatcaacgtcaggaactgctgagagtggtgaattctcacacctggtaaatttcacctatcagattgcagttcgagcagcacaagcgtcctaaaccaaaaggtcttaactctcatctgacaagtaccttctttgacagaaagaatctgaccattaagagttttatcacaccaccatcaacaccaacaacagcaaaactcaggaactagattacattttgtagtttgagaaaggcccgccctaaatcagaaatgcttttagtatctagggtggctgtgctttcaccttgcaacagcacctccacacatccctgcctttgcatccagagagagacccaacacattcgacatcccaccaaaagttgtcccggtctgtctgcgtcatcccccaaggcggaactcaggaggcagaaggctgacagtgagcattttctactgctggccctgagtaaaccgcggctagccccggggaagctgccatctgcacgagtaattcatagggaatattaaaacatcccaagtattttgaaatctctctgtatgctgtcctttcggtgataactggccagaaaggcctgacatgtgcctagggtttggggccaactgtcagcaaaacaaacttttgtgtcggtgcagcctccaagcaggctaggagggctatgagcgaggagagcgctgctactccctcctttcctggagcaccaagagaggcaacagctgtgtgctataaatggtaaccaaatacatttgatgcgttgattcatcttgataagatttcttgaatttgctcacatgaaattcaattgtgtacttattatcgttcatactaataaatctgctcatttagattggtgttctgtcctattaggaaaatctgtttttaatcagtattttgatttaattataaattattgagaggaagcctcttagcttgattacatggaagaatgtctaactgagtccaagccctggggggaagcagagaccagggacagaaagggagacttttccttctcccaccccacaacagcagcaactctggtgggtctctgcagctgggagaatgaaaatgtctctcttagaacgtttttaaaggtcagcttcatctccactctcggaagtgaagtgttggcatggatattttgtgacagcagtgtcgcagagaagcgattatttttagttttaaagaagaataaatttggttttcacttccaaaaaaggaagatttttcaggactatagatcacatgtaattaccttttggaatagggttctcgtaaaggcaatattcttagctaaaaaatgttcgcactctgacatgaccctttgctaatagaacaagttacatctaaacaaattcaaggtgtagctcttcccaaactcaagtgaaaagcacagataagtctattctgggaaattaactgagtagccgtggtgtagggcgcaccacactggacatagtcaattcagaacacaaatggttttcatgtaaacattttggtctttggtggtaatatgcctgctggtaaattgaatcagctggtttgatttggaaaccaaagcagatcgttttgccagttcccctttccccaagtgtgcattgctcgtcctagaccattatccaagaaataaggaatgtcaacctctctgttttccagattccttttctggccgaagggatcagaatccatggagacaaagtcacggaggcactgaggccgttccacgagaggatggaggcctgtttcaaacagctgaaggaaaaggtggagaaagagtacggcgtccgaatcatggtaagagggtagtatgcgtagtgttgcagaagagtgggtgtctgggcatcccactgttgaacagggacaagcttccagagcagaggaactcacatgtacacatggtgcccgcttaggaagtgggatgtgagggagctcagcccccttgggcagtcttgtctaccggcaactcagcaacctcctttcaataactggaaatgtcagggcgaataaacattcatgaatttccttgattaccaaatgccccctcacctgctgtgaacacagtccaaccttattgttgcagagcaatggagaaatctcacagcgcccaggcaactcagctggttgacagtgcacacctacagtcatacaatacacacagagggttcggtcatccacagggcaacagcactcacgacggcccatggcagaggtagcccagcccaaggttgacatcagaggatcatggccatcgaggaagaagtgaccaacatctggagtgtgaaattattagtgaagatttacctattgtaggaaggggtaattgatctagaccaaggaagataagccagatgtggtcaggggaggagatcaagaagacactgcctggggaaaggactccctcaacagaggctgagaggcaggagtttgaatggcaggccaggggccagtgcagacacaggcatgctttgggcagaagagaaaattcagagcggagatggaaaggcacccaacctccaagaacaagggatgctaggctggggcaggaggctctgctcgggatgaagggcagaactgagcttttgcaatgagtttatggaaggtttctgagcaaaggctggcatcaggagcagggtggagagcagcttgagttttaatgatgcaaaaaccttgcagttcaaatcttacagcccacttgagactgtccccaggagccatgccttagcagatgtgggagcaaagccaggcaccgtgagtcacagtgctgccctgctttgcagctcagagtggtgctcccatctttactcagtctctgggagctttgctgggcctaccctgcctgctcgggaactgtggagacaccagacacggcaaagggtccccactccccattgttcagggatgaggggcaatgtggcacagagaagcagggagctctcttctgtctactggaattccatgcctgccggcactgagggggtgtgcacagggcttcaactccccggcaaaaggaaggcgagctgtgggaagtcgcgctgcttctcccaggtaacatacggcactttcctctgctccttgaagaccaggtgtcgagtggggtgtgccattttggtttttttctgggcccagggccgcctgtccaccagtccctgaagttctcagctattctctattgaaccctgttttctttgacacattgatctcaataagcaaacagtaatttagtgctccccacgtgccagggaccttcctaagtgctgtatagatactcagttgcttaatctgcctcacactctgtgaagcaggcactgcagtcacctgcattttacagtcaaggaaacagggacatgggaaggtaagtaggtcacaccctagcacgtggcagacccatggttcaagccctatccatgtacctccagggtctgtgcttttagcccctactccaggggctgacatttggcaccacagagcttctccgcctctttcccacatggtaggaaatgcatatgagacctgggcaacccctgagagaaggtaatttggttatgatcacactgcatgctctcccagtctccccgcctctgccgggcatgaccgaaccttggtgcctccaagcctaggacctggtgtccctcagatgagagggtcccaggcccagcagggcttgaacccaacaaagccaacataacacaactgctgctctgaggttgaaaactcagcaggtgggagtctggaactgccagcccagcgggagctgctgcaggtgaacaggcctggaaatcagggctctgtccttcaaggctgggctggaggatcctttgtgcaagtcagaatgctagagtagcgcttgatagcttcagagcctgcaactcattacagtcagagctgagtggcaagaagcgtttcggagtgcgtcacatcgcatctctttcaaagttgatgcctgtattaattcattctaagaaacaaacacttgtgaaatcttgacattttcttcctaagtgaaaagcttcctcttttctcagtcatttaatgtatatttcaaaatcacagaaagctgtctggctcaccagacatcctgcatattcccttctctgccacattcatgagttctgagtgtgcttgctttgggcacaggtggagaaagcaagggcaggaaggtagggtgctgtggattggtgtgctgtgtggattggggtgccgtgtgaattggggtgccgtgtgaattggagtgccttgtggattggggtgccgtgtggattggggtgtcatgtggattggggtgtcgtgtggattggggtgccatgtcgattgtgccatgtggattgtggtgttgtgtggattggggtgccatgtggattgtggtgttgtgtggattgggctgccatgtggattgtgccatgtggattggggtgtcatgtggattggagtgccgtgtggattggggtgccgtgtggattggggtaccgtgtggattgtggtgctgtgtggactgtgtcatgtggattgtggtgtcctgtggattggggtgctgtgtggattggggtaccgtgtggactgtggtgctgtgtggactgtgtcatgtggattggggtgccgtgtggattggggtaccgtgtggattgtgccgtgtggattggggtgtcgtgtggattggggtgccatgtggattggggtaccgtgtggattgagccgtgtggattggggtaccgtgtggattgtgccgtgtggattggggtgctgtgtggattcgggtaccatgtggattggggtgccgtgtggattgggatgccgtgtggattggggtgccgtgtggattggggtgtcatgtggattggggtgctgtgtggattggggtaccatgtggattggggtgccgtgtggattgggatgctgtgtgtccttggttggagcttatttccagcacattgtgaggcagcaccgtctccatcaacctccccacccttctctgtagcaccagctgggtcaccccgtctagggggtgggaggcttttacagaatgaaggttgcattttccaccctgagatactttgttccccggacccaccttgcagagtcctgctccatcctttgaccgcaacagcaggctctgcaagcatcctttgagagtcaaggggactggcaggtccccttgtccttccctgagaaatgtggcaataaaacgcagtctgggatgtgcctttcctgtcttacctactttggaaacttgcaatcatctcagagcactttgaaaagcaatctagtatcaccctgtttgcaaaaaagatggattttaaaatttaaaaataaacccatagaaaggacataaaccattttgtcagtgtttctgagccagcttaagccatagaaagagaagatgtggacgccctctgacttctcgatacccaggcccctctgccactctgccttggctttcatcgtgttcccagtcctggggctccaaggagctgccattccctggatgggagctctgcagcccagcttctcctgacctttagggagcgaggtgtgcagggccccagggatgagcccatgagcacctgccacgttcggcattggcccccgtgccctcaccggcccacagcgccacgttcggcattggcccccgtgccctcaccggcccacagcgtgcaggaggcatgtgtgttggccttcaggcttgtgaaaaagagctttaggtttctcaccaaaacttcatctacctcttcaagtccgattaggagcagggaaattgatcctggttctgcattctctctactcccatccacctcatcactccaaacaccatggagagccataaccccaagatgccatcgtccccctctcccctccccacctacagtcacaacacccgctggccacccagacccgggagagaaccaggagtcacccttcctccctcaagttagttctagctgtggtatcccctggtggtgctggggttcaccccaccatctttgccatcacagttggcccctgacctggcccccagcttccaggatttctcctctctcgccctccctccacagctgccggggggacccatcccagtagttctcttaactgggatccatgagaccctggggttcctcagaggctgttgggaggggtgttgactgggaggtggagctgatagcccctgcctcagcaggaacatttagcttcacctattccttgtgctggagttccatggtgaggagaagcagtgtggcatggcctacaagaacagccagggaccagggttctgtttcagatgcagagctgatggtgcagttgtgtccttcagtcttgtggcctctgagggccggccaaggttctaacatcacactcgcaccctccctgctgggcctgcccatcttctgccccaccccccagcccctcctcccccacctgctctctccaaaggaaaatgtgtcaccctctgtggatttccaggctgtagctggcatttgtatagcatctggaaagggacattccagatcacgatgaagtgtgcctgcttcttacccttccttgtacagcactggtccctgtgattaagttcagccaaccccttcaacccagcccattcccatccaagactctgggcagtaaacacctgtggctggctcaaggtgggacgttacagctcagccgggagacagcgacgtaaaactcagggtcattaggcagggccagaggatcgctcctggtcagaaaactggaatgagtgtttgctcaggcggtgaagacagcagcagccatcagggtaaggagccctgtgggcttccccggcatcatttcatttagttctaatgctggccctctgggcagggaagactgctccctgtgtgctcaggaggaagctggggctccgagtggctcggggttttatggagggtcacaccatcagtgccagggccacaattccagcctagttccaatgtccccaactcctacccaccagccctactttcagtcacagtgtctggccgtggagtcccacctcccaggactggttgagaccctaattgcatcagatgaaacaaaagtaaagccctgatgtcttgatttctagaggctcaatcaagaaggaattatgcggcagaccgcccagtaaacccatggtcgcacccagggagtgccctctgtctctccttgacgggagtcatcctcctgccaacccccttcctttattccttgaaatccatactcacacatctcaaccaagacctgaggtcaccttctgagattatgtatggggtaaggttttcacagttggggataatccccaagcaaccatttcccttttagtttcttctaaaggcagagtaattacagtgaacatctccatgaagctatcccctggcaccatcattggtgcaggtccaagactgaccagcccctctctgctggcaaatcccagctgcacgtcactcagagccagtggtcagcaaactgtggcccctggcgtggttgtgtaaataaagttttgttgacaggcaggccatgctcattcatttctgtattatctgtggctgcttttgtgctgtcgtggcagcgcgtgctagtttccacagagaccatatgtcctgcaagcctaaaatacttacctggtcctttgcagcagaggtcccagccctcaggcagtggactggtatcagtctgtggcccgttaggaactgggcccacagctggaggtgagcggcgggtgagggagcattactgtctgagctctgcctcctatcagatcagtggcagcattagattctcatgggagcatgaactcgattgtaaactgtgcatgtgagggatctgggttgtgcactccttatgagaatctaatgcctgatgatctgaggtgcaacagtttcatcctgaaaccatctcctgctggtctgtggaaaaattgtattccacgataccggttcctggtgccaaaaaggttggggacaactgctttacagaaaatgtgggccaattcctgcccttttacaattttgagcttcttattatgaaagagatagtttacacatcaaatgctgttttatttgggatcacatatttaagaaaaaggcccacttttcagaaggggaagtggcgttatattaatcttacctgtaatctaccgcttctggccttggagggctggaaccatggtccacagcaggtcttctgtagttgattggctgaatgagatgggcggggtggggttgcagggtggggaagtcaacgccacacagagaggaagtgccctacaggaacttagtttccacatcctcaggttaaaggaaggtccttgtgcagcagctgcagtcccagatgtgccaacatctggctcggggtgcaggtaccctggaattttctagctaatgagatgtggacacatgctgtatttcaaggacacttgcttctgtaatatgtcaagaagaagatggaaaagtccatctagagatcttttttttgtttgtttttggcacaatgcatcactagttcactacctagcaagtgggagaagctttagcaacttcagcagcggtttcacctactcagtggcttcagtcacttgcagaaaggaaacgtactcttcattaagcagcaggagcatgttatttttgtctagaggaggtcagtcattatggattcatgcattttgatggcccgtgtagtctgtcaacctgcagagatacacaaaatgcatctaaagatcgaaagactctttaatcactctctaggtgttactctacattaaactttctggtcggcacattctcctgtggctttggaatgtgttgacgcatcgcggtctttgaagaaaacttgcactgtgtattaaaaggctaagaaggttccttctgatactttcacagtattgggttaggttttaaaagactcaaaaataatcattgtttttgtcttccactcagaacaagaacatgtactgtttacagaagtctgaacgatgatggtctcgattccacacagctaaggccactttatctcaggagtctgaccatggcaggcacaggcatcaaacaagtctccttctctctctttctcgctctcagccctcaagtctggatgatagaagaggcagccgcccccggtccatggtgcggtccttcacgatgccttcctcatcccgccctctgtctgtggcctctgtctcttccctctcatcggacagcaccccttccagaccaggctccgacgggtgagtcaagctcacagcagggctgagctgagcagtgagggcttgggggatctggaaggagccacccagggctctgggtttattttcttacaactgaggattttgtgttcatcaaaattatctttgaaactgagaccctccgagactttctgaccgtagtgcccaatattactttgaggtcgtgtgagttgttgagaaaaacatcctctctttgggtaccactttgggtgaggttttcatccaatttagaacctccagtgagtgttcagtcctcttcagcatggcttagaacaagcttgtccacccgcggcccacgggccacatgcagcccaggatggctttgaatgtggcccaacaccaatccataaactccttaaaacagtatgagattgtttttgtgatttcttctttttttttttttaatagctcatcagctattgttagtgttagtgtatttcatgtgtggcccaagacaattcttcttcttctaatgtggctcagggaagccaaaagattgggcacccctgggaaaaagcaaggtgcagtccgggctggccaagcactttgtacttttcatctcctgttcacctccagggtgttgtgcccggacaggagctggtgtggtctgaccatgacacaacctccactgtccccctgtgacaccattctgccaagccaactgtcacagagtcaggctttcatgatggatggccgggccttcttttttttttttcttttcctcccttcctcatttttttggagagcaaatgttttgtttatttttgtttctgctgaggtttattgccttttaaagggaaatggtgtttaagtgaatgcttctgagaatgaccatctgtccctactttttaggacaactctggaaaataaaaggcatattatcctttttaaaaaattttgtttttgaggcagactctcactctgccacccaggctggaatgcagtggtgtgatcacagctcactgcagcctccacttcccaagctcaagcgatcataaccatttgtaagtgaacagttcggtggcattgcgtacgttcacatcgctgtgcagccatgaccaccatccacctccagaactctttaatattgccaaactgaaactctgtacccatttaacaacaattccccactctttacctcccatattgattaaacactaactttgcattctttccccccacccctgacaccctgacaatgtctactttctttttttttttttttgagacggagtctccctctgtcgcccaggctgagtgcagtggcacgatctcggctcactgcaacctccgcctcccaggttcaaacaattcttttgcctcagcctcccaagtagctgggcctacaggcacatgccaccatgcctggccaattctttgtatatttagtagagacggggtttcaccatattagccaggatggtctcgatctcctgacctcatgatccgcccgcctcggcctcccaaaatgctgggattacaggtgtgagccaccgcgcctggccaacgtccactttctatcactatgattttgactattctaaatactcatgggccaccttctttgtacaaggccactttggagatgcatttttgctcttgagtacccaatagttaacatttattgagcacacactgtggctctggcattagctcaggttattgcaaagagaactgcaacattggtatttttttgtatttttgagcggcaagcatgtaaagtttgttcttctacaaaaagaaaaaaatgttgcatgcaatttaaacaacacagaagaacctctaattgttttactgctgatttgtacagttgtttgtgtgtccaatcccattttgtttacaatccatcaccctatcaaacccacaggcatctggccccctcaacacacagaaacaaacttccagagagccccaagggacggctcaactcggattgccctttgttgccaacgactgatgtgcccgatggagaattgcaaactatccccatattttttcttaacagtaatttttatcagcgtctgatatttataaggccaagtccatatggaaattctcaatttagaggtatttaaatcatgtgtgcttgtcacttacagcaagattgctaaagaaatttaattcaacttctccccgagaaaatccccggactggttatggaaaggtttttatatttctaggaacataggggttagggtggaaattaatggagaggttttagacagaagagtggtgaattgcacatgtgagctcgggctgctggctcttccccagaaggcatttgtttaacctttaactggaaggcgtctttattacagtccagatttgtgttcattcttggggttaccaccctttgctagctaactaatgtggagaaaatgaggctttggtctcaaatggcacaggttacatgcagaataaagttcatcctgtaggcagttgcttctcgtaatatgaaaatttaaaactccacctgcctttctctgggttctttgtatacgcatcaggatttcacaacccgggtcttctccctgagctaaacagcatctactaatccttttcttacctacattatctcaagttctgctaaacctagaataaaatcatgaaatgtttggttgttgcttataatagataaaatatttctcacctaatggatatggatgtattgtatatccagtgcgaaaagtccagatgtcccaaaatgccttaatgatctaagtcaatattggtatattttatcaatcagtttaaattttttaagcattttagtatagaaaaatgtcaaagctgagtacagtggctcatgccgaaaatcccagcactttgggaggctgaggcaggtggattgcttgagctctggagttcaagaccagcctaggcaacataacgaaaccccatctctacaaaaaaatataaaaattagctgggtgtggtggtgcatgcctgtagtctcagctacctgggaggctgaggtgggaggatcacctgaacctggagaggttgtggctgtagtgagccatgattgaaccactgcactccagcctgggcaacagagtgagactctgtttcagaaaaaaagaaacatttcagatatgtacaaagtgggccaaacagtgtaatgaggcccccatgccccatcatgcagtcttgacaattatcagcttttaactaatctttttttttcaatctgtatcaatcatattttccagcaaatctcaaatatcatattttatctatagctatttcactatgaatttctaatttaaactcttttttaaaaccataactcggttatattatataaactatagtaatatagtttatttcacaccaaaaatattgacaggaattccatattataataatacatgagtgttaatttcccattgtcatgtctttttttttagttggaggcaaaatccaaataaggttcccaccttgtaccttgcacttggttgatattatctctttaagtctcttttagtccccttttctcccttgtaatttatttgtgggaaatcctaggttgtgtatcctgtcatggtccccaccatcaggactctgctgatagcgtgccctatcgcattgtttaattcgcgtctcgattctccatattccctgcatattggtggttgaatctagcgatttgatcagattcagatttgatttagggacaagatgacttcataggtacttgtgtgttcttccattcagaggcacatcataacctgttctctctcttatggagatgttaacagctattgataatcagtgcttagattcaataccattattgtttacatagtgacctgcagcagatcctactgcacagccatattagatgagagaagcaaagaataggtggtggtccttgctctgggtagtctgcatcttcagcagatttaagcgcagttttgcaaatgatccttcccttcctggttcatcttactccccattatgggacacgcaacatggaaataatcaacagtgagcaaatcaatggggagcaagattgctgcaatgaccatctttttttttttgagacaggatctggctctgtcacccaggctgtgcaatggcacagtcttggctcactgcaatttctacctcccaggctcaagccatcctgccacctcagcctcctgagtagctgggactataggtgcacaccaccatgcccagctaatttttgtacgttttatcgagactggatcttgccatgttggccaggctggtctcgaactcctgagctcaaatgatccacctgccttagcctccccaagtgctaggattataggcatgagccaccatgcccggccctgcaatggccttcttaatgagaacagtggctttcttccaagtgtcccattcagaaatacatgtaagagaaactagagctaggatgaaaatatgactggctggctaaattatcttctcttgaaatcatgctccccttgaagaagccaattgcttctccaggcggtcaaggaagtcaggtttggaagttgctgtgaggctcagagctccaaagagcaggctgtattttgaaaatgtaagatcctagtaacagcactgccttccacgtgagttatgctatatggtttttcaggcgggcccatgccttcatccattcaaccatctctcctgactcctcctcacagcaggagctgctagggatgagactccagtcttagagttggatccatttcttccacctcctgataggacttctaggaccagaaacaggatggacatgccaatcttgtgttggagtgacaaatcacaatcatgtgtggatatgcttgcacactaaccttttggtacatgccttagacactagcctaagattcatttactccatggtataaccacgaatgtgtctttacagcaactgtggggtaggcagaagggtggtggtgtctttatacccttttataagtgagacagctgccagaggttacgaggacatcaagagtcacccacagtggcagacctagaatgcaggtcttctgtctccagcttagttgctggctggaaacctcagggcatctccaagcacctgtgagctggccctggcttgcttctgactgagccatgcaaagtgctttcacctgaaaacaaccgtctatctgtaatcatagagccttggtcaggatcaaggtagcagacatttctttgcattgacgtctatttttccccattaaaaaatagacaaaatatttctatataaatctctaaaagacgagggttccccttttgaaatatgccctaaataccatcctcccatcgtaaatgaacaattccttaatatcatcatcaaatatccggtcagacttcacatttgccctatcgtgctaagtgttctatctttttccagtttatctgtgttgggattgaaacacagtccttgcatctggtgactgtgtatctgaagtcacccttggcctcccttttaaatcactgctttcattgtaaatgtcttcgatggattgtgagtgactttacacgtgtctgtgggctggaaagcaattgctctcctattaagacgtcattgacctttcctttaggtttgccctggagcctctcctgccaaagaaaatgcactccaggtcccaggacaagctggacaaggatgacctggagaaggagaagaaggacaagaagaaggaaaaaaggaacagcaaacatcaagagatatttgagaaagaatttaaacccaccgacatttccctgcagcagtctgaggctgtgatcctttcggaaacggtaacccgacagggtatctttcctcgctctgcggtagcttcagggacctacctttgccccacctgtagccaacagggctgacagtgggctcttattgaacttgttataaattagcaactcagaaacctggggtcctcctcccctaacctcaaatgtcccaaggcagtaggacagccagagccacagagagacctggaggaaggtgggcttagcatttgtcccccttccgcagggcctggggcgaggccgctctgctgctaggctctgccgctctgttggacttgtttcctacacatgtcctaatatcccagaagatgagcaggagtccttttgttgtcaggaaacagtccttggtgtccgctaatgccttccccttgccccttgctgactggaactcttctaagctagttacggcccaagtgttaaaatcagcggaactagaatccaaagacctcttcccaccgggccccagaagctggacccagtcctggggtatcctgctctgtctcatctgctccacctttaaatctcctggccgtctttcacaaggacttaacagggacttcacatgacccgtactgctgagctgaccttgaagacgggtcccagtgagtctcgttcattccacagtcgtgggcgtgtgagggcggtgaaacccaggagccggctctcatcctggggctgggcctgagggctgatcctcccagaagtgcaccacattgggaatctgtgttcgtctgttttgtgttactgcaaaggaataactgagcctgcgtcatttatgaagaggttgatttggctcatggttctgcaggctgtacgagcacagcactagcatctgcttggcttctggtgaggcctcaggaggcttttattcttggctgaaggcaggggaggggagcaggcgtgtcacatggtgagaaagagagtatgggtggggggtggggggtgtgttccaggctcttttaaataactaggtctcacatgaactgatagaatgaggacccactcattacccccattactgcaaggacagcaccaagcccttcacgagagatctgctcccaggacccagatgcctcccactggccgcacccccaacatttcaacatgagagttggagaggacagatatccgagctgtatcagagtctgagtgcgaagatgaggcacagcccacttccagggcgaacttgattccaaaagtgctagctgtagttggaaacaaaaataaagaaggagttctcatgggctgtcagcatcaaaggtgaagtcaggattggagccgccctccctggaaatgggtgggtgtctgcttgtctcagccctgggcgtcggtgggctgtgattagagggttagacatactgcactgcttgtttataacttaaaacccagaaggtacgttttatctatacttcatgccactcagaaagcagtcacatgctacctggctatctagaggtggaaggcaaacgccccagccatgacttgacgtccaacaggccagcgctgctctgcggcctgtgggtaggtgctgtggctgcagctgggctggagaattcccatgagggtggccgaggatgtcagaccaggggggcactggctggaggctggcctgaagtacccagacgctcagcgtccagcagattgaggggttcctgaccacacagcatgctctgtctgctattctggaaagttgagatgcccaccaccccagaggctggctgaagtctccatctcttaagccccaggtagatttctcaagtctcaaaacattgtagctgggtaggggaatgaacagaagcatttttgaatattacttagtgccagacactgtgcaagtctttcatacattttaatttaagctccgttttaagatgctaaattggagggcctcggagcagttgtgccaagtggcagaattgatcacagctgacttgtgtgaaaagaagtccaaggacacaagcacacacgtgacaggcacagagccagcacagtgcatcttctgtccctgcccttggtggcccaagcatccttctagggtccttgcaagcagcagggctaggggcagccccacgagggctgcctccccacggctggccctagcaccctcagcaaatccacaggaactcaccaaggtcagagcacagaaccttggcggtgcttctcagcatctggcccagtgtcagcttgaaccttccagcaccaggaggcggagaatccgaacctcccactgggggacaggcttactattcttggtccagcccagcaacctgtctgtctacgcagagggcacctcctccaggggacgggtgccggcaaggtctgtgaggacagtcagacacctgaagtttcctagcaggcggctgcgtgccagtgaccagccatgcgcaggaggggaggtgcgggggaggaggttcacaggaacagaagcagcaacccattccctggggacaacaccagccacccccccaccacccccactgtagtgtcctccttgcccttcccccctgcgggcctcccctgcaccccagcttctgcaaaggttttccctcctcacccctgtggctgggttcggtttcctacttgatttgcatcatcaacaatttcctgacctttagctgagcctctccagccagagcctccaggctgtgatttgcatctcagcagtccagcctcctcagctctctgagtcagaatgtgccctccctgggatgcagggaggccaggagaagcaccttaggagaccccaaatctctcttgccagcacattcaccttcagagagcccagcgcttcacccggcctttcctgacttcccacagcagttttgctgcctggaacaaggccatttcttcagaggaggtgcagctcctgggcgcttggctcccccgacagcacaggacagttctggaaatagacctgttggcctggctctgtcactcatttaccagagggcctgaatcttcctcccaagcctagttcccatttcctccttccagcctcagtaacctccagactggccctggcacagctgactcctcctggggcagacattgaagcctatgtgctctgttgctcacccaaaccagcacagcgcatccaccaggcccccagacccagccgcagccccaagcccagagctgcccactcacctgcctgcccttccttgggggagaacgttgacccctcctttttggctgggttaatacgttttctaattactcctgcgtcagagtattttgtaactgctcctgttccccaaagcctgatgatctgagaccaacctgtaagaaatatgtaaatacaacttactgatggaacaaacagggaaagggcttaggtgggggaaagtcaagtgcctccaaaagccagagatgagcaggaaaaaatgcattgaaaaggagagaaaaagaatccctgcccagtaatgacctaggatgagagaagaagcaaaggaaaggaatagcaaaaatccttcagccaattcctagactttcaggtacacgccaaggagaccaaagcatgctgagcacagctgggaataattctgccatggaacaggccattgattttgttcttgaccgcacggatgttgccccgtgtgtccttgctggctatctgcatgtcttgcaataatactcagccacttttgcatctatattcaggtcacctgcgatgtgctgtccagcccaggctgtgtgaggacagcagtgccagcccctcgtgtgggggaggtctgctgtaaccacatgctgggcggctccaaccccagaaactcattgtctcccagttctagaggcgtcggcagggctgattccttcagaggctgtgagggagagtctacacatgcctctctcctcctgtctgggggtttgctgccatctctggtgtttcttggctgatagaagcatcaccctgacctctgctttcatcttcacgttgtgccctcccaaatttggacacgtccatgtccagatttccctttttcataaggtcacctgtcctgttggaattggacctgttactgggaagtgtgcaggtccttggttcttagtcttcttagaggaaagaattcagccaagagaccaattagtaaagtaggtaaagtaggcttattaaggaaataaaagtagcatggactctgggagaggagcaggctgaccctgtggagagcagcccccaggagttctgtgttgtggtttttatattggactgttttaagctcccacctctgtcttaagcctctccctttgtctttgtctgttttccctgctctgtcttaagtctccaccttttccctgcctagttcctgcccaggtttgtggggctctcccttgctgctagttgatgtgcacacgtggggctcagtgatcagtaggaacctacctaatggcggcattgctcattaccgccaccccaagaaggtcatacagtggtcaaatctgtacatactgtgtgtgtgtatctcttaggcattcatcccttgccctgtttccctcctgatcagcatgtagctagttacattgtcacacgttagctacagagggagcaattactgggtgtcttatggggtgtttcaggatgctgcctcctgcctaggtattctcctcccctctgctcacacctagcatgtgtgttttggggggtctctggggcataaggttttccagagtttcctcccccggtcccccattccttttcatgtcttactatctgcccactctaacaggcccaccctaagagccacaccttagcttgatcatttgcaaagaccctatttccagttaaggtcatattctaaggtaatgggggtcaggacttcaacataggaatttaggtggaaacgcaactcagcccataacagaccgtaactgtgctctttctgtccttttgatgtagataagtcccctgcggccccagagaccgaagagccaggtgatgaacgtcattggaagcgaaaggcgcttctcggtgtccccctcgtcaccgtcctcccagcaaacaccccctccagttacaccaagggccaagctcagcttcagcatgcagtcgagtaagtggaacgctccccacatacgaatcgtgctatagctccgtgacttcccctcactgaaggctctgaggttagaagcgcttcctccctccccttgcagcagagggtgggagtttagataaacacctggctccctgggagtgtcccctgggacaggctgtagagtctggacttccgcaaatcaggccaaaatccagagcccaggtctccagcactggaggggcagaaagtgcagggtctgtcccagggtccatgtggaggggacctgtgaagcacgtggaaccaccacactttctatcccaggacgcagagctgcaggaggccgtgggcctgcttgtgtctaggactgtgcgctggagaagcaccttcaggcagttggcaacagctaaggggcacagcttatttttctagttttgaccaatgtttaaattaccctagaagttcccacaaaactggtggctccaaacagcagaaatttgttctctgaaggttttggaggccaaaactctgaaatcaaggaggtagcaagttggttccctctggtggctccaagggagagcctgtcccgggcctccctccagcttctggtggctcccagcagtccctagccctccttggcttgtggccacatcactcccctctctgcccctgtctccacgtggcctccttctcggtgtcctctcttcttacaaggacatcagtcattggatatagggtccactgcaaatccaggatgatctcaccttgagatccttcactaattacatctgcaaagaccctacatccaaataaggtacattctgaggttctgggtggccctaagaggtctacattttggagagactctactcaacttactctaagtggcagacagcttttcaccactagattcagagccagcagagaggagaaatcttggcagggagaaggtgctgaggatggggacggcagcagaaccggggagcccactctccttcctgtggcacagagaggggtcccaggcaggaaagctctgtgccctgtggcgagggctgtgcaaggcagtgagtgattgtcctctgctcctgattttcctcttgctgaaaggggagcagtcatgattctggagactgtcagtgggtggggaggctggctgcaggagtggatgcgtgagtctaattgagtaggcaaagagctttctgggcactggatatgtctttggagggtgcatcttcacatccttgcactattactacatgatctttctaaaaatgtgtttaaaatctattttaatattgaaaacagacaccatcactgctgctgcggaaaacaatttagtggttcctccaaagttcaatgtagaataaacctataatatcaactggcagtcctgcttctaggcctgtactccaaagaattgaagacagggactcaaacagatacttaatattcatagcagtatttttcaagagccagtaagcaaacacaggccaaatgtccatcaactgatggccagattaacaaaatgtacgtccaaagaaatgtccgtgcaatggaatattacccagccgtagaaaggagtgaagttctgacacgtgctacagcacggacgaacctcagaaccatgatgctgagtgaaatagatcagtcacaaagggacaaatattatatgactccacctaaatcaaatatctaaggcaagttcatagagacagaaaggcatggctcacgcctgtcatcccagcactttgggagttcgaggtgggtggatcagctgaggtcaggagttcgagaccagccagtcaacatggtaaaaccccgtctctactaaaaatacaataattagctgggtgtggtggtgcgtgcctataatctcagctactcagaaggctgaggcaggagaatcacttgaacctgggaggcggaggttgcagtgagctgagatcgcaccactgcactccagcctgggcgacacagcgagactccatcccaaacaaaaagaaaagaaaaaaaaaaagaaagtagaatagaggatactaggggcgggagagaggagtggagagttactgtttaatgggtacagaattccgtttggggtgatggaaatgtttcagaaatacatcatggtgatggttatcccccacggtcgatgtgattaatgccaccaaattgtcccctaaaggatggctaaaatggcaaattttatgtcgtgtatatcttaccacaataatagcaaagaagtaggcagcaatcatgaggacagtcactcaccgaagccttcgtatttccctcagccccatggcagagcttccttataagcttacagtgtggccttcctagcatgcattttcctaataaaggatttttcatcagatgaatcctaggggaaaactccaaaagagactcatcagtaaaaatgtccatttttctctctttaatataaaagaaaacaaattatctttaagagtctcaacaaggtttgagaaaatatcctgccttaatgattattcctccgtttgaaaacggctattttttccagtttactttaaaaatcaattgtacttccccttggcttatttaaagcaacagccacagtgactgctatggctaatgacttcatgtcatacgactgtggattttcctgtggaaagagatgggaagctgggtggctggtcggcgtgttagactttgcttagtgaatctctccaggtgataactgcaggggtgactgcaggggcctggcttggcttcgaaagcagtagcagcagcagcggagacggtcctgtggcacccagctgtttaacttccaccgaggcagggggcccgagcagggacagaagaggccggggtgaacatcaccctttctacagtggctcgatgccttgcttcacactccagttttagtgttcgtgtgatacttgctattctctttctagaacattgccgttaggagagggtcccaccctttgtgttcgctccctccctgccctcatctgctctgttgacaaacgttttctgccagatgaagtgtttctgctgtgcctgcctctctgggagggaacgtggagcagctccctgagcattcaggctccgtggggaagtcggactgattttaaatagatcccggttttccaggcttggagctgaacggcatgacggggacggacgtggccgatgtcccaccccctctgcctctcaaaggcagcgtggcagattacgggaatttgatggaaaaccaggacttgctgggctcgccaacacctccacctccccctccacaccagagggtaagtcggcaatctgaaacacaggctttcattgcttcgcctccacaaagtaggacgagtccctcattccagatactagcaggtttacttcgggctagtgagcacatgaggaaaaccatgtatgatgggcccgggtttgattttgcaaaaagatatcgaagcagtaaggactccagtgggtaagatctgtggctctgcgtcattatcaataactgcatcaaaaagcacattttgatatcatgcctcagaacgaggaagaggatagacattccaaggttgtcatcggttatcatcaccatggagatcattccactggagatgcaattctaatgacattttgatttttgagaagtagcttttctatcaagaggtctgactttttaaagaggttggccaatatcgccctgtatggcaggcacctgttgtacacctgcttggccctggagaagcttgtctccaaacatccctccaggcagtctcacctggtgctgggagctcctgggtggtgacaggcactcaccttacggagactgcagaggacagccaggtttggctcctgggcacagtcatcctcactgtgcccccacccctgggcaccctccccagtgctagttcgggggtgctgacctggcttcctccagcagcactggcctttgtaagcctaagcaacctgctggaacccctcttcagcgtgagtccctgaagctggtaccccccagcagctgttttagtcattcatgccacctaaagtgccttttgccaaacagcccctgggcctgcctgcccgtacaaatattagtcaaagtcatgaaaagccatttaaacaagcacctcagttaccagttgacagttctagaaacattcttttgagatccaccccgttcctctcctggttctcaaggatgctgtcaggcgtcactcatccctgcgggtcccagccccatcctcatgtcgggcccaggcatgtgtggagggcagcatgagtgggatggaggcgggcgagcgattgactcagccacggcgggaacttctgcttctaggctcaggcctccccaggccatgttattcacagcctttgacaattaaatcagtggtgtctgaagggtaaaatatccctcttcatatgtggacagctggccgtattttttttgctatccagccttagtgaagtaattatatggccgcaaaactcctgtagaacattgaaaacatgagattgttgggtggctctgtttttttcataatggtgagacatggttttttttttttatttttctttaataaacaatataaatcccacgtgccatttctttttctttttttttaatggagactcgttgacggagtgttccacaaggtcattacatcccttatgagaggagtggaagagagagggtgtttgtgtacagcatacgtatttcatcattccctttgtatcagaaaactaaacaagcagtcatctttaatatcaaagaggcagattgctcttctgagacccaagtgccatttaaacaggctccctctccctagagacgcctcgatggggaaccggtcctggaggaggcaccaggttcccctgtgaagagggctttctggcaggctggaatggtttgttgcaccacagaaatggaagccggaccttccccggccatttctaactacttgtgagagcaaaaggagattcgggggggtctaacaagaatattgggttgcttggagtattgtttccctaacagcttcgttaattggtcacattttcatctctctattttattgcaaaggcaggaatgttccccctagtctccctacactagtaaactgaaaattctaaacttagaattacagccaattcctcttgttacaaatcaactccggggtaacattttattgtctcaatttcttggatacaccattgtgggttactgatgccacatacagttgattaagtaagggataacatggattagctctctctcaattgataaagggggtgtgaattcaattagattaatgacccaggtgtctttggtctttgtttcttgtttaatttacttgcagcctgagtgcatgctcaggtgacacgctggtggttagtatgtcatcattaggcagaagcggttgcatttcctggggtgcctccctttgcacaggccctgagagctgttctaggataatgatcatccatctgccatgatgggggtgtgatcaatatcctcctgtcactctcattgatcagcctcaggcttgtaggcaactctgtctttagttgttgccactaagctgtcatttctttccaaatggctcttcctgtcagtaatctgagcttactgagtttatcaccattaatcattttgcttaatggtgataaacttttgacatgctcatacttggcatagaggtcatttgcagcgctgtgttggtatcaggctgtgttagtgtggtccttacctgctcctcattgggctatcagtgagtgtggctttcacatgtaaacaaacagtttcatcagacctcaaaatagatgtctcttttaacggttctaaccaaccttaaaaagacttaattgttgttttaccttccttaatataaggtcatatactcataggacatctttatatcagctttacttttccacatttattctcctctctgtgttaagcattaggtcatttttgtatttactagtctgtgaatcaggaggaaatctgggcgatgagtgagagactactgcgtcactgtctatccttgaaaacctcttttctcacattcagctaaatgcaaacccacactgagaggctgataaaaatccactcttacccttaagttagacaatagtgttctgtgatttcattctggttcttctgcctgtggcatgctcccacttaccctggtctgttcacttcttcattcatttgtttacttacctgttcatttcttcatttatccactgactcgtttattcactcattcatttattcactcattcatccatttttctattcgatcgacccatatttctagagagtctcctgcacatcaggtgtgtgtgatgggcatgagggtcccaaaagcaatagggtgcagctgccctcagtcataacactccagccaggtccatcagcaaggggtttgctattatcttcacattggaaattaatgttcttttttggaatctaaagtaatatatgcccatgagctgaagccagccagccagccacctgtttctgtgaatagttttcttggaacacagccacacccctttctgtacacactgtcaatgaccgcttttcggccacaccagtggcattgagtggctgcaacagagaccgtgtggcctgccaaaaagctggaaatatgtactgtctagccctttccaggagaagcttgctaacctttgcccgaagctcagaaagcaaaagaaggtctctcatctcacccctggagagtgcctctaaggacttatttatcccttagacaatagatggataacttggtcgatagcatctagatttaaaaaggccacgcaaagggcaatggtacctctcaggggctgtgcagacggtgggagagtgctcagaggcgtcagaaaggcccaggcccatagcagcccagtcttgagcctagtagacctgccagccccaagtcggacaggatggagcccaactcatgtggggaggatggttccggctgagtggctgtgccaggtcagaccccacctggagacggtgtcttttctgtcaggacatcagttatgtgacatcttccccatcctcatgttttttagcatctgccacctccactgcccagcaaaactccgcctcctccccctccaaagacaactcgcaagcagacatcggtggactccgggatcgtgcagtgacatcgcaaggctctctggaaagagtgtgctgcccctccccatctccatgccctctccttctgtgtcccctgagtctgctgtttacctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgctatcgtagttatcagagttgggggcctctgagtgtgtctggctctgagagagtctgagtcttgcccaaacattctttctttttgtgccaaatgacttgcatttgcaaagagctcaattgctctgagctcagccaagtaggagaggctaggccatcactcttaggaagctgtgtagtgatgatgtataagaatcctcctcactgtcatgggatgttgtatccagcccctccttgttccagccggtggtgtgacttcgttggttgaggtgtgtctccaacctacatcagaccatgaagttcaacccctccagggaagctcctgatttcccctgcataattgaaaataggatatttctcagctattgaacagttactaatttatggggtggaaacagcattaagaatactgaatcaaatggaaaaacaaatgaatacaggaagataagtgttcgttcttttctgaaaaagagtatgtgtaccacaagagctggttttaattgggtgaattgtttttgtcctcattctgtacagaaatttgtatatatgatggttcttagaacttgttttaatttttgtggtccttctgtttattataataggcgtccaccaatgattatccatatgtgttcttaatttttaactgctggaagtgttaaaacacacacacacacacacacacacattttttttttcagaactccaaagtcctgaaaattttggtggacaatgatttttaaaaaactaactttgtataacctaatatttgtattctctcatctatatttttttattcactataatcatgatactcttctaatagacttaaaagttaatcattgacaacgaaaaataaaatgttattttaaaagactcacagtgtctgaccaattatgttttcatccttgattgtaaaatacagacgctgctgtttctattctgctatgttaaagtgcttggtgacacacatttatatatgcacctcttcctccaacattgtttttaatcctctctgttaattatgtctgatctggagcccagatgggaagtgcccgtgtcccgtgcatggctgcacgtcctgatagacaggagctaagcagagaccagctgagtgcttccccatcaccaaagccagagggctgtggggctgcagatcatgtgggcctcttttcagctgctaatttaagaaagggctttggttaatgggtgtgtgatttagctgtagaggtctggacatggagagctttctccagggcctatctggctggatctggggtggcaagaaacaaggaaggcagggggttctcttctcaatggacggggctctcacctctgctcctgccagacgtgtggaagccataaggatgtgccctctgcccatctaacccggcctagaaggaggctgctgtggagcccaggaagctgggaggctcttcctcctactcaggtgctgtccccagcgtattcatgcttgtaaatatccagtccacccctgagaaactgtaggcctgtgtgaatgtgggatttttttcttcaagaatctttactgtttcaactgttgcaccaagataaatattcatcttctgtcgagtgtgtgagaaactgaatattatccacaaccctagaaatcgtcgaatgggcacacccatgtaggcgaccacggagagcccagcctggggacaggttgtttttgggcagtctgtgcctcacattgtataagcggccaccagaaacggaaagaataggccgggcgcagtggctcacacctgtaatcccagcactttgggaggctgaggcgggcggatcagctgaggtcaggagttcaagaccagcctggccaacacggtgaaaccccatctctactaaaaatacaaaaattggccgggcatggtggcaagcgcctgccatccggtaggctgaggcaggagaattgtttgaacctgggaggcagaggttgcagtagctgagattgcaccattgcactccagcctgggcgacaagagcgagaaatctgtctccgtctctatctccatctataaaaataaaataaaagtatttatttttataaatataattgtatttataaaaaataaaaattataaaatttataaaatgatataaaatataattgtatttataaaaaaataaaaacacagaaagaatagtgcctggccctgtgataaatgatggttttcttgtggaatgacgtgtgggctcctgctcttcccccatctaccgggttaatcctcgcgctgcacaaccctggctggaatccccgccccacaaccccccaaggaccttatatccgtcggggatctctagagctgggaggtttgcagagaacacagaacagagttaaagaaaagtgaagacagccaaaaggttgcagacatttcctatttattaatatgaattacaaatatgctaatatattcaccagtgagtaaacttctcaaacgtttcatgcagatgcaacatttcctcagcttgtaaatccgtggatgggctgcaacacaataatcagagacaaaccggcctctgcacacagtgcctgctacatgcattccttctggaatgtggatccaggggaaggtttgcctctgtacatgcggggacatatcccttctacacagaaacactatttcttaacctttttttttttttttttcac

SEQ ID NO: 14158 - DNA, 105210 bp, Human
aatacctttaatacttgcatcttccccacactctccagggcctccgaatgggcagggaagaggaagggtcatggagaaacagaaacttaagctgtgtcctttaaaacacacaagaatcccttcaaggagaatacttacttcttgagaaactgctcaaattttaaaaattacaaacaacaatctatggtttggaaaatgttggaaaaacagaaaagcatcggcctaaatttaactgagaaactttgtaggctgttaattttgcaaaccacacatccagcattcttgctttgttctctacacatagactgacacctttacccccagaggtcaggccctcgattgagttttacctcatgggaatgagttcccagaaagacaacaatgacgctcgctggtgagtctctctaagctgcgtctgccaagttcccagaagcctgaaagatacaagagtatgtataaatatctgcttctccaggctaggcgcggttgctcacgtctgtaatcccagcactttgggaggccgaggcgggtggatcgcgaggtcaggagttcaagaccagcctggccaacatggtgaaaccccgtctctactaaaaatacaaaaattagccgggcgtggtgttgggcgcctgtaatccgagctactcgggaggccggggcagaactgcttgaacccgggaggcagaggttgcagtgagccgaaatcgcgccactgcactccagcctgggcgacagagcgagactctgtctcaaataaataaataaatatctgattctctcccacttcacaggaaaataaaaaattgcaatgctcccaaacccggggcacttctaactacttgatatgacagcaaggtcaacgtggaaggtttttcaaaatctttcgttcagaccacagaggacttaagcaggaccgctgctcgccagggtgctcagattttcatgcataagagtcacgaccagatggctcatccctgagatattcgtggactgggaggcgagcagggagcacaggcgagtcctggcggacagtcgcgaagaccccgcacgcgccctgggcactccgctatccggccagcgtccgcactcacccgctagtcgggcgcagggctagcgagatacttcgcagcacggaggccgtcatggctaccctcgccgcttccgggcgtgcgcccctccacagtccggcccgcggtgccccctgctgaggtccggcagaccaggcgcccagcgctcaggcgttccggctgcgtgggctgggacgcgcctgtccccgcccccgacgcagccccgcctagggtgtcagctgcgcacacacgagggccttgcgtttcacgcggctcggggtcctcccttccgtccccgccctgggctgggagcgcgcctctgcagcgggcacagtctagccagtcaggccctagccggttggtcggtctgcgccctcgcgcgggcctcggctccgcagtgcagccggagcggccgagggggcgtccctctgctcctccgagtccaaatgttcatgtctaggcaaacggccccgatcttctaataaacgcgtccgccccagcctcccccaccagggttggctcgtcccccgcattcgttcgagtccgaagcccggatcgcattccggcgccggcgcggagcccggcgctcgcaagatgcccaatagcgcgtgttgatgaatgacggaagctagttaataagtcggactcagactggcgaggcagagctggtgacgggcggtccacgccacctgggccccgcctgcctctgcgggcggcccgggttgcaactgcaggccccgctcgctgtccgccgtccaggcgaaccgccctttctggggcgcccgcgcccgggcccgacccgaagcccctgccagcggaggagccggggcggcccagtccgcgtggggagcggtttcccgccggggcgatttggcaggtgcgcgccgtgacttccggcgttgcccgggagccgcctgaggaggagcggcgcaggggatgcggctgtggtggcggcggcggcggccgagcgcgggtggcggctgtggcggcggaggggggcgcgggccggcgatggcgcggcggccctgagggcgcggggcgggcggcggccggagggcgggtggcgcgggaggaagcggcggcggtggctccatggcccgggcgcgctgagggacccggcgctcgcctcagcccggcggcggcggcggccgaacaatgaagctcctgaagccgacctgggtcaaccacaatggtgagtgcgcgcaggggtcgcgggaggccgagcccggagtcgggtcggggtctggagtcgagtcggggcgcgcgcaagtcctgcctgtctcgcccctgacgcccggtacccggtgcccaagccaagaagccggcgggagcggactttgtcctcagcgcggagaggctggtgagccccagcacgtgctccgggttgaccgcagcgagggccatcttcgcccctggctcttgctctgagtcttccgctgcccacctgtggtccttggaggggccgcggcctggctcccaggagcgggccttggtgccagccagtgccttccactggtctgcatcgcccgagaagtgctcagacggtcctgaaggtgaaaccgggatgaaatcccccttgtggcctttcagtggcaggatgaagatccgaaatctgcaagagggactgttactgcccctctggatctggggacagtgcccccagttggggaattgtggtccctaaataggagggtttgggggccccgggcccccgcgaaggatccacgattaatgctgagctgggacatcagggtgaactagggttgggcagatagggcacaggtgtgttctagcagaggggcttcttagctctgtggcagtggctccaaagcacacccttggggaacggactcatccaccccatatcttgactctgatacagagaggctagtggtaatcagtttcgtcatagttctgccttgttggcagaactgctgcaggagttggtgtttgctccccgggtagatgaaaaaagcgcgcctccccctcccccaccccactctgctgacagcactgtagcacagaaatcaacccagggagactcctccagcccagggcctgattctggcctgtctgactgttgacaggcaaagggtcaccctgatgctgtcttgttcctcatttctactttgcagtgcgactacagggtgctaccgttttctttaggagcgagaatagatattttaacatgtggctttttcgttttgaatttggtcccaggatgctctctactaccacaactaaactgaactgatcatgtgtgtgttctcctcctgccacctctctctccttccatcttgtgtgacatctttcccatttttcagggactaggttcacgtgtttcttttgaaactgttcatcctgagttaccccggtagatgtgctgtatcactgtctgtgtgttttgcctggcatggaaggtgtgagggtactttccatatgcccccagggtagggactgcctcagtcccttctgtatgccctactgcattgaacaacctcttccacatgatgggtatgtgataaatattggctaaaacaggtaagaaagctgaggttttcataatttatcaagatgaagttaggtttactgtgcatgaaagccgaagccttgagttttagtttcatttctcctgttgatctccaagagcatttcctgatgtgtactgtgcagatctttccctggagaactggacaaatattgtaattatgaattatgatgcttgtgattaggaaaggaaaaatgttattatgaactagtttactgtgtgaaggtctgatagaatttttattttaaaatgctttacctaaatcagtttttgtgaatagcctacccttctccagcctctcttctactgtcatataacttgttcctttttgataagctcctttgtaggccaaaagttttatgctatgtaaacataagtaagtcaagatgcttaagtgacgaactaggtacaaatgaataagagactacactcagatcagcagccaagtgcatcagcctggcagagcaagcacaacagtggcccttattgctgagggcctctctacagccctagaatggagcatgataatatctactctaaccacttcatagtatgcttgtgatactcagttgggagcgtagatataaaaatgctccccaaactgttaagtgctttagaaatctgagataataagtaataataaaaagaggctgggcacggtggcacatgcctgtaatcccagcactttgggaggctgaggcaggtggatcacgaggtcaagagatcgagaccatcctggccaacatggtgaaaccccgtctctactaaaaatacaaaaattagctgggcgtggtggtacgcacctgtagtcccaactactcgggaggctgagacaggagaatcgcttgagcccgggaggtagaggttgcagtgagccgagatcgcgccactgcactccagcctgatgacagtgagactccatctcaaaaaaaaaaaaaaaaaaaaaaaaagatatggcaactctggcaggatgggatttaacttcttttaaacttgttctttgttaaatttcctttcttttaaaatctcatggaatgttcagaaggactgtcaagaggtaaattaccactgccctggaggagatgatgctggtctgaatcactaccgagcaggcctttaaatactgtaggagtattggtggctgctgggagcaggggctgctcagccggaagcctgaggggtgggtagtggccagtaaaattgtgcttgcttttgtaaagccatcattgcactttctggcttccttgttctatattcatgtctccaattttgtgaagcacaaacataacttttttttttaatagaaatgggatcttgcagtgttgcccaggctagactcaaatacctgggctcaagggatcttcctgcctcagcatcctgagtagctgggactacaggcgtgagccactgcacccagcatgaacatactttttctgtttttcgagagtctaaagggggaagtagcagacagctcagcatttttctctggtgtggcagggaatccattcaaagtggagagggtagctagaacaggagaagaagtatttattgaaatgtgggtgtactttggtcttcattttcttggctgataatagagacacctctaaggtagggtttcccaacttcagcaggttgacattttgggccataaaattgtgtgattgtcatctatgttatagaatgtttctagtatccttggcctctacccaccagatgccagtagcacttcacaaacaccttcttagagtaagttgatacaacttctagttgtatcaaccaaaaatatctccagtcattgccaatgtccattggtagccaaaatcacccccaattgagaagcacttgtctaaggttatcaataagttaatcttgaagttgtcacgttgtagtgaaatgagccttgaatgtggaatcagactgggttcaaaactgcatcatttactagctgtaaattcttggacttataactctacttctgggccttggtaaaataagacttacctcttccattttatcctgggaccaaatataaaagattgttaaattgaaatataatagctatcatttatatagaagatgtgtcagttattgttcatacatacacattttacttcgtgttcttggatacagtattctctatatattttattttagaattgaccaaaataagctttatttctaagttaggttaaggtcagaaagtaaaaacaactaggtttctggttttaaagtttgtagaaatatggagtttgtatgtttagaaaatctcgttgagattcatggctcttcccaactctgggcctttgctcctgagttttttctggaattctcatgcctgggcagacagcgcttatgctcagctctttggtgaagccagttctaaccaagagggccaggactgaaagagctcttgtccacctttggcctttggttcacactttgatggcagtgttatgaaaagggatttgggaaattttcaagaacagggtaatttgctggtaatcacatggccttatggtgtgtattttctcctgtcctgcgattggattatttttacccctaccttgtgtcattctgaaaaggatttgaagctgtcctactgagacatcagcatgaaaattaaataattcagcttgaagggaaaatgtaggcagaatcatataatgataaagttaggagtgggtgggtaaggtccagcctgctgccggagggcactgcagacctatgtctgagaattggcagggaaaggatcctaatggtgaggttatatgattgcagtggttgagagataaacatggcagttgctttagatcagtggttctacagggcaatgtctagagacatttgtggttgtcacaacagggttgggcagggtacgtgctactggtatcaagtgggtaggggacaaatctgttaaacatcgtatagcatgcaggacagcccactcatggagaattatctagccccaaatatcaatagtgctaagggtgagaaaccccgctctgaataagttatttgccttttggtgtatttgtcttacagttccgactagactgtaagtttcttgaggacaagaattttgtcttctgtttttggaatcagatatcctgctctggagtctctgtgccctgctgcttactaaatatgtgacataaaaagtttttccatctcttcctaatctgttcatgaagtcagtaattcttgcctcacctgctccatgtggtagctcagaaaatgcaaattctctcagcaatttctctcctgacttatgcctgaagacagtaggttgatttaggaaaataaccagagtacatctgaagagtcagaagaaaactgggtgagattttgctgtggatttttcactgatttatgcaacaaacattgaacctttctggtaagagttctgtggggaccagaggtaaataaggctctctctctgaacagaaagctgtgtggaagatagatgagagagattgacatacaaaccgtattctagaatgcagggcaggggaaacaggagctagaggaataagcgtgatagcccaaggaggaagggcacttcaccagcagagtcgggtttgtggatgtgtccttggactgaaccttgacgtgactagaattgtgatggcagagaaggcgctacagcacatgagaccatcaggagaaaaggcccagagggtgaaagcatttagggaaagacatagaacatgttaggagggaggctaaacagggcaagagggagaatggggctgggaggcagagccttgccagcagcttgaacttccttcttggggttaggggagagaggagaacattgaggcttctgaggaagctggatgaaacacccaacctgtgtcttaggcaggccctagaggagttaggaatttctagtcttggtgagatgctcagggagacagggagatcacaggtgatggaggtgagaaatagagaggcactaaagacagggtagaggtagaattaatgggacttggccatgtaggcaggtgactgtagatttgggccactctgaatgtatttatttacttatatattttctttatttattttgagacagagtctcgctctgttacccaggccaggctggagtgcagtggcatggtctcagctcactgcaacctccacctcccgggttcaagtgattctcctacctcagcctcccgagtagctgggattacaggcacatgccaccacgcctggctaatttttgtatttttagtattcggtatttagtgtttttgtatttttaatacacattttcgccacgttggcctggctgctctcgaactcctgacctcaggtgatccacccgcctcggcctcccaaagtgctggtattacaggtgtgagccaccgctcccagcctctctctgaatttatttctttaatatgctgcagaaagaatatggatgaaggccaggaaatgggattttcttaaacatttgttttactctaagaagtggttgaaaactattttcactttatgagcagaatcatagttacacagctgggagggacttctgaggagcgtctggccttgaccactgaagccaagtaggagacctgcttccactgtgctgatcttgggtcctgtcggtgaccaggaagaggatgctctgtgtctggcttgacccctccctttccccagaggttgctagcatgttctgttcatccggggtgtttgcctatggactgcagaagtgtctagcacatgaaccagaggtatggaatgagccctggggaccaaaaatttatgcaaagcacattttatcatcctgccagagtcagcaacaacacctagaagtgagtgggattgtgaacattgtgcatattgtcaaatagcacaaagggagtgttgcaaatattgtagggttgcctgccttgttccttgttagcagaaccccaatttttttggtctgccttctgcaggccaacctgctgatagccctaagctgatgtgtgggtaaatgccaaggatttgttgaggaacagccatgtgatgccattttggcccttgagactaggaggggacgtctgctgggacctcctagggaattaaataagaggagatgcttgacaggctagtctcttctgctggactttactaggtctgcgtgtaaaagccagcttggaacagggccgacactgatgacaggagaggaagacagagggacacgtctctttaagttgctaaattaatgcaccctgaagctgacctatctcaggacttgttatatacgatagaagattaccctcgaaattctctatgacttgcagcattacagttcacagatggaaacttaggctgagtgagatgaggtgaccccctggcaccaagattccactagatgtgatggagatgtgttgagagtcacacttagactccagcccaagcccagacttactctttctaatttgctaagcactggtctttgtgctgaggctggccactccgtcctggagagcttcaggcccatttcctcctcagaaggacagctttcagaaaccacgtggtacagcatgggaccaggagtctggtccctggagcttgtcctctgactgcttctgtagccattctgagtgccttggggcttctaacctggtaggtttctcttgaaatgtgcttggtgagccttttctggcatttgattttcaagagttctctggttgtggggtatcgagaatgttttcagtgagaagcagaagggagaggtctgtgccccagccttggactttgggtcttccccattggctgattggtccaactaggtcatgtgccctctcttgcatcaatcatcgttgcctactggcttacataacgggcagagtggatatctgaataaaactggagttctattagacacctccctgggggagcatatgctcctggaaaacagactttgtctttgctcatgcccttttcccagggccaggaatggtacttggtacacaccatagtagtcactcagtaaatgttgaaggagtgctgagtgctggaagttggtgatggaaagtggctgatggatgggcagctaacagtgtctgttgtccttggctggtagagttgatgtactgcaaataaacttcttgttcatcctggctggctctttctagtggaatctgctggcaattccaatgatgaggggaaacactctgcccaagccttacccaaggagttcatttacatgattctgtcttctagagccttccattttaggaaaggaagtggatgaaacagatagcaaatggttttaaaacactcctggcaaaaagaaaacccatttagattaacatttgttgctcctaaaagcattgtctgcctcgatgcattaacaaacctagggtaggccaattccctgggaggctaccctggcaaaagccactgtggtgaagaccagacagaagggacagcaggccttatttgaggtccagggatagacctacgttggagcagactccaggtctgctgcatcctctaacagaaggtctcacatggaaaaaacagttgataaattcactgctgttttaagagctgaaaatgtgtgtgtgtgtgtgtgtgtgtgtgtgtgtgtgtgtgtgtatgcatgtgtgtgagtcagtgtgtgtatgttttcagctcttaaaacagcagtgaaccaagcagcatgccaggctcttgaggagcagcctgttatgcatcctggccagtgagactgggatgggatctgctgggggtttcctgtgtaagtggaaaagaggagatgtgggaggggagcttcctggtgagacacatagcggaatcacaaacaagatcctgtgaattggagaaacagcagacttagagatgaggaatgctgaggcagaggcgggggatagacgggtttaagtgggacgctttggcaaagcctgagtgaaaaggtaacatttgagcaaaggccttgttgcaggagtcagattctgagctgcagatttttgcatgcaggattattggggagggctctcgggatccacaccattgaaggagtgaaggaagcagcaccagacagagggagaaggcaagctatgatgtaagcacagagaaagccgcagccagccctgctgggagttctgtagctggggaggcccttcagaattgtcgtggattggggtgggagaccagggccctttactcccgtgtccacagcctggatataggctcttttggaaaggagacctgaccctgccaaaagagtgcttccactgagggcaggtctgacctggaggaagactacagggagctgttggggctgccaacactccacagatagctatgggagtgtgctttagtccctggagggtagggacctgggcatgataccacagcattcgctgcaggcctcatggagatgaggaaggtgccatctgagggaagagcattccaggcagaaagaagagctggaacttgcctggagggtttgagcagtagcacagatgtcattgtggttggagcaaggcaagggctgtgagagaggaggccagagagtgaatagcagactgattgggagagcctagtaggctactagaaggccttgattctcactgcaaggggagcagaggactactgtgatctgacgtgagttttagagatctttctgactgctacgtggagactagattggttgtgggggaccagagggagggaggagccaggagaccagttataatgccaactactggtagtaatccaagcaagagatggtctggatcaggatggtgatggctgtgatggcaagaaatggttggagctggtgggggagactctgtgtgtgtgtgtgtttatgtaatacattacatgtatatatgtgtttatatgtatatgtaatatatatatgtatatatatatgtgtatgtgtgtgtgtgtgtgtgtgtgtgtgtgtgtgtatatataaacacattcttttcaggtataaataaaatgtccagaccttaaatgtataatgtgttgacttttgacaagttaatgtactttgtaacctgttccctgataaagttaaggaacatttgcatctctcctgaaagtttgggttatgggtatgttgggaaggtagggtcaaatatggggtatgagataagatagaacaggccgggcatggtggctcacacctgtaatcccagcactttgggaggccaaggcaggcagatcacttgaggttaggagttcaagaccagtctggccaacatggcaaaaatgcgtctctactaaaaatacaaaaattagccaggtgtggtggcatgtacctgtagtcccagcaactcgggaggctgaggcaggagaattgcttgaaacccagagtgggaggttgcagtgagctgaggtcgcatcactgcggtccagcctgggtgacagagcaagactccatctcatacacacacacacacaaaagagttaagagagaacagaaggatgagttccagtctaagggcagagttgctatctactgagctcagtaagactgtgaaagaagttaggaaaaattagaaaatgcacaaaggaaaacacattgttaaaacttttaatgtggtctttcaaaccatttggaaaaaaacaactgggtgattttgtgattttagaagacgcatttagtgtatgcacattatacaagtgtctgaatttttttaagactttaaccaaatccccatcagtcaccatagcaaatccaatgtctttggtgtgtagcctcccttacagaccttgcattgtacagataactggcatagctaaaatgttgctgtgcatttttttttttttttttgagacggagtttcgcttttgttgcccaggctggagtgcaatggtgcaacctcggctcactgcaatctctgcctccagggttcaagcgattctcctgcctcagccttccgattagctgggattacaggcacttgccaccacacccaataaattttttgtatttttagtagagatggggtttcaccatgttggccaggctggttttgaactcctgacctcaggtgatccacccgcctcgacctcccaaagtgctgggattacaggcgtgagccactgcgcccagcctgctgtgcatttttcacttaaatagtattgtaggtttgttgtcttcttaattgtggttattgttgagctagcagatttttcccactatggaaatgtagcttttaattttctaatggaagtaggtggaagggactagatttataggagtacattttgcagataactttttgttgttaaatttaagggatgtaagtgcagttttgttacatggatatattgcttagtgatgaagtctgggcttttagtgcaaccatcacctgaataatatacattgtacccttgcagataacttttttttttaaagacaaggtcttactttgtcgctcagaatggagtacagtggcatgaccatagttcactgcagccttgagctcctgggctcaagcaatcctcctgtgcagatactttttagggaatacctctgttttgcaaaatgaggggggaaagaagtattaagaaacagaaatgcctttcgtcaaaacttttttgttttttggggttttgtttgtttgtttgttttttgttttggtttggtttttttttttttttttttgagacagttttttttgttgcccaggctgcagtgcagtggcgtgatcacggctcactgcagcctcgacctcccgagctcaatagatcctcccacctcagcctcctgagtagctgagactacaggcttgcaccaccactactgggtaatttttgttttttgtttttaatttgtagagatggggttcaccatgttgcctaaagtggtctcgaattcctcagagcaagtgatctgcctgccttggcctcccaaagtgctgggattacaggagtgagccactgcgcccaatctcaaaactttgttgattatatgttggcagatgcttcaggagaagtgattaaggtctcctaaatgatatacctgtgacacttttccactttagtttgtggcgcgtgcacacacacacacacacacacacacacacaatggttgtatggtgcaacagcttccttcctgtgctatgttttcaatctcttaggcatctgacacctatgagatgtcattgtgtcatgcttactaaagaagatggggataagtttttgtggtcgaaagtggtagagataacagcagcagatggctgtgaaccagccaagggtgtgcttcccacctgcaggcagttggcgaaatctgagtccccacagcagtagatcaggagcctgccttccaaagattgttacaccagtgatactgaaggtgtttgaatgtagtgcttctgtcatgagctttctccagccattcaacagcaacaagtttttattgttgtgcctgttatgtgccaagccacagctctgggtcctgaggatgaattagtgaataaaacagacaaaagagctgatctacttactggagtttacattctagtgggcagagtagacagacatacaataaaggaaattaatatgtaagaaattcccgaggaaataaatagatcaggactaaggggatttgttgtgccacattggggaaataatcctttaaattaaagttgttagagtaggcctcaatgtgagggtgacattgagcaaagacctgaaggaggcaaggaagagtcagtacaaggcccaagataggagcgcacctggtacagtccaagaaaagaggaagaccagcgatggtgggggttagtaggagatgaggtcagaaaagtcgtgggggcggggtggccattgtgcaaggattgttggcctctcctctcaaggtctggccttaactgtgttggggcagacagtgggtagagcaggtttcttggaaagatcagaccgttatagagaagatcagggtgaggtgtctagaaggcagtcagccataggagttacttgcatataggtcacattagtgtgtttggctgatgagtttctccagagggattgcttgttatagagtgtgcatattgtcacctgcacatgaaaagaatcatttttattatgacctaacctctggtgtttggatatttacctctactgccttatatattagtacacacacatatatatcgttttttaaaaacaggccttgtgtgtgtgtgtgtgtgtgtgtgtgtttatttcttatcgagatgattatagattcacaccgaattgtatgaaatactgagaaggtacttctggacttagtccagtttctcccaatgttaacattttgcaaaactatagttgacattgacatatgctacctattttttaaaatttatttccccagttttgtttgtacttatttgtgcgtgtgtatgtttagttctatacaattttgtcacctgtgcaggttcatgtatctaccactgcagtcgagatgctgaacagttccaacaatttttatatattttttatttttatttttttgagacagagtctcgctctgttgcccaggctggaatgtggtggcgcgatctcggctcactgcaagctccgcctcccaggttcatgccattctcctgcctcagcctcccaagtagctgggactacaggcgcctgccaccaccatgcctggcaattttttttttttgtatttttaatagagacggggtttcaccgtgttagtcaggatggtctcaatctcctgacctcatgatccacccgcctcagcctcccaaagtgttgggattacaggtgtgagccaccgcaccccgccaacaatttttataattacacccacctccctcctacactcctccattttatttatttttatttttggttttgtttggtttttattagcattttaaaaattgtggtcagatattcacaatataaaatttactatcttaatcatttttaagtatgtaattcagtactgtcacaattcacattattgtgcagccagtctccggaacattttcatcttgcaaacctttataccaattaagcaacaactccctattttcccctcaactcagacgtaggcaaccaccattctactttgtgtttctatgaatttgactattcatagatagctcatataagtggaatcctatgacatttgtcttttttcacttaccataatgtctttgaggttcatccacattgtagtgtgcatcagaactactttcctttttaaggctaaataatattccattgtatggatatataccacattttgttcatccattcatcggtcaagggacacttgggttgcttccacctcttggctgtagtgaatagtactgctatgaacatgggtgtacaaatagctcttcaagaccctttcttttggttatatacccagaagtataattgccaggtcatatggtaattatatttttaacaagagttacaatttctgtacaccctcatcaacacttatttcctgaggttttttgtaagtagccatctttttatttatttattttttttgagacggagtctcactgtgtctccaggctggagtgcagtggcgggatcttggcccactgcaacctccgcctcccaggttcaagtgattctcctgcctcagcctcccgagtagctgggactacaggcacacgctaccatgcccagctaatttttgtatttttagtagagatggggtttcaccatgttggccaggatggtcttgatctcttgacctcttgatccacccaccttagcctctcaaagtgctgggattacaggcatgagccaccgcacccagccgttagtagccatcttaatggatgtgaggtaatacgtaattgtggttttgacttgcatttctctactggttactgatgttgacatcttttcatgtgcttgttggttatttgtgtatcttttcttttcttttcttttcttttttgagacagagtctcacactgtcgcccaggctggagtgcaatggcacgatctcagctcactgcaacctctgccccctgggttcaagtgattctcctgcttcagcctccagagtagataggactacaggcacccaccaccacgcttggctaatttttgtagttttagaagagatggggtttcaccatgttggccaggctggtcttgaattctttacctcaggtgatccacccacctcagcctcccaaagtgctgggattacagatgtgagccattgcaccgtgcctcatttgtatatcttctttggagaaatgcctgttcaagttatttgcccaattttgagtcacgttgttgagtttcaggatttctctatatattctggacattaatcccttatcagatatgtaatttgcagatatttctcccattctatgggttgcctttttattctgttgatattttcctttgatgcacaaaagtttttaattttgataaagttcagtttatttttcttttattgtctgtgcctttagtctcatatctaagaaattattgccaaattcatggtcagatgcagtggtgcacgcctataatcctagcactttgggacgtaaaggtagcagatcgcttgaactcaggagtttgagaccagtctgggcaacatggtgaaaccccatctctacaagaaatacaaaaattagccaggcgtggtggtgcgcaccaggcgtggttgtgccctcagtccccaactactcaggagactgaggtgggagggttgcttgagcctggaaggttgaggctgcagtgggccaagatcataccactgcactccagcctgggcgacagaatgaggtgctgtctcaaaaaaaaagaaaagaaagaaagaaaaaagaaaaagaaattactgccaaatccaatcttgtgaagcttttcccctatgtttccttctaagatatatatgcaggtctttgatccattttgagttaattgtatatggtatgagatagggatccaacttcattcttttgcatgtgcagttttcgcagcaccatttgtaaaagagactgttctttccccattgaatggtcttggccccttgtcaaaatcatttgatcatatacacaacagtttatttctgggctctgtattctgttgttctaggtgtctgtctatgcctgtacttcactgttctgattactgtagctttgtagtaagttttgaaataaggaaatgcgagatcctcaactttgtactttttgaagattcttttgactgttcagagtcccttaagattccatgtgaattttgggatcgatttttttttttatttctgcagaaagtaccattgggattttcatagggattgcattaagcctacaaatcacttttaagagttttgacatcttttttttttgagacggagtttcactcttgttgcccaggctggagtgcaatggcacaaaattggctcactgcaacctccacctcccgggttcaagcaattctcctgcctcagcctcccaagtagctgggattataggcatgtgctaccatgtccggccaatttttgtatttttagtagagacagggtttctccatgttgatcaggctggtcttggactcccaacctcatgtgatccacccacctcagcctcccaaagtgctgggattacaggcatgagccactgtgcccagcctaacatcttaaagttattaaatcttctagtccatgagtacatatataatgttttttcatttatttgtgtctttgatttccttcagcagtgttttatattttatagtttcagtgtacaagtctttcgcctcctgggctaagtttattcctacaaattttattcattttgattctgttgtaaattgaattgttttcttaatttccctttcagattgttcattgttggtgtatagaaatgcagatgacttttgtttgttgattttgtatcctgcaactttgctgaattcattattagcactaatagtttttctgtggaatttttagggttttctacatttaagattatgttgtttgtagctgggcggggtggctcaagcctgtaattccagcactttttagccaggcatggtggcacacacctatagtcccagctactcgggaggctgaggcaggagaatcgcttgaacttaggaggtagaggttgcagtgagctgagattgcgttactgcactccagcctgggtgacagagtgagatttcgtctcaaaataaataaataaataaataaataagtttgtgttgtttgcacccaccttatatattttttgttttgttttgtttcttgagacagtctcactctgtcacccaggctggagtgcaatggtgcgcctgttggtcaggctggtctcaaactcctgacctcaagtgatctacctgccttggcttcccaaagtgctgggattaccggcgtgagccaccatgaccggccccaccttatattttagtattgttctgtaactgtttcatttaataaatgtttcaaacattttcttatttttaattctaaatttgtcaacattggttaaaaccaagttctattgggcagtgcaggaagtgttcccaggagcaacattcactgggcaaaagcctcaactttcccaagcttcattccaaaaggacatatgcacatgtgttccagtcagctctacccaatgaactatcagaacataaaagcccagagactttttggagccaaaccaaaggtctgtgggactgctgagagggaagggccagcagctctccattgtgccctctctgctttgcctctggccacctctctgtgctcagagtttaagttcccatgtttagtcctcttctaggaatctttcccctagtgtgaaggagggtacgattctacctgagcatgccctgtcataatcccagcttccttaatgtattctttattccctgccaggtggaaagcatttgtgctgctcttgtcaaatcagcaaatccccagacagtagacagtggctgactatattggctgtgtattgggtgtgcagggacaacattctgatctggggttgatctaaggataggtgattgcttggtgtctctagagtctagggtgtgttaatttgtcttttctttctgtctctattacaaagaaaggccagacactggaggtagttgggaactcatctttgtcatcatcatgctgtgccacaggaagagttgtctaactagctcagccagaaggtccctttccttagctccacctcagagagccctttagaagaggttcattcctggccgggcacggtggccgggattacccctgtaatcccagcactttgggaggctgaggtggtcggatcatgaggtcaggagatcgagaccatcctggctaacatggtgaaaccctgtttctactaaaaatacaaaaattagctgggcgtggtagcaggcacctgtagtcccagctattcaggaggctgaggcaggagaatggcgtgaacctgggagacggagcttgcagtgagtggagatcacgccactgcactctagcctgggcgacagagcgaaactctgtctataaataaataaataaataaataaataaataaataaatagtttcattcccactaatggaatgtgagtgactgctttccttgggatggaaaggcctagtgctgtaaggaggcggggagccagcactgcgctggtatctgtgtaggtcccctaccatatttcatctaatctgcatagcactaggaaaggaaacctggtgccaatgaaccaggcacgccttctcaaaataataaaaataaaataaaataaaatctcaaggctttgtagctgggtaagtggcagggctaaagattcagcccatgatgtttaatgccaaaacccaaacttgttgccagcctccatccctgccttcccctggagccttgaggcccccacccccattttccacactgctattgtggagccagaatgtgaatctgaccttggcattaccctgccttgaaagtacctttagagaaatgtctcagctccttactgatgcttgctgagccatctctgtctcctcttctttctcacactctctacctgcagtctgctctgcaacattacatcagcctatttcttgattccatgccgtgcgtcccctcagcctgaaaaccctctccttcacccgatcttctggctaactcttactcaacccttgggacccaattcagttattatttctgcaggaagcccgaggctgagtcaggtggctttctgcttgtgaagtgtccatcagtggacatcttactaggggagtttgtatgattatgtatctttactttctcattgcttagcctaatgcctggcacatagtagaaatctgcaaacagagactgagtgagaaaacatgcagttgatgctgtgagtgggcatgatctaaagcgcatgggctgtaattggttacttgtgcagctgagccctcagcacagcctggctcagcctgtacgtgctcttgggtagtcaggggaactgtgacttgcaggtaagggtttctggtgtgcttcttgaggggactgatgtaatacaatgtctcacagacttatggaactgaaaagcactccaaggggaggggaatgttccgccctgattgcccgtcaagaccaaagctgtcagctagaacattttttgttaaaatgacaaatgcccagctcaagctggcttaagcagaaaagcaaatgaattggcattttggtttatctcttatatgacaaacccctaaatttgctggcttaaaccaataacagttttattatttgctcataattctgcagcttgtcaggacttagcaggttcagctcatcttggctctatggaatctgctgggatggctcgaatagcttggggatagaacacctcaccaggcctgtgtctgtgaccttgattctcacttgtccgggctctttgatgctctacatgtggccagcttgggcctcttcaaaacatggtggtctcagggtacttggacttctcacatgacaactaggtttctccagagagccaaagttgaactgctagactcttaaggcctacacctggaactggagcaacattacttctgtcatttccctttggttaaaacgggtcccaggtgtttcagataagggatactcaacctatactacatagtgaccagtaagaaggaaagtgtattttatctcaagttcatgcttgatttgactacatggctgcggctctccacagctgggtgctgcctgggtcccatgctgggcagtgccttttgggcaccagcatttaattttcacacttgcatgggagccctggcaggacttcacagttctcagacagccactgcctgcccacacactcctgatcccagtacttgctgagtgattctagggctggtgactctggtactgtgtccacattgcctcctcttgggtgacagagacagaacatgttcaattaagagactcttggcaacagcccatctatatcagcaattgttgatgctcagatcattgtcatgtatctcctttgtcaatgaacaaatattactgcgctactgtacactgggtactgtgctagaggctgaagatgtgatgaactcaacagcaactgacatgccacttgtagctcttaaacctttgtcctagaagcagggagctggacaaatgcccaccaggcgtgagtgccttctatggtctgctgggtttcaagctcctacagtgcttttgccggtctgatccacccacccagccagccagctagcttcatgggatcctagtgcaagcctaggcccatactgggctctttggggcttctaagaactaatagccacagtcctttctcctggaggaattgaacagctaatttaacatagagtacaaactgtgaaggaggttcagccagaggagatgctgagatggcagacggtatgggaacttcacagcacaaacaaaagagggctgtttggaagcagaagtatgacaagcgaagcaatgctccttggttgcagccagcgctggtcctgctcagctgtcagccagaaaagacaaatagcactccttctgtctaggctgccagtcaagtgcagatccatgcaatagggagatgtctggagttacagctgtgtgcccttttcactaagtacctgagactcagaacttcaatcatgaacagctcatagccattacaaacacacatccctacaagatggcagacaaatgcccaggcatcctatgggctcagccattctcagtgatggaatgctttctcccactgttggactttcagttgtctgatgtttggagaatcttctagcagtttagactttaactgaatctgttgagtttgatacacttcaatgaataaaagccaatttagatactgtatttttttttctttgtttccaggcaagccgattttttcagttgatattcaccctgacgggaccaagttcgcaactggaggacaaggtatgtttatggaataaagaaagggaaagcttaacagccctgccaccttgctcttctcctgctgtccatttagctgtagagggaatacttgctatttttcaggatggatgcaacgctgtttaaaatgtacagttataatgtgttatctgaatgaataaaatcaaaatccttttatggctttagtgtgctctctgtaagtattttggcagcggatgtatcattctaatttctgtttattgagttaatattaaaatcagtttgtatccccaaacttgtagagcatcgagagcggtaggtggtccagtgggcaaagcccagccccagagacaagggctctgtcagcatttttctcatctgaaaaaagggaatgagggtaatttaagcttctaaagcaatcgtgtagttattaggcccattttctcgtcaaaggaattcagttaggttaaagagaaagcacactgtgggcaagtaagaaagcccacaccatttgaaactgttattggtagtattgcccttatgcttcagccagcatcttttgcaatgttgcatggttctatttggaaagacagagctgttcttcatgccacaataccaagatgtatatatagtgacacaatgtagcattccacagagcccagccctctgtcatctttaccccagagcggggcctccctccaaccaggcctccccaggcagcacttagagagtgcctttgtgagctctaggtcctcaggccaggtgctgcagggtgggtttccagcagatgcttccacccagaatcaaggagctggaagggagtgtagggaagctgtgggcagggaagcctttctctccttccatgctgtggactgcacccgagaggaggaggtgcagcacatgagagagaacacatggacttagctgaaggaatcagagggttcgcacctgtacccagaagacacacattttgccaccttggtccagcagagatgttttggaaatacttttacatattggccaagaggcagtttcaaacatgctttatggtaattttggcatgttcattggatttggccctattataataggaaaattaagtgaggggctaaacttcgttagatatcagtgatggaaagcttagaaatcattactaaggctgggcacggtggctcacgcctgtgatttcagcactttgggaggccaaggcaggcgaatcatctgaggtcaggagttcgaatcagcctggccaacatggcgaaaccccgtctctactaaaaatacaaaaattagctaggtgtcatggtgttcgcctgtaatcccagctagtcgggaggctgagataggagaatcgctggaacctgcgaggcggaggttgcagtgagccgagatcgtgccactgcactccagcctgggagacagagtgagactccatctcaaaaaaaaaaaaagaaaagaaatcattactaaaaggcatgggtatattttttagccgagcaatacatcaactcatgaccacgggagccctaaatcccctcttttggtggtctctcgtctgtaggtaactgcaaagggtggataacaagataatgagccatttttcctgtgttcagggtacatttgggtctcaaaacagtcggctctggaacagcctaaattccaggcagcacctggaaggggagggaaaccccactagggtgtgcttttctgtttgctttttagggtgtacacagaacagaaaaggtcttatgacattgactttcccttctcctcatttcacagatgaggagtcaaggagtcggagtctaggtgctgggcagggatgaagaccttttagggacccctggtggatccgtgttagaggccagatcagagctcagttccctcctgattgctagtctaaagttctttttgtaaagtcaggttgacttctgctgactgctaagtccgctccgtttcgtccccatgagtacttatcatcttttctgtaacttaaattagtaatttaaattcagtctccttagatctagttaattattgtttatggaagctaagtgaggacttctcctaatttaatttgacattaaatattaatatcaaatttctactccttgcacattcagccatttctgctcctttgttccagggcaggattctgggaaggttgtgatctggaatatgtctccagtcctccaggaggatgacgagaaggatgaaaatattcccaagatgctttgccagatggacaatcacttaggtattacagagtggccctttgcaggctttgcgtgttggcagagtgcccaaggttagcacatgtgtttgtaattagaaagataaggccccgtgcggcggtaactcccctcggcctgctgtctgaaggcacagatgttggctgcacacctgggtgagttattcagcagaagactcggcccgcccacagaaccatctttggacagtctgcaggtacctctggtgatttcctgctcatgagtcgttactgcctgattccatggggctttggggccagcgacctggacacagtagggttctggggaagggtgcgcaagagacaatttgccaaaacatctcaggttgttactgtgtcactctgaggctctctgccaggacccttttggccatcagacagtgtgatggtttcctttcctgctgtagtgccttagtttcccacccctgagatgcttaatgaacagtcactggcctttggacatcagctccttcctttcctctgtgtgttcttgtcctctcaacatgcctctcagtgtcttcagacctggagcatgttactcacgggccatgtgggggctacaactttgatagccatctttcaggtcttccaaaggccaagttgtgagtgctcttggaggctctggcccatcaggggcctgggggaatttctgctgatcttagcttataagcgcagagtcagtcaatctgcagtgctggcgagtttggaaaatccgaatgtgacagggctggctctgacagatgagatgaagtcagagttttatactgtaacagactgttcatctgaaaaatctagaaaaagcatctgaccctttttagcacgtactctttttttgagaataatctctactcagaaatgtgtctcattaatagatgacccttttgaaataatgagatttggttatcattttttgattttcttagaaagaagccttctattgactatgtcattcagcactaacgattctcagataatgtatatttttccccctccagactgttctggtaatttgtttttatagcacaagtaggttagtgcttaaactgaattgtttttctggggctctcacacagtagatgccttaaatagattagatagattagattttataaaccctttacatcttgccaaactctacataaagcaaatgggcatgactactggattttcatcaccttatttttttttcttcccagcatgtgtgaactgtgtgcggtggtcaaacagtgggatgtatttagcttctgggggagatgacaaactgattatggtgtggaagcgggctacgtaagcatcattttcctttcttcacattttatttttagaagctgctttgctggtctttatcaaagtcacctttccctaccctgtcactgaagttcccatagccctgacctcataagtagtggaaagtgcatgtaggtcaggagcaggtggagcctgaccaggaattcaggagacctggtcagctgccccctcacaggactgcaggctctcacctgaaaaggaaagtctgatctcttctagtgccgatgtgggtggggcttcgttgcttttgttttttcaagtgaaatttcacatggaagcccaatatacaaaatggttaaaagtcagggtgctctggttcttgcccaggatctggggcaggggatccagagtccagcctctttgccattactttattctctgttggtccccacctggggcagcctctgctctactctcaaaaggagctaaccatcacctggaaaactattgctcccaggtctctgggccagtcagtctggggcaccagaccctgcaccattgctcaccaagagtggccctgtggctgtggcttcaagagcagaggcagaggctgtctcttcagcctacttggctatctcagcacactctttctgtggatttgtgatgagctctacaagagcaaaaggtgttatcagaggctctgatcatcggtgtgtcagcactgcctccaccaggccccaggtgattgatgctcctctggctcctgtggtgggggctagtacctatagatcgcgtggtttctctgcctcagatgtcaaagccatttgattcattgtgagatgcttaaaaataaaatactgttgattttgcttctttaaatagccaacataagtaacatttagtatacaatttagaaaactaaaaatacaaaagaaaaaatatccctcatcacaccacctaaagaaagctacagttaatattttgacattttgggatgtgtgtccttctaatccattttccatgcatagatgctatccatgtcatgtggttttttttcctttacataagtgatatcatattgtatgtgatgtcctgtggcctgcttctttcacttattgtgaacgttttcccatgcaagatttgtaatggctgtgtagtatttcatcaagtgcatggatcataattcacctaaccagccccttttattcaacaacccagtgctttccagttcttgtttgtttttgctttgttctgtgtgccctgataagctggctgcagggagcatttctatgcagtgcccagagcactccatgagtgcctttttggcccctttctcacacaggtacatcggccccagcaccgtgttcggctccagtggtaagcttgccaatgtggagcagtggcggtgtgtctctatcctccggaatcattcaggcggtgagtgggactgcctgttggggtgggtgggcccctgacacctggctcagatcagcagcaccgccacgtcccctgtgggactgtttggtccttaaagcagccctatgtctgggctgtcccaccccatcacaatcagtcacaccctgcctgtcccttaagatctgtgcagtcaccgggtccactacctgtctccagctgcattcagtctccccactcttgccctcatggggtatatgtttatatctttaatgtagaacttcccacgttctgctgtttgtcctgctgaacagaatcagtaccttcatcagcggatcactaagtccgtaagcacactttgtttattccccagaaatcagctcacagatgcccattgaaaagtttctcaacttgaccttgagtatgtttgcagtgttttaaataaacttggcatggaaagaagcacattttatgaatttagactgagggggaaggttgcccatgcactgtacactcaggtgtcaaggataccaggttgagtgcaatttagacttgacttaggagtctgagtccgtttggtccaggaatggaccaaagggttttccaggcagggtggtacagcataagtgagaaagtcttggtgtgaatggggatttggaggcatttcaccatggctggatctttatagacaaggcagggagcagcacaaagtgaggctggtcaggtatgccagagtcggatcatggaaagcttgtgctccctgttactgagggagtcccttgtcatggaagagatagggagccactaaaagctttgaagcacaacagagaggtcattgtgacagctcagtgaagtggaggttcttccagtcgtttagatggacactgtcagggcctgagctaggcctgtgataattgaggtagagaagaggagattgatttgggaatacttaggatagggcacagagaggtatgagatagattcttggctggatgcctagatagtcagaggtatcacctctgctgagaccctaaggacaacaggcttatggggacggataccagttcagaatggagttgcccctggcttgaggggtaggggaagaaatgtcaagaaaccttcaaattgagcctggagctctgggcgaggacagggcaggagtgagaggtgtgggaggtggcatcagctataatccattgttagtgtatgcttagcagattccctgtagactgttaaaaggagaacaaacccatcttggtggcggccatagattgagtccacatttgtgaaagctgaaacggttagtgttgtgttattgtttgataattaaattgtgtaattggcccttacttgtgtcacagtactaacagtgaagtctagttggacttttctggaacttggtgcacatgtctatgagggtgcccaagtgtggggtaggcctcaagtgaggacttttacaaggccctaaccagagccttgcattctctttcctacccaccgcccagtggggctcctttaccagacaagtagagttgaccaccttcagctggggacctgacactcattactcactggtcctggtagcaggtgcaggcagaaccattcaagaagaaaaatcaatgaaaagcagaagtaaatgaataagaaagaaccggatctttgaaaagcaaagtgtgagaaatatatacttggtatatttaattgggggttgggaagaaaaaacctagacaaaattagagtttaaagatctagaaaaacatttaacccagacagaaaaaaatcatcaaacagtacaatataatgtttgtactattaagctaaagaacaaaatactaaaaaataattttctagaaaataggaactttcataattgataccataggattaggaaaaactgaacagaatagtaaccaatgaagaaatgaaaggctgtcttcagaaatgcttcttggttctaaattagttgtaggtgcattgttttgagcttttaagaaaaattatacagaacaatagcaatatttataattgaaaggaagatataagccagggttattgtatctggaaaatacaagaaaacctaagaaaaataatgtaacaaaagcatagaataatatgaataaagatagaaaaatcagaaacaatactagtaaatataataacacttgaaagcagttactcatttatttatttatttacttgagacagagtcctgctctgttgcccaggctggactgcagtgttacgatctcagctcactgcaacctccacctcccgggttccagctattctcctgcctcagcctcctgagtagctgggactacaggcacgtgccaccacacccggccaatttttttttgtatttttagtagagacagggtttcactgtgttagccaggatggtcttgatctcctgacctcgtgatctgcctgtcctggcctcccgaagtgctgggattacaggcatgagtcaccatgaccggccagaaaatagtaatttattatgattaaatgtgacttgtaagtgtagtacaagggaatctattaatataactttacatactaggaagttagatgggaaaagctacagtcatcttaggtgttttaaaaggaacattagacaattcaacatcagttcctattaaaaatgctttttttaaaatgcccataggaagatatttctttttctttttctttttttttttttttttgagactgtgtctcactatgtcacccaggcaaaatgcagtggtgcaattacggctcactgcagccttgaactcctgggctcaggtgatcctcttgcctcagcctcctgagtagctaggactacagatgtacatcaccatacctggctgattttttttttcgtagagatggggtttcactatgttgcccaggctggtcttgaactcttgggctcaagcgatcctcccacctgcatcttccaaagtgctgggattacaggcataagccaccacacctgtcctaaagctatttccttaacatggtagagtccttagtctttttcaaaccagtggcaaatattacagttcacagttaagcctggttgcggtttatatcaagaaaagacaatgatgggtgctgtcatttaatttgttgctctggaatttctgcaacacagttaaatagaaactggaaaataaggcaaaaaggaaatgaaggtgacattatttcatattaggaaaaaccatagggggataaagctcttggaacaaataaagcactgaaaaatacttagaactaataaaatgagtctttatattggcctcataacagaacaattttaaattatttgtcttttgctactaatagccaattagaatatctaatgataaaaagagaattatacagagtgggatcaaaagttataaatatccaggaataagtaatcttaccaagaaatgaattagttttgtaagacttaaatcacaaacgttttaagatacaaaatgacattgagagatagaaaatggcttcctaaattgaaaggctagatgaaatacattttttcccaaattaatatttacttgtccacataccaaacatttattgagtgcctgccatgttccaggcactgttcttctctcaaggagatttgttcttgtaaaagagacagacgagtgagtagtataggagatttgaagatgagcctagaaggcagagtcctgtaaggagttggaagatgagtgctgggggccagtgaggagatgacatttgagggaagactggacggcagtgaggggacagccagtgcgaaggccttggagcatggacatgtgcttactgtgcccagtgaacccctgggagctggggcgggggaggagggtgcgggaggcagtgtgcctttgagaccgtggcagaggctcttctctgagcaagaatatgaagtctccgcagggatctaggcagaggagttgagacctgtggcagcagtgtggattctaccatgggggtctcagggctgcactgggaagactagtaaaggagccgctccgaaaaacaagggagagacaatggtggtttggagtcataacacagaagtggtgagaagtgatcagaggcggatttcctggtgcattgaatatgggatgtgagataagcagaggagtcaggatggcttcccggactatggtccaaacagtggaaaggatgcagtggctgtaacctgaagcaggaagtctgcaggtgggacagaaatgtttgttaagggaagtgttttcagagtttggttttggatatgttaagtttgccagtgtaaatggacatactgtgtagacatttggaaatatgaatcttggaaatatgaggttctgggtatgagcagagtccaaggatgagcctagggattggagagctgaaaccagaaaaagaagctagaaggagaggccagttaagacagtgaaaagaagcgaggcatgaggatcacttgaggccagtagctcaacagcctgggcatcatagcgagaccctgtctcagcaacaacaacaaaacggacagtgaagagagtatttgaaggagaggggaacaggcagcgtattgcttattgctgaggggcaaagtgaagaccaaggatagactgctgggcttgacagcatggagggtgctgggggcctaggcaagtgcaatattcatgtggtgtcattgggccaaaggtgtcattggagagtactcaaaaaacactaggagaggagctgagctttgtcaggcgtgtaggaagatggaggagaagaaaagggggagtggtggtgggctctcagctggaggagagaggtaaggaccaggtggttggcaagtggtgaggggacggcagcatcagtagatcggagttcctggtggcgtgaaagtgctgttggagctgagggtgagctaggagcacggggctgatggttggcctgtgggaaggttggaattgagacagattgcagtgatttgtcatggaaggcctctggacatgaccgtggggtgaaagtagtggaagccacggtcatcagaagggaaggaggaatttaaggaaccaagagcctggagtgttagaagaatcatcctcttggagtcaccaagaatgatggtgagaacagtggccagaaatgtaaatctacaagtgaggggagggtctcctgtgtgtgtagatgcaccataaaaaggaggtgctatatagtctgaagacagaaactccaaactgggagtttaggagaaaattatgtcatgtatgtggatttactcagcagtgattctaaaggattgtatctggaaggataagaatgttacggatgaaaacattcaaagttccagtgatagaaacatcatgggtttgagggtaaactcgtaacactgaaagaggctacagtatacctaagaagttggtgtgttgtgaaaggaggcatcgcttatcaaaatggattcttcctcacatggagcatagtaactgttaagcagttagtgaggagaaattaatttcaatcctcaccaaatacagcacacaccaaaccagatactaaagagagaaacattctaaataactacacaaggaaaaaatagaattgaatatttaccagacctctagcagagagaatatttttcaaggttaacaaggcaatagaagaaatcacaaaggagaataacagactttactccataaaactactacagtataaaaaagtagagaggtgaaatttgcagttaatagctgcattatatgtgtctgtggagattgctaagaaaatcccttctcctttctgggctcccacctaaccacatattctctgttctaggatgtgggcactcccctgctgtcctggcgtttgcatgtgtgcccctccaggactctcagttactagagaaagttgttgttttcttcatttttgtaggcactgcatttatgttgttagacccactgcccgaaacacttcccagtaaatggtcacaataagtcagcaaatcagtccaaaaacacattagataagagacaaacgctttcactaataatctaattaaaaattttaaatataaaattgtattgaataaataagtcggaaggggaaaaagtcatcatcctcaatgctaataagggagttttgaagcaaacagtctgcatgtagaaatgtaaaaccacagggatcttggaaaagcagtctacagttttatgagaatccagacctatgaggatgctcagatattctgcccaggattcccactctagggtatgcgtctcagagtaataatctggagtatggagagtgacaaatacacacgggcccaaaaaaccagaatccagttaatcttcagtgttaaattaggtcaattaatagtagtgaatactctcaaccacatagaatgcagggcaaaaaaggaaagaagctgtgaagatcacataggcatttagaatacaaaatgtgaaccacagcatgtgagacaatttgaaaaaaaaaaaaaaacctgttaagctgttactatagtttttttttaactggaaaaaatacaatagatatttggaatattttgcttaaacctcttgtacaaagaaaggacttgatagctattaccttgctgctatgtttgtttcttcaactcaccaatcattcttctgtatacctagcactgcaccaggcgctgaggttagagaaataactaagactgcgcccttcacccctgatggcaggataggcaaggttggcaccatcgtcacagcggaccctcatcgatgccttggtgtgtgcctggcatggtgttgcagcagtttatcacatttaatccttacagtgaccctatgaggataggttttggggttttttgtttcattggtttttttgtttgttttttgagacagggtcttactctgttgcccagcctggagtgcagtggtgcaatcatggtcactgcagccttaacctccctgggctcaagtgatcctcccacctcaacttcctgtgtagctggggatacaggcatgtgctaccaagcccagccaattttttgtagagatagggttttgccatgttgcctaggctggtattgtacctctgggctcaagcgatctgcccacctcagcctcccaaaatgctgagattacagacgtgagtccctgcacctggcctagattttgttttttaatctgcacttaacaaatgataaaatggagtcacaaagaagtgaatgtgaataattctgtttggaggctccatagtgaaggggtactcctgtcagggtctgggagatgagacccagtccatgaaccagacgagggcctcaagatgacttgtgttcagttgtcagcagccctggagttctgactgtgccaggcattctgccatgtgctttacccactgtgtctcatgctcagaaggctctcggaggaaggccctgttatgattggcaaagcaagtcagcagggctgaggagcatgctccaggccacagacccacgaagtagcaggctctcatgcatgggtgtggtgccatatggtgcccaagctctgaaccacgccctcagttgcttcgtctgtaaaaggagtgaggcactggggtcggttagatgctttaaatttatgaccaattgaaaaattctggggggagttttttcaggttggttaaaaaataccagagtggttatgatggtcccaggtcccaggggcactggccaagctaatagacaagggcatcaccaggtaagagatctcaccagaaccctctgtcttctttcagatgtgatggatgtagcatggtctccccacgatgcctggctagcctcatgcagcgtggataacactgtcgtcatctggaatgctgtaaagttcccaggtctggggcctcctctgactggttaacagcaagcagtactgcctgtcagtttctggagcaggggttgggctgtctccttagtcttggtggcaacagatgtgtcacagtggcctaggatttatgtgtcttgtcagtttttctttgtcagttacatttgtttaagctttaaaaagagattcatgcttaagaaaaatggtaactgagtgctagcatggcatgccacagatcaggagggtaatggatgggcagctgttgttggggaccctgatgctcctaaacctgctgtgtgcacccccaccactgggctctgggctcagctcagtcaccatctcctctgtgaaacccttgagcagatacgggctaacacaaacccagttttgcaaaagattgatttttcttattcattgtgtttaaagtcacaacagatggcataacctggcacagtgctgcagtttataactagtaaaattcttctcatatttcagctctgtatttgaagtatgctttccttatggatccaggtcattttaactctttgaaagccaccagcatgtgtggaaacactcagtctggctatggagagggaagctttagagaccggagtagcatttggattacagatctatatggggtaccgtcgtacacacctttgtcttcagccataacttataaaagactcagccacagtcaggccctttgagctagtaggcctcctccttatcagggagctaccagggaggctaacgtcagaagtgctggtgtcacagcccaggaagggcagccataggcagggccgctagatacagataagacctggatcagaactagccccttggtgcctgcctccttgatgctgtcatttcttcaattggcttttgccttggtggagatcaaatgaggaggcccttctgcttctgtctggtgtgggggctggccatggcagactgctgagtcccctctcttgcatatccatcccatggcccatggattgcaggtcatgtttccctcagacaacacctctccacattccttttttcttcacagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgaggtaagtggggacagctcagggagctgagcccccgcagctgccccagcctcttcctgacttctgtgtacagagagggagctggccatgggccaggccacctggggaatgcacagagtccgggggcctgagcggattcaccaaggctctctggggtgggactctggccctaagagtcagataatacagaatccttcatttctgagacgctgtttaatttccaactttgaaataaaagggatttatagttttgttgttttttgctttgttttggcgacagagtttcgctcttgttgcccaggctagagtgcagtggcacgatctcagctcactgcaacctccgcctcctgggttcaagcgattctcctgcctcagcctcctgagtagctgggattacaggtgcccaccaccacacctagctaatttttgtatttttaacagagatgcggtttcgccatgttggccaggctggtctcgaactcctgacctcaggtgatctacccgcttcagcttcccaaagtgctgggattacaagcatgagtcactgcgcctggcccggatttataggtttaaagttgaagtgaaccttagagatgtctccacatcattctgtcacccagctcactcccacagacgtggataaaactgcttcttatagtgcggagtttactctgagcctcccgcagagcagcttgttggggaggatggaggagactcttgtgccatcctcgactgtgctgtgcttgttgatatgcaccctgcagttcaggggccttttttcctggctggagttagcagtacagtttgcacatgtttggagatcagactgcagtagcttctctggtattttaatctctcttccgttatttgagttctgatttcaaatggaatgagagctcaagatcaccattgttcattagacatttattaagtgtctactgtatagaaggcaataactgggcacagggaaataaaagtggattgagatggagtctctcctcttgaagcttaaagccccataggaaagacaggcattcccattagttgcatgataatggagttgtccagagtgcagaaacagcccaggagaggtgagtgcatcaggaaagacttcacagagcgagggacacatgagggaaggtttgcaggaagagcacgcatttgcccactggtcaggatggctgcaaaagtaaagtgatagtcatatgttcagttcttcccgcacaacaccagctcctgggctaggtatatgagtactggtttttaccttacttagtcttgccctaaggagcttttgctccttctggagttcctcagggctctgactgccaggcagtggggtcccatgaggtggactcctagggacggctttaggagtgtcttgagtaccagcaggaggtggtagtactcttcagcctctactgggtgggcccatccttccaggtagggggtggttctgtcacctaggctgagagctgaggtgggtgatttcactatactcaggctctggtttgtcatgtcctgctctagagctgtgaggtcatgatcttaacccttaagtctttagagctgccctgggcccaccttgagcttcaaggagctggctctggacccatgtcatctctttttgcaggagggataatgtggagggatgctctgcctcagcccccagtccagactgggggagcagtgcctttctactgttccttttatagtttataaggatgttacaaacctcttctcccttgcgggtgtcctcaccaccctttgggtgaggcaacaggctcaagagagtaggtggtgcctcacagtcatcagctacattacagacacaggcttctgccaggctcctgggttaaaaagggctttttctccaccagagtatatcttgaggatgctgtgcagatgccatgctgtgggttaacaggtgctacacagaagaattgggtcagtggccagagagatttggcccatgcagaggctatggttcaaacaggtagccttcctgcagatctcctcagggcatacacttctgtactatatttctttgttcagctcctctgggggagtgtaggatgctgcagtttccaaattcatttcacagagccctttttggttgggccatctggtgagacagaagctgtcagtgtagccagaagcttggggtgcatgctccaccatcacacatttataaattgaagtttaactttatcctcgaggccagagttttggtcacaaaggtggccttgagctcctttcaagtgcagatgcttctttcagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtggtgagtgcccagggaactaaagggagatgggctccaagattcagcaaatattaattcttggtttattttgaatagttatacttaaatatttaaaagctaattttacaaaatagagtatgtacttggttgatttattggcaaactttacatgtgaacatcaccaaaatcagtcttgggttaggaacatcgtagctccacatcagccttttacacactcaggtatgcttggggtgcccaagcacggtgccaccctcacctggctccagtgaatacaggtacaattctggtatacccaccaagcactgtgcttgtccccacacctggcagcatcaaccacaggtgcaaggccatgccatggatcactgagttgggagctgctgccagatcttgctgcggcaggtgaagagctcagaggcgtgaactgctgtcagtccttaggcatgagagttgtctggccactcgtcttatgcttctccatgactttaattaaatagtgtcctgacagagcccaaggcaagctgttaagtagttgcgaataatctgtgagaaccaggattttctcaacactgggcagccaaataaaataaacagattggtggactaaggttgataaaagtgaaggatcatccaagaccctgatgaaaatagactcacttttgcccgtgtttaaatagataataagtatcggccggacacggtggctcatgcctgtaatcccagcactttgggaggctgtggtgggcggatcatgaggtcaggaggtcaagaccagcctgaccaacatgatgaaaccccgtctctactgaaaatacaaaaattagctgggcatggtgtcatgcgcctgtaatcccagccactcaggaggccgaggcaagagaatcacttgaacccgggaggcggaggttgcagtgagctgagattgcgccaccgtactccagcctgggcgacagagcgagactccgtctcaaaaataaaaataaaaaaagataataagtatcatatattgtaccttaaaacacaaattttatatgaataaaatattacttattaaatttttttgttttggagttcatgtagggttttgtttgaaccagagctttgttgctaaagtctttggaaatcagtgcttcatggttagtgctctacgtgattctcccatgcagtcctcacaaccactttattagcagctctgggagatcacgacgcctgcctatggctcacagagctcccaaggccctgcagcctcattggtgttagagacagcaagcccagggacacgcctctgagttccatcttctccagtctctgtgcaccccggccattcctgcctgccctctggaattaaaacatctctaggctacctgacaccaggctttcaggaaccctccttcttctgccctcagttgtcctaggttggggattcccagagcgcccacccctttaaatccaggagggtgtctgggagctcagtgagtgctttcatcctttgcagaaacaaagacaagttactctcggggtagttccctggactaagcagccaaccaagcacctttgtgtgatattgccatggtcactggcccagggagatcacaaatgactctctgactgagcagatctctgctagacggttatgactgaacaacaaatgcagtgaggcaataaggaattcagagattcacacccctcctgcccatccccttggcctcccttaggagatagggagtgagtaggtctttgtttctgaagcccccttgcaggctcagcttttctgcaggtcctagggctggccctgcctggccagagggaattgagaaggctagtttcagtagctacgcatcccttctacttggcaagctccagaaatggagagtttggtagctctagtttcaaatctgcatttcccagcttactcatttggtgcctccgcacatactttctgacctccctaagcttcctttccatcatcagccagatgcctcataggtggtcgggaagatgaaatgcatgctcagtgcctgggctcagagaatgtctgtgggagactcccttcagtgggctgggacttgggcacaggggacatgcctgatgcttgattaattatttttaacatctgttatttggctttagaaattcaacccaaaaatcttcaaaaagaagcagaagaatgggagttctgcgaagcctagctgcccgtactgctgctgtgctgttggcagcaaggaccgctcgctttctgtctgggtgagcctgctatcctgagcttttgttgcaggacgggaggtgtaggttggtaaagtagcaagtggaggaaagagacctgctttgggtgatgctaagagtgtatttctattctgcacctggggtcagcccctccttggaagctcacaggctctcctgctctcccagaaggaagtgctgaagactgggtctgtgcccagccaggagaggccaccttgacccccacctagaccagctcttgtgtccagactcaggcagcaccctcagtggtcaatgccatgagcagcatgttgggcttgcttcctattagaaaaatctttatatggctgggcgcggtggctcacgcctgtaatcccagcactttaggaggccgaggtgggcggatcacaaggtcaggagttcgagaccatcctggctaacacagtgaaacctcgtctctactaaaaatacaaaaaattagctgggcgtggtggtgggcgcctgtagtcccagctactcgggaggctgagacggagaatggcgtgaacctgggaggcagagcttgcagtgagctgagaccgcgccactgcactccagcctgggcaacagagcgagactccgtctcaaaaaaaaaaaaaaaagaaaaagaaaaatctttatataaagtgtattcacctgaaaggtacagtttggtgagttgtcatacatgtttacacaccagtgtcatcactgcctagagcactcctttttgtccctttgtccctccccagtcaagacctccctcaccaccaaagcaaccactctaatggcctctgttacactgatgagttttgcctgctcttgaacttcatataaatgcaattgtgtggtacttgcttctttgtgtcttcatttcttttgcttggcacagtgtttttgagattcatgtatgttgctgcacttaacagtattttattccttataatttcggtgtagcattccactgtatgaatacaccacaatttgtttatacagtctcctgttgatggacattaagattgttccagttttgagatattatgactaaagctgatatgaacattcttgtataagtctttatgtggatgtacgttttcatttatgagtacatacctatgagtagagttctaaaattaaaaaaaaaaacaaaaaaatagtaccaagtgtcagcaaggacatgataagctggaactgatacattgctgacacgtgttgctgacaggtgtttacgctggcatgagcacttgggaaaactgtctggcagtttctaccacagctaagcatatgacctagagcacttccactcctaggcatacaaccaagacagataagtgcttatgtccacagaaaaagacacacagaaagctgacgcctctattagtccatttcacccctgggtgatgctgtgatgggtaaggttgtgagcctagtactcctcactcgctggatcccctgagatgaggcgatgtcttcagcttcttttttttttttttttttttttttttgagacagagtctccctctattgcccagcaggctggagtgcagtggtgcaatcttggcttcttgagtcactgcaacctctgcctcctgggttcgagcgagattctcctgcctcagcctcctgaatagctgggattacaggccaccacacccggttaatttttttgtaattttagtaaagatggggtttcaccatgttgtccaggctggtcacaaactcctgacctcaggtgatccgcccgccttggcctcccaaagtactgggattacaggtgtgagccaccacacccagcccgatgtgtcttcagtttcattgttcccctcaccttcctaactcagtgccctctacagagcaggttctcagcagatatactcaatggtagttggcgagtgagaacccaagggtaagaactgtggcggtttctaagtgagggctcctgaagggttaagtttctcactgccaggggctggtgtgctgtgacctgactgtgtggtaagagacacctccgcatgcagtgcagggagcagtcttggtgctgagcatcaaggtgccaatatatttaaagtttgataaagcaaagtgcacacacattaattttttttttttttcattttgtaaaaaagtgtccctataagcagagcaagttggaagttctgggtttgaaggttatcctctggctgcatttattagtttggtatagagaaatatattactgtgtgcgttgtgatttttttttttttttttaggccaagtattcacttaacacccattctggaacctgaaccacagtaccacagattgccgttcaggggaccttccctgtttcctcccagccagaggccctgtttgtggcgctgcaaccaaaacatcactgactgtgatgcccatatttcttagaatgctcaggttaggcagtcacacggcctgtagatttctgaggggtctgtaggcacatttatgagaggagggacaaggcagctttttctagaagtggaattaaggtggaggcgagattcttaatgtgggttccagatcgttcagacttcagccccctctccaccactagggtagacacagcttctccttccccacatagcagtctcaggctgcactgggacgctcagccccacagcctcccagaagctgcagcagcacctatgggagcccaccatcccgtgaggaagtgtgtttcttccctgcccattgtcctgcagttcagggccagccagcagggtagccaggcacttgtgcacaagtggaaaggcctaccatagttgtgggaacgtggagtcagagtgtatgccagcaattgagtgactcgatagagaatatgcacagtgcatgctatgcagtcatccagaagagacttttacaggatatttaatgacatacttattgtgtgttaaatgaaaaaacagacacaactatgaagaataaaataaattcttactttgaagaataaaataaatatttgcacaaaatagaagataataattcatcaaagtattaatagtcggtaactaggcccagattaagggcccaggtgtgtatttctgtactacctacacatagtgtagaatgagccttggataaatgtgtaccagagtcccttgggcccagggaagatgtgttgtgttctctctcagggtgcctcatcccctgtctaggctttggcatcgtgtctcctgctccatagaccctctcagaggtccaccctggggctgtccctctcctccgaccatagcccttcagaaacccactcccactctgccttctctgttgctagttatctgtgtataaagctatttcccctgtcagaccacagcaagccctggaggcagggtccactctaggtagcatgcacatttttggcaggctttggttcccacagtttgggatctctgcagctgcagtttgaatagagttgaagatgccttaaatatcagcagccactttgacccaggcttctaggttggttatgttaactgagctgaatacagaaggggatttcagtaatttcattaaccttgactgtgtctttccttccagctcacatgtctgaaacggccgctggtggtcatccatgaactgtttgacaaatccatcatggatatttcctggtaaggtggattctacttacaggaataggttaagaaaggagaagccacacattggaacatgaggccttctgggtgtgactagggtcaggtggccagtggcccctccccaggtgtcatagtagcgcagaccaagagtgctgtttgcacgtgatttgggaactggcagcggtgtacctgctgctgcgagaatgtcctgcctgtgtagaatttgccactggaaaatgccttttcaggatttgtctaagacgaggagaatgacgtgatcctagtatgttccactttactccgtcagtgcatgaaccaaagtcagaagcacactttctgcttctcagtgacctgatttatatgtatactttgtcaagttttttttattttaatagtttcaaaagtaagataagtaaaattgaaaattcttacagaacatatggtaaaggagatattttgtacacctgcttagagctaaagaacaccagggccctttgggatacaattgtcgccccctcccccccccgcccaggccaaagaagggaaccaggccacagaagggaaccaggagtttccagcatctccctagaacactgcccaccatcctcacaggccagctactgcggcacatgtgtctgcctggggctcttgctaccaggctgctgatggccatgtctttcaggactctgaatgggctgggcatcttggtatgctctatggacggctctgtggcattcctcgacttctcccaggatgagcttggcgatcccctgagcgaggaggagaaggtaggctgacggctcttgtgctgctgggtgctctgtggccattgccacaatagctctgagagacccctttgactacaccctcttcttgtgagatacacagacaagtcatttcttaacatgtaatggggtattcatcttttatatcttgtaatccttctttacaaaatagattaattaaaaaacgagtccccatttcagaaataagtcctggagttaagagtagaactattttaggcatctctttttgagctgataataggccatccactgggaggtttttgccctgggaaagagctgaagtgactcctcaggggcccctgctcatgtcactttcaccttcatggtagtaatattggtcatttcttagaacgcattgtctgccaggctctgggaatgtgttttgcacatatgatttcatttaaattgcacaaaacccttcaaggcaaggctcatccatttcgtggatatggaaactaagcctcagaaaatagcatggctctttgcccagactgtatgtgacccttaggtcagaagagtgaacaaggcctgctgcctctgggccaggctgcctcccctctgtgctctgctggggtgatggggtctctctgcccttctgccaggctttgagaaaagccctgcttcacctaccagaggcttagaaacctgcccccacttggtgggttgtgtgtatgtgtctgaagggagctctgtgaaagcccagagcaggctggcagctctcctcatgaccttatttgctggtggaagcttcctcttaacctacagtgtgacctccccactaaaatgtgaacccctttgggggagaggtctgccttaatgactacacttagaatggggcctgccaccccatcatttttccatgaaggaatgagtatctcagaggcctcaggtcctcctccaaccttgtcactgtcatcaggtacctgggatcactatgcactcccttggagtcactctgggagcctaataacccatctgcttaccatttcccaagtcaggctgggactccatgttggaggaacactagggaaaccctggccaaacactgaattctgcttcgagattccaggggatagactcaggagagaagggcaggagccaagatggcaagaaaaggaggttcctggccacattcaagccctgcaggagcaggtcccaaggcacctctcttggaacgctgcctctcaacccatgctctgctgtaaagcagatgtcctgttaaccacagtccctgttcttgagcagaatcccacattggacatttgcacatcccatggaagtgtgttcctcatgcactttcatgtacagcagtcactacagtgtgctggggacaccatctctgctctcatgaggctcctgtctagcttgttagggcacaagactatgagggcctagaaggaggggagtatgatgacatactaggaggggtgggagtaaaggaggctccccagccctgctgtgccaggccttcccatactcttagagacactaagcaggccaatggggacttccaaccacagggcttatggctgcagatgagctgtgaaagtagacttttgttctaggatctgattcccaaaatcatttgggtcctaggagtgatttaagagccttaagttagcaccttgagtatcttcctttccactgaagcactgtggattgtcatttgttctccaccagactgtggggcaggtgttgtcttgttggctgtctcatttactgtcatcccagctacagatacaagggaggccataaaaatcaagggtgggcatgagacatcaacagagctgtcgaatgagggacaggcagaataggatgggaggcgatggggagttggccttgggtcccttctccactcagagccaggagagccctgctgtagtttgcctgctggtgggcagcactggccacactggcactcatgctggcatgtcatgcctctccttgcttccccagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaaggtgagagccctgcctggtggcgctaaagacatggacatatgcccagggacagggtgaggggcagacaccagtggtggtaaggaaggggtttgtttagagtggtacgggatctgtgggttagccagcctcgggcctgttggccccttgcccactgctgcatgatgcagtaatggggcctggatcctctttatcaaaggcctccttatccccaggagcccagaggaggtcatctcttgtaagaacttacgaattttatccttctggtctttctaaaaatcctagatgctaacaacagtggatttcaggctctgcccttaggagacttctatgggctcccccttcttcatctggaagccatgtttgatgggaaggggttggaaatggggcgggaaaagggtagggaacgttattgcctggggagtataaaccatctccaggagcctgtgtaggctgacaaacctcctccaggcaattcagatataaagtatgagagaaaacccctagttacaagctttctgtggaaggaaggattctattttgaaagtcagtttgaaaatctctacctcaggccaggcgcagtggctcacccctgtaatcccagcactttgggaggctgaggcaggcggatcacttgaggtcaggagttccgaccagcctggccaacatggtgaaaccttgtctctacttaaaaaaaaaaaaaatagccgggtatggtggtgcatgcctataatcccagctacatgggaggctgagcaggagaattgcttaaacccgggaagcagatattgcagtgtgccgagactgcgccactgcactccagcctgggagacagagtgagattctgtctcaaaaaaaaaaaagaaagaaagaaaatccctagcttagtgacagatgtgtggttcacgggtacagagctcagtcctttagccctttcattggtcccatggctgttgtgcgaggcggccagtgtggcatgtacccactgcttgttctttgcttgggtgtcttatttagttgtaccaggagggcaatttagaatacatttccttagaagccttattatttttaaacctaccgtgttgaagtacaattgacatataaaaagttatacatacttagtgtgtacaaattaatgataagccagacacagaaggacaaataccgcatgatatctctctttttttttttttttttttttgagatggagtctcgctctgtcaccaggctggagtgcagtggcgcaatcttggctcactgcaacctccgactccctggttcaggcgattctcctgcctcagcctcagcctcctgagtagctgggattacagttacacaccaccacgcccagctaatttttgtatttttagtagagacggggtttcaccatgttggccagaatggtctcgatctcctgaccttgtgatctgtccacctcggcctccccaaagtgctgggattacaggcgtgagccaccgtgcctggcctgcctgatacctcttatatgaggaatctaaaatagtcaaactcacagagacagagaatagaatggtgaatactggggtcagaggaaaatgggagttattagccaaagggtataaagtttaagttatagaagatgaataagtcctagaaatctcccctacagcatagtgcctacagttcacaatatgatattgcatacttaaaactttgctaagagggtggatcttatgcttagtgttcttatcaccaggaaaaaaagagactttattttttaatatttggaaatagttggccaaaacttttgcattcatttatgtaactctgctttgccagaatcttttgaagaaacaagttgagactcggacagcagatggccggagaagaatcacgcctctctgcatagcacagctggacactgggtactggttcattcccctttcatggtcttatctggcgagatcttcctgtcttctttcagcggttaacactttcacagtgaggatcttcacgggtccttcacaacctgactggtagaacatggaagcaaggaagtgaagctcagcttcccgcagtctcaaagcccatactcctcctggagcccttgtgcacacctgaatcatgtgaggggtgggagtgctaaggcggccagcacatctgctgcacttcactgttgccagggcaccagaggacgcacaaggaaagcagtcagtcaggctgattttttttttcttttttttctttcataaagttatttttatgattatgaaaggtatatttacacatggttaaatttagaaaatagtaaaagcccaaagaagaaaaaaacattatccataatcagatacagtcactgttaatgtttttatatctgtatttccagtcttttttttccccactcgttactgtttcatgcccattcatccattttaataactagtcctctgaggtgtttgctatctgattatccagattcccatcctaggatttgcttagccagctcactgtagacttgtgtttgtgtccagtttctcgtgattataaatgagtctttgagctcacctgtggttgttctctcaggataacttctagaagtggaattactgggcagagagtagggctcccaaacatatttccctgtgggggacagagaagggggaagagactcattcaccacttgctgttgtcccagtgtatatagtgaagattgtttttgaattggttattcttcccaaaatgatgtgtgttgattcaaaaaaaaaaaaaaaaagaaagaaaaatgataaagcactgtgtgaaagaaatagacccccactgtcaaggcagttcactctgggttttattctcattccgtctatctgctcagggcatttgtaagcccttcatggaggccacacactttaggcctctgcgttttgcagttgtccatccacgagctattccaaatcttccttggtgtctaaagaaaccttcactcgtacagtgtacagatccagtctcctcatgttagatgtgcaggctctgaggtccccacgagtagagcaagaaccaggtctgctggctccccacagagcactcattttcttttgactaagtctttttcctattgtgaccctgtagggggtaatgcccctacctaccttttattgagaccaagtgagacccagtgtgtggttgagctctgaacatactgggcctgtgggatggggaggtggtggtggtgatggtgacactttgttctgtggatccttccaggcgttacctggtgagaaggtgtaggtggcttcctaactggtctggggccaactttctgacataggatgcatatttctagcatcaggacctgatccttttggtattaaaagctttttgccctcctgattcccacgttctaacacgtagcaacaggataggtccttattagcttagctaatcaagaaagaagagaaaaagcataaatatacaaagtaggtataagtgagaaataatagacaaatcaaaaagatgagagacttctttgctgaactctgtgcaaataaatttgcacagaaagtggatggtttttgaagaaaataaaattactaaaagtgaaaaattattgtggaagaaatagaggacagagttaaccccaccaaagccaccggactaagatggcttcacagggaaacttcaggaacttttaaggaacaggtaactcaggtaactgttaataccattttaaatattctagtgcatggagaagaaatgtgcaaatttttattttgaaatgaacataatatatcaaaatcttacaaggataaaacataataaattcaagatcattctcatttctgaatgtcagtgcaaaatcctaagtaaaatagtaacaaacagaaccttactgcttgttaaaaggctaatataccatgaccaagtgaggtttgttttgggaaagtaaggaggttcaaattttaggtaactatttaattctacgtatcagtagatcaaaagaaaaaaaattatatgatctctcatcgatgcttaataggcgttttggtaaaattcaacgttgttttaaaactcagttaaatgggaataggtggatgcttccttaacttgataaattatcttatttcaaattaagttcaaaaactaaacaaatgcctactcttgcaactataatttaacattgttctataggtcctagcccatgtagttagtcaaaggaaagaacaaattggaaaggataattatttaaggatgatatggtttataagagaatcaactggaaaagctgccataggcaatgaaagaagatagtcacatggcaggatacaatcaacatgaagtcaggtagcaccaactaccctcagagcacataaagaaataagtcatattcacaaataaaataactaggatgcaaccagagatgcatatcttaatgaagaaaaaattaaaaaccctactgagaggcttcaaagaaaactcaaagaaataactagaaattcataccattgattagctaggatggcatcataaagatgtcagctctcttgtagcctataaatttaaccagtacaaataaccgtaggaattttgggaatcagacaaggtaactataaagttatgtggaaaaatcgactgggcacagtggctgacaactgtaatctcagcactttgggaggccgaggcaggcagatcacctgaggtcacgagtttgagaccagcctggccaacatggtgaaaccccgtccctactaaaaatataaaaattagctgggagtggtggtgcccacctgtagctactgtagctactacctgtatcccagatacttggaggctgaggcaggagaattgcttgaacctgggaggttgcagtgagccaagatagtgccactctccagcctgggtgacagagtgagactttgtatcaaataaataaataaataaaataaagttatctggaaaaataaataggaatggccgaaatatttctgaaaaagaagattagccagggaagactagccccaccagaaattaagacttaaaagctgtcataactcaaaacagtgagatactgacacatgagtagatagtgcagtggaatatgatagaatatgaggaaacaggcccgaatatttatgggaattttaaaggtagcatttcacatcagtgataaaacattggctaattcggtaaatggaagacaggactacatggcacctcctagaaacaatgttgggtcccagcctcataacttatcattacatacattctaaacagcttatagtttgtttctttttaaattgttatttaaaatatttttgtttaaaattttagaagattccctggaagaatattttttataatctcagaggtcaaaaaagtgttttctgtaaatgacaatttagagtacacaaaaattttaaaattttagtgcatttaaaagataggctgtctgggcgtggtggctcacacctgtaatcccagcactttcggaggctgaggcagatggatacaaggtcaagagatcaagaccatcctggccaacatggtgaaaccccgtctctactaaaaaatataaaaattagctgggcgtggtggcacgcccctgtagtcccagctacttggaaggctgaggcaggaaagtcacttgaacccaggaggcagaggttgcagtgagccgagattgcgccactgcactccagcctggcgacacagcgagacttcgtctcaaaaaaaaaggccataaatagttgaaacacaacatcccaggtaaaatatttcctaccatataaggaatttttttaatatgtaaatgatttttacaaatcagtaataaagaccaataacaaaacagtagacaaagcatatgaacaagcagttcacaaaaaaaaaaaaaaagaaatcaagtatttctttttttttttttttaattgaggcgaagtctcactctgttgcccaggctggagtacagtggtgtgatctcaactcactgcagcctctgcctccctggttcaagagattctcctgcctcagcctcccaagtagctgggattacaggcgcctaccaccatgcccggctaatttttgtatttttagtggagacggggtttcaccatgttggccaggctggtctcgaactcttgacctcgtgatccacccgcctcggcctgccaaagtgctgggattacaggcatgagccactgcgcctggccggaaatcaagtatttctactttgaaaaactgccggccgggcacggtggctcacacctgtaatcccagcactttgggaagccaaggcgggcggatcacgaggtcaggagatcgagaccatcctggctaacacggttaaaccccgtctctactaaaaatacaaaaaattagccgggcatggtggcgggatactcgggaggctgaggcaggagaatggcgtgaacccgggaggcggagcttgcagtgaggcgagatcgcgccactgcactccagcctgggcggcgggagagactctgtctcaaaaaaaaaaaagaaaaagaaaaaatgtcaacgtcactcatatcaaaataagataccatttttcttctgtcagattgttaagtgtcaagaaatttgataaaagtgttactaagcacctatgtggagaaataggcgctctcatacatggcttgtaatttaaacctctgaggagggcactttagaaatatttattccaaatcatcagtgaacatttcatttgctgctacaattccacttctaagaatttatcccatatattatgtgaatcttaggtgtaatgacaattattagaatttcataattctttgagcagccaatgtgtgttctaagagtgtcctacaccaactgctttagtcctgacagcaaccccatggggagagtcctggcactttgtattttgcagacatgactggaggcacaagagtagttagagcaagtcacaagctaacaaatggcagaggagtcagacctggctgtcccagaatcctcagttctgacactgcaataccttgcttcctggtgcagcagcatctgttctagaaaaagctggagacagtcttgtggtccctcagtagaggctgggttaggtatattatggcacacccatctagtggcatgccccatggcccttcatgaaagggaggccctttctgtattgctgcatttcattcctcctaagacatgtgtttgcacagtttaacacctctgagatttgggtgtgttgtacagtcaatggcatctgacaattagtagcattgttttctttcttagtagtacatatagaacctgtaaatcctagattcaattaaatatagtatattaagtggctttaattttctttttacttttctgtaactttgcagattttctatcatgaaaacatactgcctttggacctagaaaaaagttatttgaatgtataaagtactggatgtggcacctgactttcaaggctgacttttgttcttacttgatgacagggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacaggttagtgggtgccaaggcttgttcctgtccctggggaaagttcaggtttgcacatagttttgaggacagagaattttattctgtttgcactttgtggccccttcaatcaaaaaagaaagaaaaaaatgcgtgatttgaaatggggacttctcagaggggaggacttgttcagtgagtctctgatgcacaggactgttgaggatttcacagagtgtatcaaggctgaccgagggtcaggctgctaagggtgggaactaccagtgaaatgctacgtgctgcagggtcagccccacctggcagctctacactggaggtgcttcacatttctggggcctcagcttccacttcactctgctgagcacatcacacagcattcatcttaggcagggttctcctgtgggagggcacagactccccttatactctcagaattatattcactcacagagcctgtgtcctcacccattgttacttggaaaccaaattagaaatcagaaagaaccaggcaagcacaaatgaaagccaggagtgaacgtttgctcagcacctgctctgggttatacaccctgctaggccccaggcatcgcaggggcttaatgggtgggtcctcatcctcagggagtgtgtaggctggtgggggagaggtagccacagggttgcaggtggcccctcaggtcccctggatagaaatggctagccatccaaagaggggctggtatctcagggatcagggaggtgcctcagagggtaccctccacaggactcatacaggcctaccaggggatgaggcctggggattaggggcagcagccccccagtcccctgaggaaggccaagaagagggagaaggccaaggtgtctgtgctggatcaggtagtctgggcttttccccagagtggagacgtagaaggctttgagatctccattttaggaaagtgactctgttaggcggtggtgccccaaataggccactccctggcacatacagctgataccgtcagagcgattctccattggtggaatggagtcttgtgttactgcagccccctgcttctgggatacagctgataccgtcagagcaattctccattggtggaatggagtcttatgttacttcagcctcctacttctgggtgctagcaccatggctgtgaaggcatgcccaaacattaggtcactgccctggggggaccctgagagggtaggaagagaagactgagcagcaagaccagtgaggaagcaaagcatgccaggacgaagggagcctgggaaggacagaccatgccagatctgagaactctgtggggatggcccattctagtggccacagatcatggaggagaagaatggggctgtccagggtgactaccaggcatgtggtgtggtgtctgggcagataggagtggaaggtgttagcctgggtgtgcttaggaggaggtccagtggccatggtcccaaagcgtgtggtgtgggcttggacatgaaggatggaccaggcaggcttctgcctggcctctcctttctctgtggaatagaagatgaaagttgtgtgatgagcacttggagcataatgctaagaatgtgacactgtcacagggagatatgggaggggccgctcaggatggaggatgcctgactaagggtaaaagcagaccatggcttcaggaccccaggtgcaggcttatctcatgagactcattgtcaaagtgggaaaggtgagtggctggagtggtttggggtagaggtgctgtatttaagttgtggagatagggcagtgtgactagagaaaagggttgtaagaaccatgttctaggcctcattctacccgcaaaagctctcagaacagtgcaaagggggaaatgtgaatgcatttgctcacaaccttctaggtgtccataattttgacacatgaaaattttaaagaaatgggagtagtagattgtatcttgacattttttgtgtttatggaagtttgatatttgtgccttttttagtaggctccaaataatgcaaatactagacctccagatcctttcaggattgcgcttgacatgcctcccctcttcttcaccccagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggtaggtggtagctgcaggaccctgaaggaccaggcagggtgcaggcatgggtcaacagcacagtggcagtgttcccaccaagcaacctgccttcctgttggggaaaagactctagccactcaatacatgggagcaagactgcagagcccttagtgagccaccaggagaaagaggtggttccttgaagtgggaaggtggctggaaggagtcatgggggaggacgcggcaaaagaaccacaaggtcaaaggcacaaggattggtcagtgcagaggctgaactgagaataatggtgtttggatggagcccagagtttgcacggaagagagcatgagattagttggagaggtggaagactctgatattgatacatcatggaagtgacggccttccactcagaaactgaccagaggtagagagctgcaataaaaatgatgtaagtgaggtctttgtcaagtcagattggcttctgagctcttgtggacactatgctgcttatccattctctgggtctcccctcaaacacagctgtgacatcacgcaggttgtagttctttatttcttggagttttgcagtagtgcatcctcctgaggtggccagagcgaatgtctgcagcctctgccattggcactgaagttctctgcctcctgagagggcccctccctccaagcctagcttgacaaggagctaagttcacatcccagtgagtcagagcctaggagaggagaggcagatgtgggctggactttgggggcttaagagctgtcccttaagagttgcaccccactgcgaggtttatagggctcagcagccctgggcagacacaccctagcctgtgccaccatcagccaagtacaaggacactggtcagaaacttgcagtagccacacagccagcaggtgcccaatgaaaggagcatttgtatgtgacctgtccttgcagtagatggtgatttggagctaaagccacagcatgctacctctggggctttgcttatgaaaagccctgtccaaaactgcatgtctggacaggatttattctccttggaaaacagttcctggaagctagcatgggaggaccctttctgcaagtttgatgctgtatctataaacttggtgtggaatcttgtagtctgctctgtaatctaatcatgcttgtttcataattaactcaatgcaggccacatgcgatagctcatgcctgtaatcccaaatgctttgggaggccaagacaggaggatcgcttgaggccaggagtttgagaccagcctgggcaacatagtgagacccgtatctctaccagaaaaattatccaggtgttgtggcttatgtctattgtcctagccactctgctcactgcaacctccgcctcccaggtttgattgattcccctgcttcagcctcccaagtagctgggattactggcgcctgccacaacacctggctaatttttggtaattttagtagagatggggtttcaccatgttggccacgctggtctcaaactcctgacctcaggtgatccacccgcctcagcctcctaaagtgctgggattacaggcgtgagccaccgcgcgcggtctccatgcttctaaatactttgaaatgctggattaaatgcaaccctcgtccctaaaatgaataactagttcacaggaaagagcagtacccagagtctaaaatctaagagtgaacaaaaaagccagagcacgaggagaatggaccacgggtggcggagcttgcagtgagccgagatcccgccactgcactccagcctgggcgacagagcgagactccgtctcaaaaaaaaaaaaaaaaaaaaaagccagagcagtgagcagaactgcaccatgggtgcaaggctaggggtcttgactgaggaccttgagttttaatgaccacatcgacttgagacaaggcctggggtctaagccatgtaggagttggaattaagtcaccagcataaagtcaagctgcttaaaaaaggactgaggcagacctgggaaaacccaactgacagcacaagaactagcagagaagttggaatgtctcagcctgtttttgggttgggataacagtcttcccttgagactgtgtaaccacaggtctgccctcatgtggattcagggccagtttaatactacttgtgttgtatagaaatcgccaagccgagaaatgaacacaaacgaaatcctggtctaattgacgttcagaggcacttggcagagatgcgtatccaccatgcagtgacattccttgggccagggtgtacagcattaccactgataaagcactgtttagatgatcataaaatccacagtcacaagaagaaagagcctgtcatgcacaaatgtcaggagacatacttactgggagacttaggtttctataaacctgtgatcatagaattgtcagatggcactataaaatatgcttaagtcttgaaagacatgaaagctaaaacaaaattggaacaaattttgaaagacatgaaagctaaaacaaaattggaacaaaagctaaaacaaaatgaggaaagattaatactgtattctataaacaaaaattaactcaaaagggaacaaagaactaaatgtaagagcaaaaactataaaactcttagaagaaaatatagatagaaatctatgtgaccttggattaggcaactgtttcttagatatgacacctaatgcacaaacaactaaaggaaggaatcgataaattggacttcatcaaaatttaaaacttttggctggacacaatggctcatgcttataatcttagcactttggaagcccgagacagaaggcccagtaattcagaccagcctgagcaacatggcaagacctcatctttacaaaaccatgttaaaaattaaaagcttggccaggcacggtggctcacgcctgtaatcctagcactttgggaggctgaggtgggtggatcacctgaggtcaggagttcaagaccagcctggccaacatggcgaaaccccatctctactaaaaatacaaaaatgagccaggcatggtggcaggcgcctataatcccagctactcagtaggctgagacaagagaatcacttaaactcgggggacagaggttgcagtgagcagagatcacgccacttcactccagcctgggcaaaagagcaaaactccatctcaaaaaaaaaaaaaaaaaattaaaagcttttttgcttccaaagcactatcagaattgaaagacaacctacagaatgggagaaaatatttgcaaatcccatctaattaaagtccagaatttaaattatataaataacttttacaattcaacaataaaaagacgaataacacagcttaaaaatgagcaaaagatctgaagagaaactgcagagaatatatacaaagcacaggtacataaaaattcaatcaacatcattagccatcagggaaatacaaagcaaaacttcaatgaaatacttcatacccatttggaggtctgtaattaaaagatcagatagtcagataataagtgttggtcctataaacctgtgatcatagaattgtcagatggcactataaagtatgcttaagtcttgaaggacatgaaagctaaaacaaaatgtgaggaaagattaatactctattctgtaaacaaaaattagctctaaagggaaccctcatatacatgctggtaggaatgtaaagtcttttagcacctttggaaaacagtctggaagttcctcaaatggtaaaatatagagttatcatctgacctagcagttcccacacctagatacatacccaggagaattgaaaacatatatccatgcaataactcatacatgaatgttcacatctgtacataataaccaaaaagtggaaatagcccaaaagtccatcaggtgatgaataaacaaaatatggtttacccatacaatagaatattattcaacaataaagaggaatggaatgcttacatgtgctacaataacgataaaccttaaagacattatgctaagagaaagaagccagtcacaaaggatcataggttgtatgattccattgataggaaatgtccagaatggaaaatccataaagaaagtagagtaacagtggttgccagggtctgagggagggaggataaggagtgagtaccaatgggtacagagtttgtttttggaattatgaaaatgttctggcattagatagtgatgatggttgcttaaccttatgaatatgctaaaagctaatgattctatactttaaagtggcgaagtttatgatatatatatctcaataaaaattaaaagaataatacactatcaaaaaaaaaccagatttggaaatgaaccaaaaaaaatacttttagaaaagaaaaataataatcattgcagtttaaaagtcaacaagcatttcagagagcagatcagaaccagctgaaaagaacattcagtctacaaaattggccagagtggcacagaggtgaggaggtggagctgaagacagggcaatagagaggagtccccccaggaggatgtgctgcggggtagttgtcaagagggagttaagaggcttaccagaaggtgaagaaacctcagattttgaaatggagcaagttctgaacaaaataaataaaatgaattccccacctgagagaaactacagtgtgccacagacagtcctgcttattgaggaagacactcatgtttgctttgtggctttctgtggcccttatctctcatgtagtgcataccctgaatgagaagccaggaggatagcccttagattggcttctggagacagaatcttgactgtatatcctgggtcctggtgccacaagggttggttcctcagcagctatgtccacagggtctcacaagaccgtccagccataaatacagctgtagcaagatctgtataataaggggccaccatcacatttgtcatcctcagtttctcacttgaaagtggcagtgagtgagcattcacttggggctgagcttcctgctttccagccagaatgagtatagtgagcttctaggagcctggtgctgaattctcaggttgggttggatccttatatgaggaaaatgaaataaaacaagtcccagtatctttaacaaaggccttacagaaaatgcagatactttcttgatgtggctgttttcttgtattgattctcaatgaaaaccaggaggagccctttaaaacacccatcactggaggcctggtgcagtggctcatgcctgtagtcaatcctagcattctgggaggccgaggcaggtggatcacttgagtccgggagtttgagaccagcttggtcatcatggtgaaaccccatctctgctgaaaatacaaaaattagctgggcatggtggtgcgtgcctgtagtcccagctactcaggaggctgaggcagcagaattccttaaacgcaggaagcagaggttgcagtaagcagaaatcactccactgcagcctgggcaacagagtgagaccctgtctcaaaacaagaataaaaacaaaacaggccaggcgtggtggctcatgcctgtaatttgggaggccgaggtgggcagatcacctgaggttaggagttggagaccagcctggccaacatggtgaaaccccgtctctactataaaaatacaaaaattagccaagtgtagtggcgagaggctgaggcaggagaatcgcttgaacccaggaggcagagattgcagtgagccgagattgtaccattgcactccagcctgaacaagacttgtctcaaaaaacaaaaacaaaacgaaacaagaaaacacccatcagtggagattttctttgtttgtttgtttgttttttgagacagagtctcgctgtgtcgcccaggctggagtgcagtggcgcagtcttggcttactgcaacctctgtctcccaggctcaagcaattctgcctcagcctccctagtagctgggattacaggtgtatgccatgacgcccggctaatttttgtatttttagtacagatggggtttcaccatgttggccaggctggtcttgaactcctgacctcaagtgatgcgcccacctcggcctcccagtgttgggattacaggtgtgagccaccgcacctggccttcagtggagattttctttgaggcacagtgtcatgcagtggttaggggtggtgcgcaaagtaatacaccttgcaagttaggcccaggtcccccacttcctcagagagggaggagggataatcttgagacacatggtctttctgagtccatctcctctcaggcagaatggacctcccaggaaaactctcctcataggaggtatcccttaaccttaggcctgtaaagccgtatcttggtccttgcctcacggtgagcagcacatgtcagctcctgctgttgttccttcattgtgcgtcacagtggttgggcagtgagacccctgcaacctgactggcacttcctagccaagagcctcaggtggattgggagccaaatgctagcatcccaggtacagggtagcagccctgggtgaaactgtgggtcttctgctccaccctctcctaaggccaggtgtcaggcagaagcacgtagggacctgaggtaagtgactacagggcaagtaggcctgagcagacagaacctaggatggagcccatttgtaaggggggcagccctggccagctgtgctcttgcttcacagatgtctagacccattgggcaactgctgtagatcgatttacctggtgctcccagggatattgtaacaactgatacaagcccacatgcaggctggggaggtgcagttcccagtgggccactggccccagagtccctgaatggggcatctggcagaggcaggaggtggggagactcctaagggctctcaggggtcccaaccagagagggtggagcagctggagctcggcagtgccaagcaagtgtatgtcatgggccagtgctgtggtgagctcaggaagccaccgcccgccttagaaacttagatgatagttggacgttgctgtgacattctcgctgtattttacaaaacgatagttacataaaagtctgactttttttccatgtttcacaataggattctctcattttaatacatgaaaccctttcagatcagtctgaaccaggaaaattcatgttagaaaaaattagaacaagctaatattccatttccatattcagaacatctgagagaaagcatttttgactgttccaaaagcttatttaacaaaaaatttaatatgaaaatgtacatgatctgatttttacaacatagtaaaacaagctctttgaagaggcaaatgtctgacatttaaaaaaaaaaaaatttttaaaggattttgaggagcactgactcaggacttccagaatattaagctacacccacagatggatgctttgccctgttgtaggacattagaagaaaggggaacagacacttcagtttcacagagcagcgtcatgggcctcttgtcttcccagtttttcacatggatacaaatgaaaagaatccaggattctacacgctggtgtgtgtatctgcccacatttctttgacccaggtgactagcagggaaaacagctgaagacagtgcccagaggaggggctaacaggccagaggctggttagcagtgggaaggcaggcagggatgagggctcttggatactagacaggagttcactcatggtgaactccttgaggaaataagatcagtgatagcacctgtgatccagggagtctgtcatatttagagatgtttaacacagcattatgagaaacatttaccaacttcttcaaaagagaggtgttgaggaagtaagctattcattatgttgtgcctctctttaatgtttataaggaccaaagtacaggcgcccctctgtatccatgggttccacatctatggattcagccaactatggatcaaaaatatttgggaaaagaaattccacagagttccaaaaagcaaaaactgaatttgctacatgccaagtactactttgaatccatgcaaatgaagttatttttaggcattgtactatgtatacgtgatctagagattatttaaagtatataggaggctggccgggctcagctcagtggctcatacctgtaatctcagcactttgggaagccaaggcaggcagatcacctgaggtcaggaattcgagaccaccctggccaacatggcaaaacttcgtctctagtaaaaatacaaaaattagcggggcgtggtggtgcgtgcctgtaatctcagctacttgggaggctgaggcaggagagtcacttgaacctgggaggcagaggttgcagtgatccaagatcacaccactgcattccagcctgagcaacagagtgagactccgtctcaaaaaaaaaaaaaaaatggtacattggaagctgtgcctacattatatgcaaatactaaatcattttatatacgggacttgagcatccttggattttgatatctcctgggggtcctggaatcaatccccatgcagataccaaaggatgactgtactatggaaaaatagttcagatggaatgttatttgaaaaaagcccgacatacagttgtattaaagtatgattagtatataaataaatacaatcagaaatgaaaggaggcattagtaccaaccttacaaaaaggatttcgatggcatgatatttcaatgtatgccaataaaggccaggtgcagtggctcacacctgtaatcccaacactttgggaggccgaggtgggtggttcatctgaggtcaggagctcaagaccagcttggccaacatggtgaaaccccatctctattaaaaatacaaaaaattagccggttgtcacggtgcatgcctgtagtcctagctactcggggaggctgaggtatgagaatcccttgagcccaggaggcggaggttgcagcgagctgagattgtgccactgtactccagcctgggcaacagaatgagaatctgtctcaaaataaaaataaataaatcccttattatttcaacaatatgcacagcatcttcaccaggagattccatcttaagaaactactttctttgctcttccctaactagcacctcctcatttgttcaagttttttatgagattgcagcaatttagtcccatcttcaggctttacttctagttctcttactgtttccaccacatgtgtaatgactttttccactgaagtcttgaacccctcaaagtcattcatgagggttggaatccgcttcttccaaactcttgttaaggttgatattttgacatcccatgaatcactgatgttcttaatgacatctagaatggtgaatactttccagattactttgcccagatctgccagaggaatctgatatagcttacaaaatgtttttttgtttttttgagacggagtctcgctctgtcgcccaggctggagtgcagtggtgcggtctcggctcactgcaagctccacctcccgggttcacgccattctcctgcctcagcctcccaagtagctgggactacaggcaccccccaccacacctggctaattttttgtatttttagtagagacggggttttaccgtgttatccaggatggtctcggtctcctgaccttgtgatctgcctgcctcagcctcccaaagtgctgggattacaggcgggaaccaccacacctggcccacaaaattttttaattattatttttaatttatttaagagatagtgtcttgctatgttgcccaggctggagtgcagtgttattcacaggcacagtaccactacttatcaacacaagagtttttacctgctctgtttccaaactgggcagttcacctctccttaggcaacctggtgtggtctcttgctctcagaaggtcactatactgatgccaaacttagtgtggacacccaattggcatagcgcactataactcagaacttctggacttaaacagtcctcctgcctcagcctccaggtagctgggaccacaggcaaaaatgtacctcttaaataatgaaacttgaaagatgaaaatgctccttgttcatgggctgcagaatgtgtgttgtgttagttggtatgaaaacaacattcatctctgtcagagctcttggttgaccaagtgcattgccagtcagcagcaatcttttgaaaggaatctttttttccaagcagtaggtgtcaacattgggcttcaaatattcagtaaaccatgctctaaacagatgtgctgtcatctaggctttcttgttgcatttatagatttagaataattcttaagggccctaggatttttggaatagttaatgagtattgacttccacctaaaatcaccagctgcattcacttcaataagataaccagcctgtcttctgaaactttgaagccaggcattgacttcccttctctagctaggaaagtcctagatgacatcttcttctgatagaaggctgttttacctacactgacaatctgttgtttagtgttaccaccttcatccatgatcttagctagatgttctaataccttgctgcaacttctacattagcacttgctgcttcaccttgccgttttatgttatagaggcagcttctttccttaaacttcatgagccaacctctgctagcttcagactttcttctccagcttcctcacctctctcagccttcatagaaatgaaaatagttagagccttgctttggattaggctgtggattaagggagtgttgtggctggtttgatcttctatccagagcactaaaactttctccatattagcaataaggctgttttgctttcttttcaaacatgtgttcactggagtagcacttttaacttcctttaagagcttttccattgcattcacaccttggctaactggtgcaaaaggtatagcttttggcctgtctcagctttcaatgtgccttcctctttaagcttaatcatttttagcttttggtttaacacttacttagaggccattatagggttatcgattggcctaatttcaatattgttttgtctcagataatagggaggcctggggagaggaagggagacaggagaacaaccagttggtggagcagtcagaacataaacgccatttattgattaagttcagcatcttacatgggtgtggttcacagtgccccaaaacagttataatactaacatgaaagatcactaatggcagatcaccaaaacagatacaataagaatgaaaatgtttgaaatattgtgagaattatcaaaatgtgacacagagacacgaaatgagcacctgctgttggggaaatggcgccaatagacttgcttgatgcagggttgccacaaaccttcaacttgtaaaaaaaacatagtctctgcgaagcacagtgaagtaaagcacaataacacaaggtatgcctgtgtacttattcagaattgttctgtcttcttgaagaattgactccttcatctttatcactgtgtaatgtccctctttatccttgataactttactgtctctgatgcctgctttgcttacgtaactacaccacctttttttgattagtgttatcatggcatgtctttctccagtcctcgctttttttttttaatagactttatttgttagagcagtttaggttcacagctaaattgaacaggaaatacaaagagttcccacatgcccgcctccccaacatacccatagcatcccccactttcagcatcccccaccagagtggggcacaccgtcacccaaagtttacatttgggtctactcttgatgttgtacgttttacgggtttaaccaatgtataatgacatatattcatcattatatatcttacagaatagttttttgggttttttcgagacagagtctcgctctattgcccaggctggagtgcggtggcacagtcgcatctcggctcactgcaacctccgcctcccaggttcaagcaattctcctacctcagcctcccaggtagctgggattacatgtgtatgccaccacacgtggctaatttttgtatttttagtagagatggggtctcaccatgttggccaggccagtctcaaactcctgacctcaagtgatctgcccaccttggcctcccaaagtgtaggaattacaggaaagagccaccacacccagccagaatagtttcaatgccttaaaaattctgtgcttcatatagttaccttcctttccccaacccctggaaaccactgatctttttattgtctccatggttttgcctgttccaggttgtcatatagttagaatcaccccttttcttgtatttatttatttacttattttttgttcttagagatggggtctcattattttgcccaggctgctctcaagcctctgggctcgagcagtcctcctgcctcagcctaccaagtagctgggactacaggcatgagccactgtgtccacctactattaatctgtctttgtcttttgtagttaaaattaaatttttaaaaacataaacccatttcttttttttgttttttttgtttttttttttgagacggaatctcactttgtcaccaggctggagtgcagtggcacgatcttgactccctgcaacctctgcctcctgggttcaagcaattgccctgcctcagcctgccgagtagctgggactacaggcacacgccaccacacccggctaattttttgtattttagtagagacagggtttcaccgtgttggccaggacggtctcaatctcctgacctcaggtgattcacccacctcagcctcccaaagtgctgggattacaggcgtgagccaccgtgcccggccttattctttttttttaatcttcacttctttttatcttctttttctgccttctctggttttagctgagtattttatatgattcagttttctcagccaggcatggtggctcacgaccataatcccaacactttgggaggctgaggcgggtaggtcacctgaggtcaggagttcaagactggcctggccaacatgatgaaaccctgtctctactaataatacaaaaattaaccaggcgtggtggcacacacctgtaatcccagctacttgggagactgaggcaggagaatcacttgaccccagtaggtggatgttgcagtgagccaagatcacaccattgcattccaggctgggcgagaagagtgaaaatccatctccaaaaaaaaaatgataataaaataaaaataaattttctctcctctcagcattattaattatgctttaaaaaattttttttagtgattgctctagagtttacaataaacatttataacctaactctactttcaaataatattataccacttcatgggtagtagaaagagttccccactctttccttccatgccctatgacattggtaccacttatttcactcattcataaactatagtaattcaagacatggtggctgttatttgtttgaacagaaagttgtctctcagatcagttgggaatatgaaatacaaaagattctattttatgttcattgttttttttctctaacatcactcttcctttcttcatgcagatgtgagtttctggcctgcatcatttatcttctctctgaaagacttttaacatttcttgcaaggcaggtcttctggcaacagattccggtgtctctttgtttatttttgtctgacaaagtcattatttctcctttacttttgaggcataatttcactggacacagaattctaggttggcaagaggtttgtttaagcactttaaatatttcacttcactctttcttgcatgaatggtttctgaagggaagtgtgatgtaatgtttttgtgcaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccaggtgaggccagtgggcccatcctgccttctttagcccacctttctgtacttagagcttgaaggccctgtgtgcatggtaagcctcagctgggtgggtcaccttgggaaccagctggcttagacatgcagcccctggaatgtagcatggaggccacgctctccctcagatgtgcccttgactcacccagggcccttgagcaggttccctggcatcaactggcttgtccatgaggttaggatccttgtagcattcccctctgcttcctccctcccagggtggaaatgctctggtcgcaggctcagcctcacttctgggtgacctgcctttaccaaatgctaccccgtagtgttagagcaaggctcaggaacgtttctggctcttccagtctccagctgccctaaccgcagagaaggaggccatgtgtctgtctgcaccagcacttgcactgaagctgccaattccaagcccccagagagcattcaccctccaggtaagttctaggaccctgccagttctccctcaggcacacccagacattctctgtcccctactgcatacaaatcctatcttgtcacttccttggagattggtttccagtggctctccatcaccttctgggagaagtcatagcagatcggggtacccaccaactcttagcgaaattgccagcctccactctcactcacccatagcctctgtctggctttgcccttgggattccagctgctggggctgccattaccaccacatgttctggtgctcttcaggactcctctcaggtgtcctggctggaagccacctccacctccacacacagccctgggcagcctcaggcttggtgtctgtgggaatgtgtggtcataatctatctcccaaccatcctgctagctttgtcttctcagtgtctggcacagtcaatcatcagagttgtttgagctcttggaatggaagcttgtaagcatgtggttatccaaaacacaattctggagtaaataatcctttatacccagagccctcctggtcacttggcccagcatagtatctaggcctctcctgccatggtgccgtcacacacactgctgcctctctgcatacccttgtacctcagctcaggtgcgtgtcctcgagcagccttcttggaccctgcttgcgggtcacttcccactggctacacactgctctgagcccaggttggtcctcacagggcaccagagagcaggcgtcagcccttcctaccataggtccttctgggccacagtgcagaggaatgaagcagggaagccaaagggtaggaacccatagggtttgttcttattgctggtgtgaacggaggcaggggccctccagtggtcagcagcgttcagacgtgctcttgcactcagaggtgttctgacttaggttccctcctgggtgccctgcttctcagcacagaactctcccaaactcctccagcccttcccctaggcatcttgccctccaagcactgcttgggactgtcatttctgggtctgtgaagggggcagtcagccctcggcccagctcacccacttgagtggccacacaagcacagactgtttggtggttctgcctattttaccacagggaaaatctgttggtcagctccccacacacgcgtgtggctgagcccatttggtgccagacactgaattaggtgcttttcatacatgctgtgccataaacacccctgccagtttagtctcagttgagcagaccaagtctcaccaccacaggaactggagagcccctttgggggttttctaaacattccctccaagcactgacatggtctctaatcttgccaaacactgccatctttgaagattcttcaagtaggaggctagaaacccaagtctcactcccagctcggtcctttgcagtgtgcttttgggcacgttactcccttgtgagatgaagtggcagggttgggagactttggggtctttaaccctggcactgcttctcttctctggctgttcaactacacaaatgacagggtagaaaccagctcccagcattctccctgccttgggggccacatgtctggccctctgggcctcccgctcagcccctttgccctacctgccctccctctcctctcttggccagccagtctgcctctgtatcctgctgctgccttggggccccaggctacagagccttggagcatgtcacctgggctgcggcccttgtctgagcagacccgtgtgtttacttcatccaggtcagctccgatccttccatgtacattgaggtggagaatgaagtgacagtggtggggggcgtgaagctgagccgcctgaagtgcaaccgggaagggaaggagtgggagacggtactcaccagccggatcctcactgctgcgggcagctggtaagggtgggcaggtccttagccggcccaggtgacacaggcacacatgccatcattctgggcctgggcctgtctaggggaggtgcatgaccctgggagcaccagctcccacagagactcacaccaggcttcactccaggccaagcatatgtgcttgtcatctcagtccctgcagcacccagcaaggtcagcatcagtatccccgtgttacagatggggaaactgagcccttgagggttacccaggccaagctttgaacctgatggcctgattcccttgtccagccagatccccaaagtctcgaattccacactgaggtgtgcctggctcaccttgacctgggctggttccttttttggatcccagatttccatccaagttggtcaggatggatttctgactgtccctgaagtccccatcccagcccatgccagattctgcactgtgagggggaccttgattcagtgattagtcacccagtatcttcccctgggttcctagaactgtacgtgagccctgtccctacctgtgttcaatgtggaaggggaaccaatgtttctcctcaggttcctgtctgatgtagcatcccagtcaggaccagatacagtcatcataattacacccttaatcatctgccatgaggtgccatgtaaatgcttttacttgtgtcaaagcacatggccttaggtcttagaccacaattctcgtgggccctgagtgagttttgtgtttttaggcctaggggaccccactgtttgttctgttcctccctcaaattccccctccagatgagccatttaaattcccagtcccaggcacctgtgtatcagatgcttccacaggctcccactctctgtccctcccctcaaggcaggtggcttgcccagctgagggctaaggggtgtcggcacagcctctcccacagtgacatggcagctgtggggcaagcctgctggaccacgtgggacctctcctcctgcttagtcctgcccagttcaggcccagcctgcagacctgttccccagtgttacagcccaaaaatgatggctttctttgcagtgggctggcttgagccaggctctgaccaccagagatgggcagatagaattcagtcacagtaccagcctggccaacatattgaaaccccatctctaccaaaaatacaaaaattagccaggcgtggtagcatgtgcctgtaatcccagctactcgggaggctaaggtaggagaatcgcttgaactggggaggcggaggttgcagtgagccgagatcacgccactacactccagcctgggcgacagaccgagactctgtctcagaaaaaataagaattcagtcacagcactgcagagagctccttgttgcccgtgctgcttagagtgttctctgattcatactctccaagtaaacatttgtaaacaaaagcatctcacttgcctctccctttttggagccagtagcaatagtggctcattaggaaggcagttggcagagctccttccttaactgacctccttgagcctgctggagtgactggctcaccaggatagaagtgacacaaagcggggctctgggtggcctactgtggccaggatctcactgtactggctgtacatctgctacccctgcctgcgtctgagctccagcctcaccctgggcctgtggctgtgccttagggggctctgtctgggaaggcagcagcctgctcgtgcagggcccacccaggggcctggtggtcactcgggagaagctggacagtgtccagactgttctgtaacgcactccttgtttgggagcgacacacatctcccacgccagccagacagccccctggacacagaggtgcatgctgtcatccccatacttctcttagcctgccttgttagagaccttctcaggactggtctgactagttgcagccaggagactgtcctgtgggtactatgtggccttatctgatgagcaaggcatgtttcctgggtgatcatcagaggcattggctctccaaagcccccacaccccttggtcagcatcagcatgagctcaggaaagcgcaggcagcctgtggaaataggacagaagcctctttcatccaagatctcagggaggctccaacagccccaccagccctaccctgacccaatccaccttcccttctggctgtacctgctcaggggaggcccttgttgggcccaggcagagggaaggcccacacttccagggctactgtcttggctgcagcactcagcccccatgacacctgcccccactctgccttctcagtgacgtggtgtgtgtcgcctgtgaaaaaaggatgctgtcagtgttctccacctgtggtcgccgtctcctctctcccatcctcctgccatccccgatctctactttgcattgcacaggctcctacgtcatggcgctcaccgctgcagccacactctctgtctggtgagaggcaggcacagggtggggtgggcttcagccagggcaggacagggctgtgtaggccccacctcactgcaggggcagggaaggcagtggacaaggctggccatcaggccccagaagaggccctgagcagttagtgatattgcttgtgttgggtgccctgggtaggctgagggctgaggggtagtgtgcaagggggatggaggcagcttgcctgctcgattatttccttactggagcagcccatgcgaccagttgcactgccagggtcctatgcaagattcatcagaaatggagtcttagctggcagaatgtggccatgttcctgatgtggctgctgtggcctggcttcccccaaagtggtgtgggcgctgagggttccccatggctctgttgcctgggctttgtgctgcagccttaatgcagagggagtgtagtggcacatggagagcagaagccactcgtagcccagagcccctctcactaggagaggccagggttagggtcgcatgcagtagggccagggtgtctgagcagccaaggcacactctgatgtgtttacctgggttggtgagtaaactgttccctgtctccctcctagggatgttcacagacaggtggttgtggtgaaagaagagtctctacactccatcctggcaggtaatgcaggcaacaggctgtccctactcttttgggggcccaagttcatgtctgatgctgcagaagggccccgctcagagagccaggctctggcctcagcccagggctctcagtgaggcaggaggtgtggttacgctgcaggagacacacactttttgggggcatgtttgaatgggtccccaagaggtgacaaaagcctggtgtgtggcaaggagaatggcttgccctccctatttgccaaggcagtgttgatgcatttgctgctgggactgtgggagcctagagtacagatttctcctttgatatgtttgaaaacacttgctgatcagagcacacccagaactcattcccatgctgtcctcaggaagtgatatgacggtatcacagatcttgctgacgcagcatggaatcccagtaatgaacctgtccgatgggaaggcgtactgctttaatccgtcactttccacatggtaagcaagctgacccccagtcctattccctggaagagtgtctgtctgctctagacagcagagcaaagggtcgtggcctacagggctgcctagccctgcttttcctgagagtcaggccctggagtgcaggctgcattgactatctgtgcatgctcccctgtcccagcaggacactgcagcctatggcctctgccctcagagcctgtgtgcaggagcactgtcctcctgcattattttcaggaggcactttttgaaaaagccccaaaatttttatggtttttgctgtggcccccttagccaccatgagcataggttagtgggctttacaggagccttaacaggactagtcaatttctgtgagcttagtaagcacttcagacttcctcagtgaattagtaaggatgcttatccacttacccaggcatgatggtctgtacttttcctctgtccactcaggaatttggagcccttttttgtacttgcaaaataatttatacatcagagctcttaacccagacacgtgaattatgtacgttgtgttccagccactccaagttcttttcttctgtctatacctttggtccttaagaaccaaagcttgctacctcctagccccttttctgttaagaactgccatgcagaagtctacattcacactgagacttctttcttgaatttggaaaaaaaaaatctgctgggtgcgatggctcacacctgtaatcccagcgctgtggaaggctgagaggattgcttgatcccatgagtttgagaccagcttgggcaacatagtgagaccctgtctctaccaaaaaaaaaaaattttaaataagccaggtgcagtggcacacatctgtagtcccagctccttgggaagctgaagcaggagatcccttgagcccaggaggtcgaggctgcagtgagctgtaatcacactactgcacttcagcctgggcagcagagtaagaccctgtctcaaaggaaaaaaaaaatctccactgcctgctcccccaaattgcaaaatgttgtctattatatatgattgctgtaataatggaaataagctgattatttaagaagagaaatattgactctctgtaggcatctttgtattttggacacatttacaaagacatctagctgttctaaaagtgtgtgaagagtcttcttcacaaggatgagaagggtccagagaaggtggaaggactgccagtctgggatagttgtagaaatacaggcaggtagaggcctggcattgctcgctagctacagggcccaggccatgtggccctgtgggcagaccatggcagtgtttgagctgagcatcagagcacactgcacacagaggcctgcagtcatcaggaaccaacatatggagctgaagtgttcccagcaagggccctatccacagccttcacttcactcatttttcctttggaacagtgatctatcagacccattaccatgaaacctgtcagtgataggcgcctgtgcggaagtgcaggggcgctcagcctctactggctttctgtgtcggcaggggctgcttctctgtggcctctttgccagccttctctggttggcaaagaggccaaccagatctcttggttttcctgagctctgctcctgcctttgcctccccaggaacctggtttctgacaagcaggactcactggctcagtgtgcagactttaggagcagcctgccatcccaggacgccatgctgtgctcaggaccgttagccataatccagggccgcacctccaagtacgtgacctgaatgccatggccactgtccttagtcctgccctggggaagtgcctgggtcagtgcacgcacagtccctgcccaggcctggtctccacctgcccttcccctgtgccccaggtgctggtcagcacaggcaggctgggcaggacggactaggggtgctgagggtagtggtcctgcatcaggtaatatcttggggttgggggcagcaatcactggccctgtcacttcaggggcccagatggcaggtgctgggtgagataccccaagggtgccaggaggcacatggctggggcgtggggatgggcagacaacagatctggcatctgccaacagactggctagtggacgggaggccttggcagccctggtgcctgcctcctgccagctccttgcctgttgcacacgggggcagttcctgactctgtgtagtgcctgctgccccatcatggaaactctcctggtctctgcagctcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaaggtgaggctcctggcagccctgagcagccttctccttctgcccctccatcctcccaggcctcacttagtccctgtgaaatcagggaaaagatgtgatggcccagcagcctctacctcccagcctgagctgcagtcaaggcagctcagcaggcacccagccccttataggctctgaggctctgaatagagtgaccctgagggtgttcccgcagagaagcagcaggacaggcagcaggacggaggaatagatgcctgggtggaaagacatggtctgaaggagcagattctatgttctggctcctgccctgcaccacaacttggcagtgctgctaatcagtgagggcatcttgtagcagtggttctcttcctcctcccagcccttcctgccctggacaggcttgcctgatgtcctgcacttactgaggccctccatttctggcacttcccgccagagctctcactctgctgcctcccttgcagaaagccaggtgtgctggaagaggtggctgcactgtcctcacagtgactccaatagccttaccaacttttcctcccacttgagtgcagccttcagggtgcggcatggggcaggccctcccagagctctctctgtgcagcttcctgggctttttgctttatttttgtcatcaccctccccattttgattataatttagaaaaaaatttaagtacagaaaagacagagaaaatcataatcagaccttcacggatgtaattcccagaactaacatgtcacatgtgcctctggctgtgtaaatacgagtgtatgtgtgtgtgtgtgtacatacacttgtaaacgacagcaaatattactgatcaacttgaagcctcccctccctccctgcagaccacgatgatgaatttgatgtttactcttcccaccaggtctatgtggttgccattatgtgtggtccccagcttttctgaatactcagccttcccaggctctcatacctctcctgtggtgctctagtcacgtcttccctgggagcccctcctcttactccactctggtttgcttcatcctgggtgttgactgggacttgctctgatgccctgcatcaagtccccacctcctctccgccccgccacccatcttgggatgacttctgctgcttgcttctctttctccatcttccacctgcctgttctagtgtccatacaccagttacccaccctccattctgtcccttgtttccttggctgtaaaaggaggaatctagtgtaaaagtggaccccattcacttccaaaattcctcagattccagtttcatctctcttactccacccttttctttggacagtttaatccattccctattgctttagctgccccaagtgctgacaaaccccgacactctacctccagcctttctagcagccctactgggtggtgcccataacccttgagttaatggacctatgccccctccactcagttgcccctcttcagtcatgcctttgccatctcttacctcctgcgggctggccgtcccaccctcctgacctcccctcaacaccagctgccagcgcatcttctcaaagacagatctcaccagcccacaatttcccatatcttcccatcaccttaaggagtttatcacagaactggccatatctcgtttttcctctgggcccaacacacagaggaggcactacagatgtcaggggagtgagcaagtgagtgaaaatctgtgattatgggtctcagtgccccccgctgagagacatgcaggggcgtcttgcccatagtaggcaataaaatacgcatgtgtttattctgatttgatagacacaacaacatattcttgattttatttctttttgtaatgtgttcctatttctgttttgttttttgttgttgttgtttgtttgtttttctgtaattagggtttgaataccgacttcgagaaatatgcaaggacttactgggtccggttcactactccactggaagccagtgggagtcaacagtagtggtaggtgcttctttcattgttgctgcaagaattctttcttgaaacatgaaggtggagattttttaaataagccaaagtgctttgaaattgtgtcccgttagacttctccagcacccagcctcaggtcccagcatcagtgagagggtgacatgccgacggccctccacaacctggcaggagctgggccctggacatcaggagccacggagtgctccgccacgtgcctgtgctgagggaggctgcctgcaggggctctgggcttggttgtgaagacaaaagacggaaggtacttccctgccttcgtggagctcggtctggtagggatgcacacataaacagggaggcagttaggtcaacaaaatattttcagactagattcagactaagaaggaagtaagcagggtcttcagatgagagtgcctgggaaggagtgaccaggaaggccttgtgagaggacactgcggatgaaacccaaggagaagagtgagacagccatacagagacctggagaaagtgtttcctagtagaagtgagagtaaaagcaaggagtgcttgatctgtttggagccactgtggctggcacatagaaggcaaaaggagagggtggtgtgaaatgaggcaggaggtggaccacagagacctttacaggagctagcgttttcttcttggcagagttggcgcagaggtgtcatgaactaaaatagaaaaacagtcagggagtatcttctgtaacagtcccaggaagagatgaaggtgacttggatcagtgtggtggccatggagaggggaaaggagacagattcaagatgtattttggaggcagaaccaataagatttgatgggtggttggatgtggaaggaaaaagcataatgaacatgtggcacctccaggttcagctgcaaaaaatggatgccagaaccattcattaaatcaagaaggtaacaggttggtgggggatgggagaaggtatggatctaagagttagctcacagcttcattcaatcattgagcaattactgatggggcacctcccctggccaggcatgttataggcatagggcaggcagcagtgaatggggcaggcagcagtgaataaggcagactgagtccctgcattcatggatctgctttcttatggagagagacagactaagcaaatgagaagaggtatctgtagtgtcttgagtggtgatggatgccatgggaaaaaaattaaaagggcagggagatatagaatactggcaggttgctatttcatgctgggcaattaagaaaggccaggctaagctttcagtgagccaagatcgcgccactgcactccagtctgggcaatagagcgagactccgtctcaaaaaaaaaaaaagaaaagaaaaaggaaaggccaaacaaacagataagcagagaccagaaaaggtgagggatgaaaccatgcatatatttgggagaagaacatccaggcagagggaaagtgcaaaggcctgaggtgggagagcttggagtttaaaaggaacagcccaacgggatggtagcagaagggtgaaaggagttgacatcaaaaggccagagggtcagccctcacaggccttggtgtgtacagaggcctaattttttattccattcttaaatttgactgtggtgtaccttaattgactaggtactttgaatcctgggttcaaagtcaaatccccttaagtccctgaaggcattgttccatagactttgcatccagtgttattgctaaaaaaatctattgtaaatctaatttccattgctttgtaagtactttgggatcctatcttggtgttttgaagattcagaaagctcattcattctgtagaaacagagacagagaccagtgattttcttcggttttcctatttgattatttcttccctttcattttccccatcatctgagagatgtaatatcctctctttttaaaatcagctgtatcgccgggcacagtggctcatgcctgtaatcccagcactttgggaaaccgagatgggtggatcacctgaggtcaggagttcaagacctgcccggccaacatgctgaaatcccgtctctactaaaaataaaaattagctgggtgtggtggcacactcctgtaatcccagctactggggaggctgaggcaggagaatcgcttgaaccgggaggaggaggctgcagtgagccaagatcacaccactgcactccatcctgggagacagagcaaaactccgtctcaagaaaaggaaaatttaaaaaaaagtaaaatcaagtatcaggccaggcgcggtggctcatgcctataatcccagccttttgggaggccaagatgggcggatcacctgaggtcaggagtttgagaccaacccagccaacatggtgaaaccccgactctactaaaaaaaaaaattagctgggcttggtgacatgtgcctgtaatcccagctactcgggaggctgaggcaggagaatcgcttgaacctaggaggcagagccaagatcacgccattgtactccagcctgggcgacaagagcgaaactccatctcaaaaaataaaaaataaaaaggccaagcgtggtggctcactcctgtaattccagcactttgggaggccaagggggtcggatcatgaggtcaggagtttgagaccagcctggccaacttagtgaaaccccatctctactaaaaatacaaaaaattagccaggcatggtggcgggcacctgtaatcccagctacttgggaggctgaggcaggagaatcacttgaacccaggaggcggaggttgcagtgagccgagatcgcgccattgcacaccagcccaggcgacagggtgagactctgtctcaaaaaaaaaaaaatcagctgtatcatttttcatgctttcaattcttcaccagatttttaatttaggcttttatctactttagcataataatcttagttattttaaagttttatgtctgataattctagtatcaggagcctttgcagatctatttccgttgcctataaatatttctgctgtttctcattcagattgtcttatctccttatgtacctggttattttttactatctggtggacatagtatttgaaaaatttattgtagaaatagtttgaggcctaagatgatgttatcttcttctacagaacacttctatttgcttctgccaacttcttgggagtagcactgtagggactccatgatcccgttcagggactgaggttttctaggctgcctggaactcaaagctgggtgccagctgttatagaggctagtttacttccagttgacgcttattctaggttgcgtacctttggaataccaggacaaaggaggggtaagttaacagggccctagcccctgctatggtccccctaggccctcaagttgtttgtttgttttgtttgtttattttgagacggagtctcgctctgtcacccgggctggagtacagtggcacaatatcagctcactgtaacctctgcctcctgggttcaagcaattctcctgcctcagcctcccaagtagctggaattacaggcacacaccactacacccagctaatttttatttttttagtagaggcggggtttcaccatgttgaccaggctggtctcaaactcctgacctcaggtgatctacccacctcagcctcccgaagtgctgggattatagacatgagccaccgctcccaacccaggccctcaagtttggtagaagttctgcctagcttcttcctcatggataaatatttccaaagcaaaggcatccctctttggatctctgtcttccccacagcatggctcagtcatttatcattaacacattagctctcagaagtttgctgctatttgtccacctttttttctttgttgtcagtgaggaaggctgttctgaattgcatggtctattaatggaaggaaaggcttgtgatatcttctcagatatcagctacagatgctaacattttctaaaataatttgttccctgaattatctggcttttctgggttcaatctttgatttgttcattgcggtctttacttgaggacattttaccctatctggaaatccttggttatcaggttgtagttacaagtgaagaacccagattgatagtggcctcaggtttccttttcaagagtacagctgttcgcttagcacagcttagcacatctcacctccaggacaggccgatgagccatctactagagtgggaggcaggcagaaacctgcccagtgagtccccctcatgggcaggttgtggagcttcattctgtcagccttagcccaagatgcccgccaaagctcaccatagtagttctctttctcagcctgaaagtaagcactctgggccgtggtggtatagacagaaggagccacaaacaggctaccatttgatggccatgatttcttcttctcccctccttcctgctgattattcttaccaactccaaacaggacacttcactgaggctctgcctaagagaatctgtggttcccctcccagagtcacctgtcagtatgtaccacccgcttaccaccctctgtaaaggtctcctagcccttccctcatggttacaaggtggcttccatgtccaagatcagggaaggagagagaacaggagaaatctggcaacagcaacattcaccctctcatcagaaaagaaacgctctcccagaaactagtctgtgcctcacaggcaaccattaaatcacttgggcacccacctctgctgcaagggaggctgggaaaatgagcaggttttctccctctgtacaaagaatatgtaagagaagaggatttagagcagacgtagacatagccaatcccagtgtcttctgccaggtcctctcctgatctcaacactattctgaatttgttcctttttttctgtatgtttactgtcttttcatctagatgttggggcagaggagatgagtgagcatgagccttctgtgctcttcttgggtttatttatcaacactcttttattttatttatgtgtttatttgagacgaagtctctctctgtcacccaggctggagtgtggaatgcagtggcccacctcagcctcccaaagtgctgggattacaggcgtgagccaccgtgcctggccttatttatcaacatttatggtgagaattggtcattcaagtggaactgatccttcaaataactgggaaaatatagctgtggttggagggtggacttccaaccagccatgctgactcagcagccctcccaagaaggcttgttaggagagcatcatttcacatgcttaagagccgcttgtgtttcccttttttgaactatctattgaaatacttgttgccatttgtttttctcaatggtttgtaggaactctatgtatattataggagctctttatatactctgatttgagctgccagtgcaccacagggacaccaaaggttcagatttctttcaacttcaaggatcctttgcatggttcagtgtgcatgggaggaaaatgagaagcagaaggttggggcactaagcaaacacctttcaggttcctgggctttgttctggctccagcctccccagccaggccctgttcttaggaagcctccctttgctgtggtcttcagtgtaagacaggggtccccaacctctgggccacagaccagtcagcagcaacattaaattctcataggagcacaaaccctattgtgaacttcacatatgagagatctaggttgtgtgctccttatgagaatctaatgcctgatgatctgaggtggaacagttttatcctgaaaccgtcttcccctcccccactggtccataaaaaaaaaccagtcctgggtgccgaaaaggttggggactgctgctgtaagacctgtggcagtggccagagaggtggtgattaagttgtgtgttgcaggctgtacaaagagctatacatcgcatcctgaaagagtggaaaaaccatcctttactgagagccgaagggtgaggaaatatcaataatacttggctgctctttacattgccttcaggccagagggcaagtcctcttgcagcttcttcctagtaccacaggcaggcagaatgttttgctttgtttatagtagtttttcgctgaatctttagggttttccatatataagatcatgtcatctgtgaacagaaataattttacttcttttttcccaatttggttgccttttatttcttctccttgcctaattgatctgtctaggactcttaatactacgttaaatattagtgctggaagcaggcatccttctcttgttcctgatattaaaggaaaagcttttagtcttttaccattaagtacgatgttagctgtgggctttttatttatggtctttactatgtcgagatagttttcttccattcctagtttgttgagtgcttttatcaagaaagaatgttgcattttctcagatgctttttctgcattaagatgatcgtgtcattttaaaattttcttttatttcattaatgtgatgtattacagtgattggttttcatatgttaaaccattcttgcattcaaggaataaatcccacttggtcatggtgtataattcttttaatgtactttggaattctgtttgctggcattttgttgaggatttttgggtcactgtttacaaaggatattgatctaatagttttcttgtagtatctttgtctagctttgtcagggtaatgctgtcctcatagaatgaaataggaagtgttcctacctattttggaaggaggattggtgttaattctctaagtgtttggtagaatacatcagagaagctatatgatcctaggcttttctttatgagagggtttgttttattgattcagttttcttgctcattagagatccgtccagatttttaatttctttatgagccagtcttggtaagttgtttccattttatgtaggttatcagatttattgtcatatagttgttcatgctgttctcttatttataatcttttttatttttgtggcattggttgtaatgtccctgctttcatttttgattttcattatttggatcttgtctctctttttattatgtagtctagctaaaagtttgtcaattttgttcatcttttcaaagaatcaacttttggtttcattgattatctctattattttccatttatcttgtcccattatctttattattttcttctgctagctttgggtatagttctttttctagttccttaaggtgtaatgttagattattgatttgagatcagctttcactgcatactgtaagttttggtatgttgtattttcattttcatttgtctcactttgtttaatagtgtgttttttcagccaggcgtggtggctcacacctgtaatcccagcactttgggaagctgaggtgggaagatcacttgaggtcaggaattcgagaccagcctgagcaacatagcaagactctctctctctctctctcttttttttttttcccctcactgtggcctcaaccttctggctcaatcaatcctcctgcctctgcctcccgagtagctgggattacaggcgtgcaccaccacacccaactaattgttgtatcttttgtagagatggggttttctccatgttgcccaggctggtctcaaattcctaggctcaatcaatccacccgtctcaggctcccaaagtgttgggattacaggtgtaagccaccacacccaaccaactccatctgtttttataaaaatacatgaaatttaaaataacagtgtgttttccaacttccacgatgttgtagatttttggagacagagtctgactctgccacccaggctggagtacattggtgtaatctcgacttacttcaacctccacctcccaggctcaagtgggcctcccacctcagcctcctgagtagctgggaccacagatgtgcgccaccatgcctggcaaattttttatttttattttttttcttggtagaggtgggattttgctgtgttgcccaggctggtcccaaactcctgagctcaagcaatccacctacctcagcctcccaaagtgctgggattacaggtgtgagccactgcacctggcctctttctttcttttgaatatgtcatcccactgactatgctgataatcttattgaatatcctatttacatgagttgctttttttctttttttgacattttagtgcacccatcacctgagcagtgtacactgtacccaatgtgtagtcttttatcactcaccctcttcacccttccccctgagtccccaaagtccattacatcattgttatacctttgcatcctcataggttagctcctacttataagtgagaacatataatgtttggttttccattcctgagttacttcacttagaataatggtctccaactccatccaggttgctgtgaatgccattatttcattcctttttaaggctgagtagtattccatggtgtatatataccacattttctttatccactcattggttgatgggcatttagactggttccgtatttttgcagttgcaaatggtgctgctataaacgtgtgtacaagtgtattgttcacataatgacttcttttcctctgggtagatacacagtagtgggattgctggatcaaatggtagttctacttttagttctttaaggaatctctggccaggtgcagtggctcatgcctgtaatcccagcactttgggaggctgaggcggaaagatcacctgaggtcaggagttcgagaccagcacagccaacatggtgaaaccctgtctctactaaaaatacaaaaaattagccaaccatggtggcgcatgcctatagtcccagctactcaggaggctgaggcaggagaatcacttgaacccaggaggcagaggttccagtgagccgagatcgcgccactgcattccagcctgggtgacagagtgagactccatctccagaacgagtccccatactgttttccacggtggttgtactagtttacattcccaccagcagtgtaaaagtgttcccttttcaccacctccatgctaatatctattttttttattttttaattatggccattcttgcaggagtaaggtggtatgtcattgtggttttgatttgcatttccctgataattagtgatgttgagcatttttttcatatgtttgttggtcatttgtatatcttcttttgagaattgtctattcatgttctttgtccactttttaatggggttatttgtttttatcttgctgatttgtttgagttccttgtagattccagatattagtcctttgtcagatgcatagtttgcaaatattttctcccactctgtgggttgtctgtttactctgctgattatttcttttgctgtgcagaagcttttaagtttaattaggtgccatctctttatccttgtttttgttgcatttgcttttgggttcgtagtcatgaactatttgcctaagccaatgtctagaagagtttttccgatgttatcttctagaattgttgtggtttcagatcgtagatttaagtctttgatccatcttgaattgatatttgtataagatgagagatgaggatccagcttcattcttctatatgtggcttgccagttatcccagcaccacttgttgaatagggtgtttgttccccactctgtatttttgtttgctttgttgaagatctgttggctgtaagtatttggctttatttctgggttctctattctgttccattggtctgtttgcctatttttataccagtaccatgctgttttggtggtaactatatccttgtagtatagtttgatgtcgggtaatgtgatgcctccagctttatcttgctttggctatttgggctcttttgttccatatgattttttttttttttttttttgaaacagggtcccactctgtcacccaggttggagtgcagtggcacaatctcggctcatggcaaactctgcctccaaggctcaagtgatcctgcacctcagcctcctgagtagctgggactacagcatgtgccagcacacccggctaatttttgtatgttttgtaaagatagggtttcaccatgttgtctaggctggtctcgaactcctgggctcaagtgatctgcccattttagcctcccaaagtgctgggattacagacgtgagccaccacacccagctgatttttgtatattttgtagagacagagtttcgccatgttgcccagactggtttcgaactcctgggctcaagtgatctgcctaccttagcctcccaaagtgctggaattacaggcgtgagccaccacaccctgctgtggtttcttgtgaattttagggttgttttttctagttctgtgaagaataatcatggtagtttgatgggaattgcattgaatctgtagattgctcttagcagtatggtcatttttaattttacctaccatgagcattagatgtgtttccatttatttgtgttgtctatgatttctttcagcaatcagtttttcagtttttcttgtagagatctttcacatccttggttaggtatattccgaagtattttattttattttatttgcagctattgtaacaagaggttcttgatttgattctcagcttggtcattgttggtatacagcagtgttactgatttgtgtacattgattttgtaccctgaaagtttacggaattcatttattagatctaggagctttttggatgagtctttagggttttctaggtatacgatcatatcattggcaaacagcgatattttgacttcccctttacatatttggatgccctttatttctttctcttgtctgtttgctctggctaggacttccagtacaatgttgaatagcagtggtgacagtgggcatccttgtctgttagagttctcagggggaacccttttatcttttcccttttcagtataaagtcaactgtgagtttgtcatagtggcttttattaccttgaggtatttccattctatgacggttttcctgagggctttaatcgaaggcatgctagattttgtcagatgctttttcggcatctattgagatgatcatatgattttgtttttaattctgtttatgtgatgtatctcatttattgacatgcgtacgttaagtcttccctgtatccctggtatgaaacccacttgatcatggtgtattatctttttgatacaccatttgattccattaggtagtattttgttgaggatttttgcatctatgttcaccagggatattggtctgtagatttcattttttgttatgtcctttcctggttttggtattagggtgatactggcttcatagagtgatttagggagattccctctttctctgtcttttgtaatagcttcagtaagattggtacaaattcttctttgaatgttcaatagaattcagctgtgaatccatctggtcccagactgtttttttgttggcaatttttaaattactgtttcagtcttgctacttattattggtctgttcaaagtttctattttttcctgaatgaatctaggagggttatatatttccaggaatttatccatttcctctagattttctagtttgtgtgcataaaggtgttcatagtagtcttgaatgatcttttctatttctgtggtatcagttgtaatatctttcattttgtttctaatttagcttaattggatcttttttttttttttttgagacggagtctcgctctgtcgcccaggctggagtgcagtggtgcatctcggctcactacaacctctgcctcccaggttcaagcaattctcaggcctcagcctcccaagtagctgggactacaggcatgcgtcaccacacccagctaatttttttctatttttaatagagacggggttttggcattttggccaggctggtcttgaactcctgacctcaagtgatcctcctgccttggcctccaaaattgctgggattacagacacgagccaccgtgcttggcctctttcatactttttgatgtaagcatttaatgctatcaactttcctcttagcaccacttttgctgtgtcccagaggttttgataagctgtgtcattattcagttcataaaactttttaatttccatcttgatttcattgtttacccaaagatcattcaggagcatattttttaatttccatgtatttgtatagttttgagggttccttttggagttaatttccaattttattttactgtggtctaagagggtacttgatataatttcgattttcttaagtttattgagagttgttttgtggcctatcatatggtctttcttggagaatgttccatgtgctgatgaaaagaatgtatattctgcagttgttgggtagaatgttctgtaaatatgtgttaagtccatttgttctagggtatagtgtaagtccattgtttctttgttgcttttctgtcttgatgacctgtctagtgttgaagtccccgctgttactgtgttgctgtgtatctcatttcttacgttgagtactaattgttttataaatttgggagctcccgtgctaggtgcatatatatttaggattgtgatattttcctgttggactgatccttttatcattatgtaatgtccctttttgtctttttcaactattgttgctttaaagtctgttttgtctgatataagaatagctatttctgctcgcttttggtttgtatttgcatggaatatcttttttcacccctttaccctcaacttatgtgagtccatatgtgttagcagatatttggttggtggatttgtatccattctgccattctgtatcttttaagtggagcatttagactatttacattcaatgttagtatcgagatgtgaggtactgttttatttaccatgcttgtttttacctgaataccttctttttttgttggttttttttttttcattttgttattgttttatagaccctgtgagttttatgctttaaggaagttctattttggtgtatttcaaggttttgtttcaagatttagaactccttttagcatttcttgtagtgctggcttggtggtggcaaattctctcagcatttgtctgaaaaagactttatgcctccttcatatatgacacttaattttgctggatactaaattcttggctggcagttagtttgtttgaggaagctaaaaataggaacccaaacccttctggcttgtagggtatctgctgagaaatctgctgttaatctgataggtattctggccaggcgcagtggctcattcgtgtaatcccaacacttagggaggccaaggtgggtggatcatttaaggtcaggagttcaagaccagcctggccaacacggtgaaaccccacctctaataaaaatacaaaaattatccaggcctggtggcaggggcctgtagtcccagctacttgggaggctgaggcaggagaattgcgtgaaccagggcggcagagattgcagtgagccaagattgcaccactgcactccagcctggatgacaaagcaagactctgtctcaaaaaaaaaaatccgataggcttttgtgtataggttacctgatgcttttgccttacagctcttaagattctttcctttgtcttgactttagataacctgatgactgtgtacctgggtgatgatctttttgtgataaatttcccaggtgttctttgagcttcttgtatttggatgtctagatctctagcaaggtcagggaagctttcctcaactatccccacaaatacgtttttcagacttttagatttctcttcttaggaacaccatttattcttactcttaggtttggccatttaacataatcccaaatttcttggaggctttgttcatttttttaaaaaattattttttctttgtttttgtctgattcaaagtcttgtctttgaattctgaagttctctcttctacttctttgattctattgttgaaactttctagtgcattttgtatttctctaagtgtgtcttttatttccagaagttttgatttttgattttttgattttttctttatgataccgatttctctggagcatttttcatccatatcctatatattttttaaaatttcttgaagttgattttcacctttggtatctccttgagtagcttaataatcagccttctgaattctttggcaattcagagatcacgccactgcactccagcctggacaacagagcgagaccctgtctcaaaaaaaaaagaaaaagaaaaagccaaaaagttctgcctttttaagccaaataatgaaaatgtactttgtaattattcttggtttggatccattgctgaggagctagtgtggtcttttggaggtattatagaaccttgttttgtcattattgccagaattacttttctgattacttctcatttgggtagactagttcagtggaaaaatctggaactcagaggctgctgttgagattattttgtcccacagggtgatcccttgatttggtgcacttccccttcccctagggatggagattcctatgagccagactgcggtgattattattgcccttctgggtctagccacccagtggggctaccaggctctgggcccatgctggggaacgtctgcaaagaacccggtgatgtgatccatcttcagatctcccagctgtggataccagcacctgctgtggtggtggtgccaggggaatggcgtagactctgtgagagtccttgtttgtagatatgtttagtgtgcaggctttctcaaatgctggttatgctaccagtgaagtcatcatgtggacacactcaggaccactggttagaaaggatgttgcaggcagtggaattagctgttgtttttctccttccttggagcagggttgttctgttatgaattgctgtaatgtcctgagttaattggcctccagccaggagatggcacttttgagagagcaccagagtttttcacctgtcttgtggaatttgcagcagcctgccacttctttcaaaggatctgtgatttctttcggtcttcctggtgtgcttttgcagtggttcctgaattctctactcaaattactggccagatgagatcacctagggttcaaggtcctcttccaagctcagtcgttattggaatagcagaattcatttccttgttagctttccacctgcctcctccatctttaagccagcaattgtgcgtgtagttcttcacaaacttcaaatccctctcatgagtcactttttttttgccactttcaagattgtctcttttgagaattataaagtatctaagaataaatctaacaaaggatgtacatagcctatatgctaagaattataaacgtttacttaaagtcattaaagaaaacctggacaaacgatgagaaagtgcagtacagtaaaagacgccaaccgtttctaaacagacctactgactcaatgcctctctaatcaaatgcccactagaggtttcaatgaaacttgacaagctaattcaacaatttatatggagcagtaaaaagccaagaatagttaagacattcactatgctaccagatatttgggtttattatgaagccggagtaatttagatactttgctatatgagagagaagacaaaacagatacagtgggaaaaatagggggggctattcaataaatggagtttaggaaactggttatttatatgtaactaagtaaaagcagatcttcagttcataaaaatatacctccaaagggttaagaattaaatgtcaaaagtgttcatctaaatgtcaaaatgtaaaaaagttctggttcggcgcggtggctcacgcctgtaatcccagcactttgggaggccgaggtggacagatcacttgaggccaggagttcaagaccagcctggccaacgtggcgaaaccccatctctactagaaatacaaaaattagccgggtgtggtggcacatgcctgtagtcccagctactcaggaggcgaagacacaagaattgcttgaacctgagaggcagaggttgcagtgagccaagatcacgccactgcactccagcctgggcaacagagcgcaagaccctgtctcaaaaaaaaaaaaagtcaaaaagttctgcctttttaagccaaataatgaaaatgtagtttgtaattataacatatgtagaagtgaagtggcatgacagcagtatcacagacgccaggagtggggatatgaaagtataccattaaaagatttttacacattatgcaaagtgatataatacttgaagacagactatgataagtaaaggcatatactgtatgttatatgccctagagcaaccaccaaaaccaaaaaataaaactcatgcacatacacgtacaaatcccaaagcagtaaaaagaatcgtagctaaaaaactaacaaatagataaaattgaatgatagaaaataatacattcattcaaaagaaggcagaaaaacatacataggatggtagatttaaaccctaatatatcaataatcattaaatataggtctaaaaggcatagattatcagattagaattaataacaaccagctgtatgctgcttataagaaacccagcttacatgtaataacacaatggcttaaaagtaaaaggactgccgggtgcgttggttcatgccttaatcccagcactttgggaggccaaggcaggtggatcacctgaggtcaggactggctaattttagtatttttagtggagatggggtttcgccatgttggccagactggtctcgaactcctgacctcaagtgatccagccgcctcagcctcccaaagtgctgggattataggcgtgagccaccacgcctggcctaatttttgtatttttagtagagatggggtttcaccatgttggctaggctgatttcaaactcctggcctcaagcgatctgcccgccttggcctcccaaagtgctgagattacaggcatgagccactgtgcccatcagacataagactttaaaataaatgtcttaaaaaatgctcaaggagaatacagacaactaaacaaaatcaggaaaactatatatgaagaaaatgagggccgggtgcagtggctcatgcctgtaatcccagcactttgggaggccaaggcgggcggatcacaaggtcaggagatcgagaccatccttgctaacatggtggaaccccatctctactaaaaatacaaaaaaattagccaggcgtgctggccggcgcctgtagtcccagctactcgggaggctgaggcaggagaatggtgtgaacccaggaggcggagcttgcagtgagccgagatcacaccactgcactccagcctgggcgacagatcgaggctccatctcaagaaaaaaaaaaagaaaatgagagtatcaacaaggagatagaaattccaaaaaaagagctaaacagaaatctggagtttaaaaatacaataactgaattgaaaagttcactagaagggttcaacagcagactcgaatagacaaaagggtaaatcagcaaacttgaaaacaggtcatttgaaattatcaagtatgaggagcaaaaagaaaatagaatgaagaaaagcaaacagagtctaagagacttaccagacaccatccaagtatacccatgaatccataatgggagttctagaagtgtaagagagagaaaggagtagagagcttatttgaagaaatactggcggaaattttccaaatttgaggaaagacgggggtctactaatacaagagcctcagtgaactctaagtaggaaaatcccaaaggaacctgcactgagacacattagtcaaactgtgggaaaggaaagacaaagaaaatctcatccttgatgtcagttttaaaatagtattcctgatgttttctttatggtaataattaacttttcctttctatttctttttgagctagttttgataaattatatttttctaggaatttctccattttctctaaatgttcaaatttcttagcataaagttgatagtaatcatatctttttctttcttctatatctgtagttatgtctctttttatttctaatattatttctttaagctttctctctctttcttgattaatcctgccagacgtttgtccattagtcttttcaagaaatgacttttgccaggcatagtggctcacgcctttaatcccagcactttgggagaacaaggcaggaagatcacttgagctcaggagtttgagatcagcctggccaacaaggtgaaaccccgctctactaaatatataaaaattagccagacatggtggcacacacctatagtcccagctactcgggtaactgaggcaggaggatcacttgagcctgggaggttgaggctgcagcgagctgtgattgcaccactacgctccagcctgggcaacagagctagaccctgtctcaaaaaaatatataaaataaaattgtttttctaaatcttctctattaaatctttgttttctattttatttatttcaatttttattatctcctttttttaaaaaaaatgtttttttctcatgtcctttttttctttagtctttttttttttcctttcccctgatggctttaggttggagtcttggcttgtcattctttcatgttctctaatacagtataagctgttgtttctaaatgcctctaaagtgcccacttttgctgaatcttaccacttttggagtattttgtgttggttttttttttttaccattctcttgcaagtcatttttaatttcacttaattagaattcccctttgacctatgagttttactcaattattttagttagaaaacatgatctattttaggagttgacaaacttttctgtaaaggaccagatagtaaacatttcagcctttgcaaatccataccatctctgttctgactatggcactctggtgtcagagcctccctgttggagtgtgggctgctcctccatcaaacttggtcgccaacagcagccattctcctgcttatcccatctctaacaacttctgtgttactcaaacctaatagttacacttattctttactgtcacttctagacttgttgcaggtatatctgtcaccgttaattcaagatcttagaccttctcgtccagtgttaaagttgtctggctggtagttttccctttggagcagccgtactgctcaggagtctgctcttttggtctgtgcagcagagaccccaactggcaatgcttgtttcagactgtggtgccaatatgacctgacgtggaggatgtttaggcaactaagcatagtttggtcagcatccgaacatcctccacatcaggggatactggcacctcatttgtgttgctggaaaactaaagccagtcactgccccccaggtgcatccttgccctggggcttgacctcaaacccctggcaaacatcagcatgagggaacagcccctcctgaatggccagccacctgaccctcagccttgttctactctcatcctgccctggatggtcagggaactgctcagtcactataaggtcagcagtggctgtgcccacggatggaggagcagaccctgcattggcctcatcctcctttatccccacactgtgttgctcccattccacctgccacttcatcctgcacatttgccccacagctctctcacagtttctcacctgcagaggaattgttctttccttctcccgtgagcagacacaaggttctctgccaggccaggaaagtccccacaatctaggtctcttcactgacacttgcactcagctgtcactctgtgtccacagggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcgccatgctgcttcagcagtgacgattgagccatttgtgagagagaatccggaagcgttaggtattacagcagactgacctaagacctatgtaaaaggaaagctgttccaacacacggactatttttgtactagaatttgctaacttgtaatattgaatttcctttggccgataatcaggatttccctataagtcacttggacattggtcacttgtaggaaatttaaactctaattatgacagctacactgaaaaataattgtactgaaattaacttgtctatcttcatttggttttaatttttaaatgtttgtaaaaagagactgttttgggggaatggggcaaaggggtgggcgatttcttttgtaagtgtaaaataaatgaacacgcattgaataccaaaccctcctgatttctcttgccttttccttctaactttcatcctccccacacagtgcatctctctcctgaagtagatggtgacagaacatgagagccagaagggatcctttgtgtcatctcattcccccctgtcatggttaatactgcgtgtcaacttgattggattgaaggatgcaatattgatcctggatgtgtctgtgagggtgttgccaaaggagattaacatttgagtcaggctggggaaggcagacccactcttaatcaggtgggcaccatctaatcagctgccaacgaatataaagcaggcagaaaaatgtgaagagatgagacttgcttagcctcccagcctacatctttctcccgtgctggatgcttcctgccctcaaacatcggactcccaagttcttcaattttgggactcgaactggctctccttgctcctcagcttgcagatggcctattgtgggaccttgtgattgtgtaagttaatacttaataaactttcatatatatcctattagttctgtccctgtagagaaccctaatataccccccatgcagaaattcatttcacagtgtagagtggtcacttctgtggtcatgaagcaccataggtcaccttgcacacgtcatctcacaagtgaggagtcatggttcatggtggttcatggttctggtcttgctgtgccccaggtccagatcatactgtgcaccaagggctgcagctgtttggacaatttcatgaaaggaaatcagtatttacagtcttgggtatattggagaattatcagcaaagttggaattttattagaaagtgatccagacgttgatctacaggagaagaaacagaatcacagaatctttaagcacagtgagggctgagtaccacccactcctgggtcctgatctttgtcaccaccacccagtgtgtgggtctgagcctggagaaggagccttggacttggagtcagaggccggggtaactgaccactgatctctggcctagcagccattccactccatgtctcactcggatgtcaagtggctggatgagacccaggcatgtgttcatgccaaataaagccaggatagtttgtgtgagtgtgtgtgtgtgtacacataaaaagccaggctgcaagtgggactcttaaggaatgaagagccagagacttgctgtgcaggtgaggcagctcccttagcaactatgcagcaagacattgcgagctttgtggagctccaggaagcaatatatgccaacaggcctgtctgggctccaaaccagcaaacatctgggcctcagttttttagctgtcaaatagagattgagactaaaaaaatctgcactggggtcgggcacagtggctcacacctataatcccagcactctgggaggccaaggtgggcagatcacgaggtcaggagttcgagccagcctgaccaacatgatgaaacccccgtctctactaaaaatacaaaaattagctgggtgtggtggcacacacctgtaatcccagctactcgggaggctgaggcaggagaattgcttgaacccgggaggcagaggttgcagtgagccaagatcgcgccactgcactccagcctcggcaacagagcaagactccgtctcaaaaaaaaaaaaaaaaaaaaaaatctgcaacgttatgaggacaaattgagattgtgtgggcaaagtcttcgcacgtttcctcccttgaaggaaacagcagtcgtgagtgactttaccaccaccgtttggagatgatgaagagataagcagaaaacatcaaggccttcaacttacagacaagatggagtaacagggaccaggttgacccttctacctgaaacaaccaaaggagcccgtcaaaaatacatgcaatggtggtttcaagacactggataccatgctgggcacagtagcatgcgcttggagacctagctacatgggaggctgaggtgggaggaccatttgaggccaggagttcaaggctgcaattagccatgatcatggcactgcactccagcctgggcaacacaggaagatcccatcttgaagaaaaaaaagaaaaagaaaaaa

SEQ ID NO: 14159 - DNA, 57054 bp, Human
tcgttcagctttggctcaaaacataatgcagaaaacgaaatctagtaaaaacagaagacaaattagctgataaactttgttggcataattagtaccataaaatctggaaaagctaaatcttaaattaaaaattttttagatttccaggataattcacaaatgtttatagattcagaaacaaaaggcccattgctttatactttacatcatagacaaccactgcagttttctaatatgggtttcaccttcttcaaacctgatattcttaaaatgtggagttcaaactgactatagttaagaacgaaacaaatagccaatacaaagaataataaaaggatgagttcaaattatctgccacatgtcatcaacttttattaaatgataaaaaggttaattaaaattgtaaatgatttttcagaagaaattacatcttaaaattggcctgtgaaagtggcttgaaaggtataaaaatctaccagtagctggtattagctttcttagtaatttaattttcagttagagaaagccagaccactttgacctttcgaagtcctttggtatagatacatatacatttaaaaagataaatgaaaacaagccattgattaataatgcccatcgcagaagctgtaattataaaattaagattttttgatgtcactgttgatgttgaatatagttaatagaaaagcaaaaataaaaaataaaaaaggtctaattttgaggcactcttttgtctctgctcaggtccaccgtcttccttgctaatgtttacgtttattattaatttttccatttatttatttacttttaccacaattaggggacagagaatgaaacctaaactttttattgcttctgtaaagagtgaatataaatgtaagattttttttttttgagacggagttttgctcttgttgcccaggctgcagttcagtggcgcaatctcggctcactgcaacctctgcctcccaggttcaagcaattctgctgtctcagcctcccaagtagctgggattacaggcccgcgccacctctcctggctaattttttgtatttagtagagacggagtttcaccatgtaggtcaggctggtctcgaactcctgacctcaggtgatccacccgcttcggcctcccaaattgctgggattacaggcgttgagccccggcgcccggccaccaaatcctttttcaaaacaactcccttctttgacacagtgcaatttaaataagtatacaattaacaaagtacgtttttcttgttcaaaaccatcactgaacagtttgcaacagtagggtatgaatgcatacaatctcgatggtctttacaccttcagaggctattcggacttaaggaaacgtgcatttacaagtgtaaatgtaaaagctcagtagttgccttgtaaagtgcttttcggggttgtggggttgggggtggtaggagtaggtggtgcctcaaattatactagcgaataccaacattcccaaacatctagccctctgcctaaactcacccggttgcggtctgtcattttcgctcttctttgttaattttttcggcaaagtcagttttcatgcagcagatggcaagaaagccggtgaacgcctagggacgtggccttttaaccgcacccaattaaagcagcaaacagaagatgaatagctgggtggatcagtatgtgtaaacctatccgtttaatccggggagctgttttcccgggtgaaaccacgaattctttctggaggttgcaactcgtaaccatagcaactggaagtggtcgccggctcccggatgttgtggggatctgcggccgcctggcccagcttcccgcagccgcccggcggcggcctgcgctccacttcgggagtggtagttcttctcttcaccgctgccgggcaggaggcgcaggcgggactacgcgtcacggcatgcactgcggcgcccagccggtcaccgcctgccggctgcagacgcctgcgagcaggttgtttttataagaggcgtcattggcgcccgagctgtgaccgccgccactggggcagccagcacaatcgggcggaggtggcgctgccccttcaggtactgtactaggcgggcttagaccccgggagggggtttgtgccgactgtctgagtccctggccgacacgctcggctcagtagaggagcagtggcggggtccgcctcctaggctggggctgctcgggcggggacttgacgcctggtgtcagcggccgcacgggcgacctcctcgggccgtgcgcgagtgcacagctccggaggcccgagccgaccctggggcgtccggtccggtggtcttgcagcctccaaaccccgagtgctataccgaactgcgcgccaagggtgggagagctgacggcctgggccacccttcttccttcactgggcaggctttgaggtgcttgtcggtctggactgatgaaaatccatatggtaagatgttatgtgcgtcaccctgccgggtttaatgccagcctgtcttttgatgacatttgagcccccgtgatgtcaggaatagaaagattaaatattaaataatgcccggagacttccgctagcacgccagcctgatgatgatcaaatacctctccatatccttctccagttccagtggcctcctttagctttggtctccctaatcgatttgtcctcattagcagctgtcccatgcagtgccttgtacgcgttgtttatgtttagcactattgggagcgccaagtaaggtattttattgagtggtgaagtttgcactgttctgctctacttttattgaaaaacacagttgggcattcttgtagttagaatagctaactatatagtactatgaattttagatttgtctcctccaatctacaggatagtgcttgaaatatcgctattactgcatcgtatcttttaagattagaatcatattgggtcccacacgtctcaggggatatttatcacacacatccagtgtgaatggtttacttttattttctgagttcaggtcatatagcagaagatggagatggtgagggtattattttaattcatattttttttttttttttgagagagggtttcgctcttgttgcccaggctggagtgcagtggcgcgatctcggctcactgcaacctctgccttccagtttcaaacgattctcctgcctcagcctcccgagtatctgggattacaggcgcccgccaccacgcccagctaaattttgtatttttagtagagacggcggggcggtggggggggtctcaccgtgtcggccaggctggtctcggactcctgacctcgtgatccgcccacttcggcctcccagagtgctgggattacaggcgtgacccaccgcgcgggcgttaattcataatttttaaccttttacgctgagggcggaatttcagtcaaaaaagctgattaaaaatcagcccaaatacaatttaaaggtgtgggaaatactccttcttagatgaaaacagtttagaaaatagtgtaattgcaattttgtaaaccatggaacaaaaagtgaacataacttcttttagaaatgacttaaagggtccagagcggtggctcaggcttgtaatcccagcactttgggaggcccatgcaggtggatcacctgaggtcaggagttcgagaccagcctggccgacacggtgaaaccccgtctctactaaaaatacaaaaattagcctgtaatcccagctacttgggaggctgaagcaggagaattacttgaacccgggaggcggaggttgcagtgagccacaagatctggccaccgcactccaacctgggtgacagagtgagattatctcaaaaaaacaaaaaaaaaaaaacaaaaaaaaaaaaagagaaaaagaaagaaaagaaataaaggatattcacagttataaaagtgtagatagtgaaactagaaatgatttttcttgtactttcctgtatttttcaagttttctgtagaaaaaacttttaaaaaaggatgcaagtattaacagcactttgagagtttctatatcatttttttcactttctagtggaaagccccacccttatgcaaaaaaaaaaaaaaagcagcaattccagttatggactctatgaacattactttaaaaagaaaataaaggcctagagcagtggctcatgcctgtaatcccaggactttgggaagccaaggcaggcggatcacttgaggtcaggacttcaaggccagcctggccaacgtggcaaaaccccgtctctactaaaaatacaaaaattagctgggcatggtggcggatgcctgttatctcagctattcaggaggctgaggcaggagaatcgcttgaacccgggaggcagaagttgcagtgagccgagatcatgccactgtactctagcctgggtgacagagtgagactgtctcaaaaacaccaaataagcaacaacagtaaaaaacacaggcaaagtccctgttgctgcatctgtagactatatgaatttaagtgtaaattatttggagagtagggacaataaatgaaatagttggactcgaagaaaataacagatccgacaatttgtagcatttgtagatctcattttattttttggagatgatgtcttgctctgtcacctagtctggagtgcagtggcctggacacgacttactgcagcctcctgggctcaagtgatcccaacacagcctcccacatagctggggctacaggcacatgtcaccaggcctaggcctggctattactttttttgagacagagtcttgctctattgtatggtggttcagtctcggctcactgcaacctctgcttcctagtagctgggattacagtgtgattcaagctgagttcaagtgtgattctcctgcctcagcctcccagtagctgtcacatgtcacagacatgtgacaccatgccccactaaatttttttttgagacggagtttcgctcttgttgcctagactggagtgctatggcaagatctcagctcaccacaacctccgcctcctggtttcaagtggttctcccgcctcaccctcccgagtagctgggattacaggcatgtgccaccatgcccggctaattttgcattttttagtagagacagagttttttccatgttggtcaggctggtctcaaactcccgacctcaggtggtccgcctgcctcagccttctaaagtgctgggattacagacgtgacccactgcccctgacctaatttttgtatttttagtagagactgggttttgccatgttagccgggctggtcatgaactcctggcctcaagtgatctgtccgccttggcctcccaaagtgctgggattacaggcacgtagctgggattacaggcacacaccaccatgcccggctaatttttgtatttttagtagagatggggtttcaccataatggccaggatggtctcgatctcctgaatgcgtgatccggttgcctgggcctcccgaagtgctggcattacaggcgtgagccaccgcgcctggccctaattttaaaattttatgtagaggcagggtctcgctatgtttcccaggctggtctctttgaactcctgggttcaagcgattttcctgccttagcctcccagagtgctggatacaggcatgagagctccatgtctggcctgtacatcccatcttttgatctggtttcttttcactttgtacagttaaatcagaggtgaaagtacttagcttttcttcacttaagcctggaaaatcttaaacttgtcaacattgaatcacgttcagaaccatgttttatatgtctgatattttggcttatgtctatttttgtttttattttttgttatggttatgttggatatggactggtaagtagtataatcaatcattagcccacattttgctttctgttgtaaagggctacattgttcttccacagtaatatacagtacatttttcttttttttggctactatcagcccttaaaaattaagggggtttaccttaacaccaagtgtccattaacactggataaaatatctattctaaagtgttttacaaaaaacactggtaacacgttgtttttcaggttgtggtgttcatactttattttcttaggttgtcttctttggagcttgcctactccaaatgtcaatttcttttcaatattttttaccttataattttgtatattctgtgtactgagttggctcaatatgttattaggctttgggtctattcacagggcataagaaaaattcataattgattaacatgtctgatttactaactcattccacagtattattgtatgggttgtataattatattcttatgcaagttaaagaaagacttttaaaaattaggtgcatatgaactgctaaaatcatggaagtagtagtttttgaacatgttaagaacatgaacacagcagcaaggcctgttaagtccaaggtactttaaacaaaaaatgcagactcatctaacagtgcagaactgctggaggctgaattatgtttgtgtttctttgtggtgaagatgaggaagttgcagtattgtaagtgataaaggattacattttcacaaatttccttcctgacagttccataattgtaactagactaaaacacttggtttcaaaggtcatttgcaatgtattgcatcagataaacttggccatattttctctcaatttgagttctaagatgaaattcagccctatgatatgggaaggattgtaattaagtgataaataaagggattttttcccccaaagggtatttaatgtgtggaaacctctttaagggtctatagaattacctgaggaagtattagaaaataagaagtgggagttaagtatttttttctgtcatcacaggaagcctgaaatctttttttttttttaagtacttatccaaatcactattcttttaaaatcttacaaaatcttacttctggttcatattgccagcatgttgaaatgtaaaaagagcattaggttggaaatcagaggatttttaatgatgttgaggaagttattatttataattttctgttcgttttcatttggaatttgtaaataatagcaagctgcctttatgggggtatttgtgaagattaaatcagatatgaaaatgaaattgctttgtaagtggtggagttatctactcatatgaagtattattgtactaagtgcatttacataaagcacttatatgtttgaagtgtgatgccttgatgtgataaatactttttgactgggaagtttgatgaagaaaaaaagtcaaatgggttattcatttgatttcttggtagagattggtggctttttccagactgaaggaaacctggctcctctcctgactgtgactttgcactctgttgcatcaaatgtcctgaaactgcagtgtacttctgtggttgagcttttaattttggttttgatttgttttaatctcacttctataagtgtaagaatggtcatcagtctagtttgacaataggaagtagctattgtttttaatattctcaaatggatctttaagttatttcatgaacaatgagactacattgaatgtgaaatctcaggtcctctgagaaatacatttcatgtttaaagcattagtctttgagccaaagaaataatggagtttagatttttccttctggggaagttatctctggctatgagaggatctgacccttgagattaacttcaagttaggttgatatatagaatatttacgataaagaaaaagtattttagaaacaagtacatattggctgggtgtggtggctcatgcctgtaatcccagcactttggaaggtcgaggagagtggatcacctgaggtcaggagtttgagaccagtctggcccaacatggtgaaaccccgtctctactaaaaatacaaaaattagcctgacttggtggtgtgtacctgtagtcccaattactcaggaggctgaggtgggaggatcgcttgagccaaggagtttgaggttacagtgagctgtgatggtgccactgtactcccgcctgggtgagtgacagagcgagatcctgtctctaaaaataaagctataataaagacattaacaaataaaattggagctatttatcaaaactttgaacttaatactaattaataaagtagctcaaggaaaaaagtaagtagtgtaagctaccattaggcaaattatgctgagaagtatagtaagtgctatagattcaggggaaaatgaaatctgtatgtcagaaacagtgatctaggaaaatttcatgggagaagacagctttaaatacagaaatcagaatgaaggaagaaaagcatttcaggaagtgaagacatggagttagggttgtccattttgtgttcagaagacagcaattaaattacttcagccatatgacgaggaaagctaatcagattagttgcaaattaggtgagaaccagatagtgggagtttttcagtgtcacactaaggagtgtgtctttattgtacagaatacttactcttaaagttgggcagactctgagtgggaagaaaaatattttagcactgggtataagtgtatgtaacctgcagtctctttcatctttgcctctatgtttatagggtagtagtggtttttttttttttttgagacggagtttcattcttacgcccaggctggagtgaaatggcgtggtctcggctcactgcaacctccacctcctggttcaagtgattctccatgcctcagcctcccgaatagctgggattacaggcatgggccaccatgcctggctaatttttgtatttttagtagagacggagtttcgccatattggccaggctagtcttgaactcctgacctcaggtgattcacccgcctcggcctcccaaaatgctgggattataggcatgagccactgcgcccagcagtagtgtgtttttagggagggacagggaaggttgaaaaatggcactgtagaaagccatcagtaccatagcaattaaaccagcgttgtagtggttcaggaatagaaaatagatcagtggaacagaatagagaacacagaaatggattaataaatgtgtgggactttatatgacaaaaggtggcatttcaaattatagaaaaagtgtggaatattcaatatttggtttaatttccacttcacaccaaaagaaaaaaaatccaaatgcatgaattaaacagctaaatgtaaaagccaaaaactgtggaagtattagtagaaaatacaggagaataattttatagtcttgggagcaggaaaaactttctaaaacaagatacagaatctagatactataaaggacaccctgttttccagcctctacattgactgtataaaatttgaaacataataaagatactttaaaaatgtttgaggcatgctagaacattaattcatgacccaacttataaggaactacaaatcagtaatgacaatctaataggaaagtgaacatatgaatatagatgcttcacagaaaaggagatgaggatagccagtaaacacaagatgcacagccccactgaagtcttcctggaagtgcagattaaggaatttattattttgctcatgagatgagcggaaattaaagatggttgttactctgttggtgggattgtggagaaataggtactttcatatgttgttggcagcaactttgtactacctttgggagagcaatttagcaatatctataattttttttgtttgttttgttttgtttttgtttttttgagatggagtttcactggagtgtgcctggcctttttaatttatttttgagatggagtctggctctgtaacccaggccttagtgcagtggtgtgatctcggctcactgcaacccccacctcctgggctcaagcgattcttctgcctcagcctcccaagtagctgggattacaggcacgcaccatcatgcctggctaatttttgtattttagtacaggtggggtttcaccatgttgaccaggctggtctcgaactcatgacctcgtgatccgcccactttggcctcccaaagtgctgggattacaggtgtgactcaccacccctggcctttttttttttttttttttttttttgaggtagagtatcttgtccaggctggagtgcagtggtattatctcggctcagtgcaacctccacttcctgggttcaagcagcaattcttgtgcctcagcctcccgagtagctgggattaaaggctcctgccactatgtgggcctagctaatttttttgtatttttagtagagatggggttttgccacgggccaggctggtctcaagtgatcctcccaaagtgctgggattataggtgtgagccaccacgccctactaatttgttgtatttttagtagagatgggtcttcaccatgttgcccaggctggtctcaaactcgtgagttcaagcgatttgcctgccttggcctcccaaagtattggaattacagacgtgagccaacgggcccggcctgtggcttttcgtggagttcttagaacgtaagttttctgtgctgttgtgccttctactttctctaccttttggaatgtcttcactttccagtcccttttacctagataatttgaattactctctgaaggctcaacctacttttcatgagttacagatatttgcttcttaaggatctttttttatcagtttcattttgatattttagatgtgaattcaatttggttgacagagtcttgctctgtcacccaggctggagtgcagtggcacaatcttggctcactttaatctctgcctcctggattcaagccattcttctgcctcagcctcccaagtagctgggactacaggtgcccaccaccatgcccggctagttttttttttttttttttttttgtatttttagtggagatgaggtttgcaccatgttggccaggctaatctggaactgtacccgacctgacagttgatctttttaatatttagcttagcttatctctaggtgtttcatccatagaactaaatctcagttgtgttcaggtacaaaaaagatggaaaactactcattcattcttcagaactgttttcaggacttcaaggaggccttccctaaccaccctatttaacattccagttcttgcaccatccccacccctactctgccctcacttttttctccatggcactgggcaccagctggctaactctgtcttcaaaaagtacttttctttgggggaggtttttcttttgtttttgttttctttctttcagtcctgtatcttcagcacttagaagagttcatggcacacagtaggtactcaataagcatatgttgaaagaatgaatgcagtttcatgttccggatgaggataggctcatttaaaatattttcatatgtttattagacaaaaagtagccttcaaaaaagttttcatgctgggcgcagtggctcacacctgtaatcccagcactttgggaggccaaggcaggcggatcatgaggtcaagagatcgagaccatcctggccaacatggtgaaaccgcatctctactaaaaatacaaaaattagctcggcatggtggtgcgcacctgtaatcccagttacttgggaggctgaggcaggagaatctcttgaacccggaaagcagaggttgcagtgagccgagatcgcgccactgctctccagcctggagacagagtgagactctgtctcaaaaaaaaaaaagttttcattagttgggatcttgtatcctcttccctttctcaagtgatgtgttttaaagcagacattttcatatcctttggcggaggtgaaagacccagaccttttgaaaagtattttacaaatacgttcttgaaagcactccagactgactcgcttatctttggtcacatgacagtacagctgcactttgaggcctttgcctatagcctattggttgccttacttcggaattgtagacgtgtgggagaataatgctcccattcttctccatcttgtctagttctagaagatataatggtaatggaaacctcacctttttcatagtaaaatgtagctacccaggaatgatgaggggcaccatcatatcaggtaatattcattccagttatattttatgaggtaaaattgatactgttgttgtgttgttcttacagattttgacaggctccaccaaagtgtttttaaatgacttatttagcctctaactctcccctgaattcagtctccagacgcctactttatgtttcctcttggatgtgataataactatctcagatttaaaatgccccaaaccaatttgctggtttccttttcttcttcttctttttttttcttgagatggagtcttgttctgtctcccaggctggagtgccgtggcatagtctcggctcactgcaacctccacctcccgagttcaggcgattctcctgcctcagcctcccgagtagctgggactacaggcatccaccagaccacctggccaatttttgtatttttaatagagacagggtttcaccatgttggtcaggctggtcatgaactccttacgtcaagtgatctgcccacctcggcctcccaaagtgctgggattacaggtgtgagccaccatgcccggcccaatttactgattttcttctcataacctgctctttttgaagtctttctgcctcagtagctattccattctagtactcggtgaggccaggagtcatcctttataccccatattcaatacatcaggaagtcctgttggctgctgtacctttgaaatccgtgtataatctgtccatttctcactgtcttcactgccaccattctagtccaaaccaccatcatgtctcacctggattatcatagtagccatgcaaatgaacttcttgattctgcctttgctcccccacaatgctgtcccagtaggtagccagagtgatcttttattccttttctcaaaacgcttctgtgacttttagttctcagagtgtaaagctaaaacgctttttaaaaggagtcttaggatctgtaagccctactcagtctgtccccttgccaccactctgtttattatcttgtgggtttttttttttgtttgtttttttttgagacggagtctcgctctgtcgcccaggctggagtgcagtggcgccatctcggctcactgcaagctccgcctcccgggttcacgccattctactgcctcagcgtccgaagtagctggaactacaggcgcccaccaccacgcccggctaatcgcccggctaattttttgtgtttttttgtagagacagagtttcactgtgttagccaggatggtctcgatctcctgacctcgtgatccgcccacctcggcctggagtgctgggattacaggcgtgagccaccgcgcccggcttatcttgtgtttaatcttttcctcctctctcctgctaggcgatccacacaggcctccttgctgtttctcagaggtagagctctgatctcagctttatagctactatttcttaaatgctcttcctccagttaactgtatataatggtgcctcactcattcaaatctttgctcacatatacttcagcaatgaagcttgccctgaccatcgtttttagagttaagcttctctatcccagcataaatctatcccagaataaatctcctcaaatattttacagggtttgactgtttttgtcgacataagtctaaggtttttgacctgaatgtgtggtgactcttgcttgtaatggctgtattgtttttggctactgcaattctgtgagttagcagaaataggagcagcaggaagatgatttcagtattgtagctgttgtgtgttaaacacttgagaaacctgcaaggggacatcaaaagcaattggaaatatatgactagagatcgagttaaagaaactactctgaggaataaaaggaagcctgagcctaaacagagcttcaagtttattgtcttcacaaagtattcttctttttataaccgtatgatttcttagcctttgtaactgtcctgtaaattctgcttatttctaaattactattagtaaagctcttaaaatggggagggtttatacatttaccaatggtcagattaatgggagaggaagctcatggatttctccagaattttgagttcttttttttttttttttggaggtggagtcttgctctgttgcccaggctggagtgcagtggtgcgatcttggctcactgcaacctccacctcctggtttcaagcaattctcctgactcaggctcctgagtagctgagactacaggcgcacgccagcatgcccgactaatttttgtatttttagtagagatggggtttcactatgttggccaggttggtctttaactcctgacctcctgatctgcctgccttggcctcccaaagtgctgggattacaggtgtgagccaccgcacccagcctaattttgagttctgtaaagaacaattaactgcactatcacccagacgtggttacctttcttgtttattgattgcttaatatgtatttagcattcattcaatgtgtgttgggaatacattataggctggtaaacaagcaattacagcacaatattctatattaagtgccagatggagaaaataataagagtcttagggatggggtcaagggatggttctcaaaggaaatgaaccgttagctgagacaagcagaggagtttgggtggaggtaaaggggatgggcaactgatcagaatatgtaaagccctggagtaaagacaaagccaagcattttgaggggaactgagaaggttgggcaaagcgggaatgaattaaaagagatgagagctagagataaaatacttgatattcaaggctttggggcattatcttgaagaaaatcttaacattttaaaggaattacataatgagattatcatttgaagatctctagctataatggggaggttcaaactgccagggggctttcatattcactgtgtctaggatagggcttaaaaagttacttttttttttttcctttgattgtagtacacgcccaacattttgagaacagttgaattaatagggttctttagtaagcctgttagttttgcttatccaaattgtcatggtggtgttagggccagcgggaaatctttttctcttttgggctggatggtgttaccaaaacaccaggggtttggtctaggtcctgctgcttgccgcacagaaagccaatcacagagacgggtattgccagggaagaaggctttaattgggtgctgcagccaaggagatgggagatcagtctcaaatccatctcagtctcaaatccatctctgactgactaaaattagaggtctatatagcagagaagaaatgtaaccatgtgtgggcaaacaggaattagagaggggtgaggaagagaagttggtcaacaggcagcaggtggtcagttaagcaatcatgcaggctctggcttctcattgtccagttgcagtgatctgttaagtaagtttcagcttcttaatactatctaggaggcctgatggtttgtttcctaagaaaggagcttagataacacaaatagaactttctcaagttttaagactgtgaggatcaatttctgtatttattcagagaaaccataaagatcagttctgtgggataattggctggtttcaatgttatctttccttgaaggaagtaaacaaagcattaaactggggcctgattaaagtgggcttattgatttgagaaattcaagtatggtaagttgtcccaagtcagtaatgtattttacttttttttgtaatctgttagaagatgggagcaggcaaagggaaggagggaagctttcacacagtggagaaagaatgctttttaggcttcagccagtttttcttatcacaaagccctcacctacttcttgtttcatatagaattcttccagttacccagtcacttaaaccagaaacctgtgagctatcctacactttctcccttatatagttggttattcagtcctttaataaaataatctttaggctgtgtacagtggctcacacctgtaatcccagcactttgggaggccgaggtgggtggatcacttgagcccagaagtttgagaccagcctaccaaactagcaagaccccgactcttaaaaagaaattagctgggcagggtggcacatacctgtatagtcctagctacttgggaggctgagatgggagcatctacttgaacctgggagtttgaggctgtgttactggtggagggtgtccaggttcttggcatcttgaacaaagaactggacaaaacacacagacaaagcaaggaagggatgaagtcagagatttattgaaaatgaaagtacactccacagtgtggtggcgggccctagcgtaggggctcaagggcaccgttatagaatttgtgggggtttcaataccctctagaggcttccattggttacttggtgtataccctatgtgaatggagaggtgaagtaaagttacaaagtcatttacttggtgtatgccctatggagaggatatttcctgtcatagctgaagtgtgaatcggcctaatgttccctgcctccagaccctattttcccatctcagcaagccgtgttcatactactgtactccagcctgagtgacagagtgagaccttgcatccaaataatgataaaaataataaaataacctttcatgtcttctcagatctcttcaaaacccttcccgctatcttctaaaccctttccctcatcaacactggttaagttcagatgctcatatttttcatggaatattatgttgcttccttgcatcccacaggtctagggttgttgagttgcttccctatcttgaaaaaaaacatttttttgagacagggtcttgctctgttacccaggctggagtgcagtcatgcagtcatagctcactgcaactttgaactcctgagctcaaatgatcctcctgcctcggcttcccaagtagctaggacaacaggtgtgggccaccgtgtcctgctgattaaaaaattttttttggtagagatggggagtctcactatgttgcccagcctggtcttgaacgcctggcctcaagtgatcctcccacctcagcctccgaaagtgctgtcacaggtgcaagccgccactcttggccctgccatcttaatatatgctatttaatttaattaattaatttatttattttgagacggagtttccctcttgttgcccaggctggagtgcaatggcgccatcttggctcaccgcaacatccgcctcctgggttcaagcaattctcctgcctcagcctctcgagtagctgggattacaggtgcttgccaccatgcccggctaattttttgtatttttagtagagacagggtttcatcatctttgccaggctggtgttgaactcctgcccttatgatctacccgccttggcctcccaaagtgctgggattataggcgtgagccattgcacctggccaaatctgaccagatacaaccgcttatgcctgtcatcctagtactttgagaggccaagaaaggtggatcacttgagctcaggagtgtgaaaccaacctgggcaacatggcaaaaccctgtctttacaaaaaatacaaatattaggcatggtggcgcacacctgtagttccagctactcaggaggctgaggtgggagggtagcttgagcctgggaggtcaaggctgcaatgaactgtgttcatgtcactgccctccagcctgggtgacaaagcgaaatcctgtctcaaaaattaaaaaaaaaatcatggccaggtgcggtggcttcatgcttgtaatcccagcactttgggaggctgagttgggtggatcatgatgtcaggagatggagaatctcctggcctttagtagagatggtgaaaccccgtctctactaaaagtacaaaaattagctgggcatggtggcgcgtgcctgtaatccccgctactcgggaggctgaggcaggagaatcgcttgaaccagggagtcagaggttgtggtgagccgagatgacgccactgcactccagcctggtgacagagtgagactccgtctcaaaaaaaaaaaaaaaaaatcaaatctgatcttttaaactatatttgtactagattgtcttttttattttttatttttttaaagaactttcatattcttttacatttttctgcctttgtttttcctgtgtgatgctttttcctttttcactgggacatctttccttgtcatcagatcttttgattttttttttttttttttaggaatcagaaatcgttttgtttgttttttgcaatgttgcccaggctgatcttgaactcttggacttgagcggtccttccgtcttggcctctccgtgttggggttacagacgtgagctaccacacctagccccccccccccctttttttttttttttaaagagtcaaggtttcactgtattacccagtctggagtgcaatggcagttcacaggcatgatcattatggctcttaacagccttgaactcctggcctcaagggatcttccttcctcagtctcccaggtagctgggattaataggcactctccactgcttccggctccagaaatcttcattttaatgtagtatctcaatttttaaattttgacaactgttaatttactttaaaaaatgctatcaaatttgcagcctcatttatagagatttccttgatcattctcctttccccctgcaaatttaattgctcagtctttgtgtatttctgtcattgcataattttcaagctattataaacatgattctcatacaaatagacattgatacatatcataaacttttttgaaagtcctgaaaaatagtggaatgagaaattgggatttatatagtcagtttaggccaggtgcagtggctcacgcctgtaatcccagcgctttgggaagctgaggagggcggattgcttgaggccaggccttccagaccagcctggccaacatggccaaacgttgtctctacaaaaaatacaaaaaattagctgggcatagtggcacatgcccacctacttatggggctgaggcaggaggatcgattgagcttgggaggtcagggttgtggtgagccatgattacgccattgcactcaagcctgtatgacagaacgggaccctgtcacactcaaaataaagaaaagaaatatagtcagtttaataaagaatgctgaaataaaattgctaagatataaacgtggttaatatcctacagggtatttaaactgtagctttttggataacctctactgactggacagaaaaaatttattttaccgtagtagttttctgtaagtttacttttaaatttgtagagttataaaatgcctgggccttaattgaaattagaaataaaacaattagatgacctcaggtgagcctattacaaaatgctcttgtcataacattaaaagtcatacaattgataccttatttcaggttttgaataattcatttgaaacatgttaatttttatactattagcgaccaacctttttgtatcctctctttttgaaatattaatgtacaggagttttcagaataattaacagattatatagatctgacttgaggctaggagtttgagaccagcctggccaacattcgcaacgagtgaaacctcgtctctactaaaaataccaaaaaacaaaacaaaacccccaaaaacagattatatagatctgtatttttgccctgttctcatttgagcactagttccatattgtcttcagtagagttctattagaacttggatctaatgtgttcacagtatatgtccaataacagaagcataagacacatgtagaataaatcaggagtactatttgctttactaagttgggttttgaagtttaaaggagtttcagatacaaaaagaaaaaaccaggtggagtgaccattgtatgctggcttagggcttgagtccaggttgttgccagtgaccagatgtttgtaaccaacctctggtgtcttcccccctgccccaactttaacacaactgaagtattgctgacacagttattttcataaaaacagtttgattgccgggcgcagtggttcacgcctgtaatcccagcactttgggaggctgaggcaggcggatcacgaggtcaggagttcgcgaccagcctggccaacatagtgaaaccccgtctctactaaaaatacaaaaattagtggggcgtggtggcacgcgcctgtagtcccagctactcgggaggctgaggcaggagaatcacttgaacccgggaggcggaggttgcagcaagtcgagatcgtgccaccgcactccaaccggtcgacagctcgagactccgtctcaaaacagtttcatcatgtttcttctatgtttgaaaatgtaaattacttcatgttgccaacatacagacttcattttcttggcataggagcttttcagtttccctgtgcttctcagtttctgcagtcatgtttttcacaccttactgttcattgaaaatagagtcctttactgttgctgcctgctccccattcacgattatccttttccttcacctctgtctggccaaatgctacattttcttttagacataactttctccttcattccaacaatataactgttgagactgttctagtccaggagggtctccttatcttagaagtttgcttctatctgttcatacaggtatgcagtcctgtcatgttctgtatggtaaatctatgggtggcttgtctctgtttcacctggaagacagtaaaccacttttcaaacttagtgtcacatatagtgcttcctatagaattaaaaaaaatgtgtctcatgagtcaatatgtttttgtatttgtagacctgaaagatgtctgaaaattccagtgacagtgattcatcttgtggttggactgtcatcagtcatgaggtatgatatttaatactttttataaggtaatttgtaatattaatgttaccagtgatgtaaactgtgttctttgaagatcagtctttttctacctttaagcaaaaagttccaatggacattttccctctcatattaaacttcactgctgaaaacgcttcatgagccagcatcttctacattattgtacatagctttgagacattaggcaaatatttattgaaggtttgttattgttcaggccctgtgctttactttcattttcatataattttgtctttttttttttttttttttttgagacagagtctcactctgttgcccaggctggagtgcagtggcgtgatctcagctcactgcaacctccgccccactggactgaaatgattctcctgcctcagcctcctgagtagctggaattacaggtgcctgctaccatgcccagctaatttttgtattttcagtagagacgagtttcaccatcttggccaggctgatcgtaaactcctgacctcgtgatccatctgcctcggcttcccaacatgctgggcttacagatgtgagccactgtgcctggccaattttgtctttttttttttttaaagggacaggatcttgctctgttgcccaggctagagtgcagtggctgttcacatgtgcaatcatagtaccatgtaacctttaactccttgggctcaagtgatcctcccaagtagctgggactataggcatatgccaccataccctgttcttaaataattttgaatatttcactgtgatacatactgttttcattcttattttatagttgagaaaactaaagcttagagaggttaagtaatttggtcaagattatgcagctagaaaatagatcctggatttgaacagatcagaaaggagaatggagaacatgtgttccatttacgttatagcagaacttcacagggaaaaggccagaaccctatcacaaaatgaattttataatagaagattgatatacatacaacaagtatacataacttgtacattttgtttattttttcataccagtaatatatgttcactgtagaaaaatggcagtatattgataaacagaaatatacttactccaggttttactccaggttttaatggacatctataattttcccatttgtttttagggtattgtaagcctcacttgttttctttttttcttttttgagatggagttttgctcttgttgtccaggctgtcgctcttgttgtcttgtacagtgacgcaatctcggctcacagcaaccttcgcctcctgggttcaagccattctcctgcctcagcctctggagtagctgggattacaggcatgtgccaccacgcccgactaattttgtatttttagtagagacggggtttctccatgttggtcaggctggtctcgaactcccgacgccaggtgatccgcccgcctcggcctcccaaagtactgggattacaggcgtgagccaccgtgcccggccacttgtttttttaataaaaattataggccgggcgtggtgctcacgcctgtaattccagcactttgggaggccgaggtcggggcagatcactgaggtcgggagttcgacaccagcctgaccaacatggaagaaacccggtctctactaaaaatacaaaattagccaggcgtggtcgcacatgcctgtaatcccagctatttgggaggttgaggcaggacaatcgcttgaacctgggaggcggaggttgcggtgagcagagttcgtgccattgcactccagcctgggcaacaagagtgaaactgtctcaaaaaaagaaaaaaaaaattaaaaaatttttgttttttaaactattagttaaggttcaggtagttatgtttagaaaacattaacagaaaaaaacaagattgccttttctgcattaaaatttcaaaatttaaaagcatctatcatttgagattgagatgattcttctttttaaaatcttcagtgacttttctatttttagcttgttttcttcaaaggattagatcaactcccatagcaacttctccttcaaggataattaacaatataggagcaaggcagctatgggagtcttacctgttagtctgcagggtggagtatgacagcagacctctgtctggcactcagtcaagtgtgtcattagggtgttctgtactggatgttatgtcccagattgaatcatatttgtacttttatctctcttcttctatatctgctttccaggttctactctttcttgctaatttctcttacatgtgtctccttttcctctcccattactgccattctcatttgggccagaattggtttccccagcaattcctaatacataaccttgctttagcctctaccattctcctgccactatagacaacctcggagtcttgcattccgaattctcattagggctcaacttaaacgctacttttttctttactttttttttttttgagatggagtcttgctctgtcgcccaggctggagtgcagtggcaggatctctgctcactgcaagctccgccccatcggttcacgccattctcctgcctcagcctctggagtagctgggactacaggcgcccgccaccacgctcggctattttttttttgtatttttagtagagatggggtttcaccgtgttagccaggatggtctcgatctcctgacctcgtgatccgcccgcctcaggctcccaaggtgctgggattacaggcgtgagccactgccccggccctacttttttcatgaattcttttaatttttgctgtcttgagttatgtatacgcaagagaatgcagacctttcgattccatgtgtcagcagactatagtggggacatagggaaagacggaatcaccttagtggttaactttgttttacaattaagacacaaagaaaaattgtatgatccgctattattaatgaaaagacagtctgacatcaaagtaggaaagataacctcagaataaaaagatagtctaaaattgtgtgaggagagtattcattaaccctataggtttatttaatccatgtcattaaagctttagccatttttagtttatagtgccataataagtagttatttgcatatgggtgtttctctgaatatgttgtaaaattgaattttggatttcatttttttttttttttttgagacggaattttgctttttttgtgatccaccggcctcagcctcccaaagtgctgggattacaggcgtgagccaccgtgcccagccagatttgaattttttatatcccacagcatctagcgaagtgccttgtctagagtagttccataaatgttaagtagaaacaaattattatagaaataaccaaatttagacccttattctctggaattcaaatttattgcttgagctcataaaatagagcattccacttttgggctgacctgacttagaatttaaacctgagactccattgtgccattttcctgccataggcctttgtggactaaattgaacaaaagcttgtctaattagatactgttcctttggagtatggcagcatctgagacttttaataatggaagaagcatttacatgtagtcaaatctagctttgaggagctaataggcaaataactgaaagattatcacttttccttaggggtcagatatagaaatgttgaattctgtgacccccactgacagctgtgagcccgccccagaatgttcatctttagagcaagaggagcttcaagcattgcagatagagcaaggaggtaagttgttcacaaattctaattttttttttaatatgatatatgagtgatattatgagtcttgccttctttccaggtgggtggcctttctggctaatctaaggggtcgttggaggattagaacttcagtgtaggttgggcacagtagctcacacctgtaatcccagcattctgggaggctgaggtgggcggatcatttgaggtcaggagttcaagagcagtctggccaacatggtgaaaccctgtctctactaaaaatacaaaaaattagccgggtgtattggcaggtgcctgtaatcccagctactcagaaggctgaggcaggagaatcgcttgaacctgggaggcggagtttgcagtgagccgagattgtgccattgcactccagcctgggcaacagagtgagactccatttaaaacaaacaaacaaagaaaaacttcagtgtggatttggtgaaggcccacagaacccagagtcatcagcctgccccaggggtttatttgcagctgtagtatatttttgggttttcagatacactttgttgctacagaggtaaccagtgacaaaaaaagtgtttcatggtttaatctgaatttgtttggtagtttctatttccttgtcatttgtttggtagtttgtatttacttgtcattattaaagttaagaaaaaaattattcattgatcacaagagatttactaacctgttttccagttattatcatgttgatggagttacagacatgcctctcattttattctgctttgctttattgtacttcgcagatactacattttttacaaattgaaagtttgtggcaaccctgtgttgagcaagtctattaatgccatttttccgatagcatatgcccacttcatgtctctgtgtctcatttttataattataatatttcatttatttttattttattttattgaattgaattggcggagtttcgctcttgtttcccatgctggagtgcaatggtatgatcttggctcactgcagcctctgcctcttgggttcaagttatcctcctgcctcagcctctcagctgggattacaggcatgcgccaccgtgcccagctaattttgtgtttttaatagagacggagtatcatcatgttggttagcctggtctcgaactcctgacctcaggtgatccacctgtgtcaacctcccaaagtgctgggattacaggcgtgagccactgcgcctggcctgtaattgtcatatttcaaactttttcattattattacatcagttatggtgatctgtgatcagagatctttgattttactattgtaattcctttgggacaccatgaaccgtgcctatgaaagacagtgaacttaataaatgtgtgtgttctgactgctctactgacttgccattcccccatctctctccctctcctttggcctccctgttcctggagacaacaacaatattgaaatcaggccaattaataaccctacagtggcctccaggtgttcaggtgaaaggaagagttgtgtgtctctcacttcaaatcaaaagctaaaaatgattaagcttatttgaggaaggcatgtcaaaagctaagtctcttgggccagatagttagccaagttgtgaatgcaaaggaaaagttcttgaaggaaattaaaagtccttcttagtgaacacatgaatgataaggaagccatatagccttattgctgacatggagaaaattttagtggtcttggtagaagattgaaccagccacaaaattcccttaagccatagcctaatccagaacaagtccttcctaacttgcttcaagtctatgaaggctaagagtggttaagaagctgtagaaagaaaggcggaagctagctgaggttggttcatgaggtttaaggaaagaagctatgtccgtaacataaaagtgcaaggtgaagtagcaagtgctgatgtagaaggcgcaccaagttatccaggagatctaactgagataatggatgaaggtggctaccccaaccagcagattttcagtatagatgacacaactttctattggaagaagatgccatctaggactttcctaactacagagaagtcaatatctgcttctaggcttcaaagaacaagctcactttcttgttagaggcaaatgtagctggtgactttaagttgaagccagtgtttacttaccatgccttgagaaatcctaggacccttaaaaaatatgctacatctactctgcctgtgctctgtaaatggaacaacaaagcctaggtgacagccatgtgtttacaacatggtttactgaatattttaagctcagtgttgagacctgctgctcagaacaaaaagattcctttcaaaatactagacattgtatagcaatacctggtcaatcaccgaagggctctgatggagatgtacaaggagattcatgttactttgtttcctgctaacacaacatccagtctgtagtccatggatcaaagagtagttttgactttcaggttgtattatttaataaatacattttgtaaggctgtagctgctatagatagtgattgttctgatggatctgggcaatgtgtgtgaattgaaaatcttcaggaaaggattcaccattctagatgcctttaagaacaattgtgatttgtgggaaaaggtcaaaatatcaacattaacaggagtttggaagaagttgatttcaaccttcatgactttgagtggttcaagactttaatggaggaaggaactgcagatgtggtagaagtagcaagagaattagaattagaagtggatcctggtcgggtgcggtggctcatgcctataatcccagcactttgggaggctgaggtgggcggatcatgaggtcaggagatcgagaccatcctggctcacacggtgaaatcccatctctactaaaaatacaaacaattagctgggcgtggtggcaggcgcctgtagtcccagctactcgggaggctgaggcaggagaatggcgtgaacctgggaggcggagcttgcagtgagccaagatcgcgccactgcactctagcctgggcaacagagcgagactctgtctcaaaaaaaaaaaaaaaagaagtggatcctgaaaatgtgatccaattgttgtaatctcatgataaacttgaacagataaggagttgcttcttatggatgagcaaagaaagtagtttcttgagatgcaatctactcttggtgaagatgctgtgaatattattgaaatgacaacagaggatttagaatattacacaaacttagttaataaagcagtggcagggtttgagaagattgactccaattttgaaagttgttctactgtgggcaaagtgctatcaaacagcattgcatgctacagagaaatctttcatgaaaggagagtcaatccatgtgggaaacttcagtgttgtcatacttcaagaaattgccccagctactccacccttcagcagctaccacagtggtcagtcagcagccatcatctttgaagtaagactctccaccagcaaaaatattacaattcactgaaggctcagatgatcactagcactttttagcaataatgtatttttaaattaagatatgtacagttttttagacatgatgttattgcacacttaatagattacagcatagtgtaaacctaacttttacatggacagggaaaccaaaaaattcatgtgacttgctttattacattggtttggaactgaacttgcagatatctgagatatgcctgtactctggttccaatctggtaaaatggaatctgtattatgtatacttcacatgggatttgatgcacacattatttatatagagaaataggactcctgaacaattactgcatacacttatgttcatatttaaattacttcattaactttttaaaaaaattacagtaaaatgcatacagaacatttcccctcaggagaaaaaagtggatgtgtcaaggccagaaatagaagagattatagctgttaatttttttaagcctacacgttgattattactactctcatttgaaaagtgattctcatcttttttgtgtcagagatccttttgagaatctgaaagctatggacagtttcttccaagaaatgcatttacttgcatatgttaaagaaaattttcttttttttctttttctttatgagacagagtctcgcactgttgcccaggctggagtgcagtggcgcaatgatctcagctcactgtaacctccgcctccccggttcaagtctcagcctcctgtgtagcttggattacaggtgcctgccactatgcccagctattttttttttattttttatttttagtagagacgggggtttcaccatgttggccactctggtctcgaactcctgacctcctgatcagtctgcctcggcctcccaaagtgctgtgattacaagcatgagccactgtgcccggcctaatttttttgttttttgagatggtgtcttgctctgttgcccaggctggagtgcagtggcgggatctcggctcgctgcaagctccgcctcccgggttcacgccattctcctgcctcagcctcccaagtagctgggactacaggtgcccaccaccacgctcggctaattttttgtatttttagtagagacggggtttcactgtgttagccaggatggtcttgatctcctgacctcgtggtctgtccgccttggcctcccaaagtgctgagattacaggcgtgagccgccgcgcccggccattttaatagcgacgggatttcactatgttggtcaggctggtcttgaactcctgacctcgtggtctgcctgcctcagccgctcaaagtgctgggattacaggcatgagtcaccgcgcctggccccagcaccccggccgagtactgtggcggaatctcacctctaaattaattaattttctgttagagggtatataatgctgaaaaatatttttttttccctgttctttgcaggacttaaattacataagaaatgcatgatcgaccgggcgcggtagctcatgcctataatcccagcactttgggtggccgaggcgggcggcttacggggtcaggagatcaagaccatcctggctaacacggtgaaaccccgtctgtactaaaaatacaaaaaattagccgggcgtggtggtgggcgcctgtagtcccagctacttgggagcctgaggcaggaggatggcgtgaacccgggaggcggagcttgcagtgagccgagacggcgccactgcactccagcctgggcgacagagggggactccgtctcaaaacaaaacaaaacaaaaaaaaaacaaaaagaaatgcatgttcatgatagggaaaaaaaaatagtaagcaaaagaaatttaaaatggtctataattcttttatctagaaataattactgttgatatttggtgtactttgctcataaatttatatgttatattatttttaacttttcttaatattttatgctcttttctttttttttttttttaagacagagtttcactcttgttgcccaagctgtagtgcaatggcatgatctcggctcactgcaaccttcgcctcctgggttcaagcaattctcctgcctcagcctctggagtagctgggattacaggcgcgcaccaccacacctggctaattttttgtatttttagtagaaacggggtttcaccgtgttagccaggctggtctcaaactcctgacctcaggtgattcacctgcattggcctcccaaactgctgggattacaggtttgagccactgtgcccggcctttatgctctttttcattaaaaatatattgtgaagtcatcattctgtttgtacacattttctttgaggaggttcttataaaatatatcttctgtagtgacatttagtttttctgtgttttgagttctttcttttttaaaaaaaattattggtagaactggtctcgctatgttgcctaggctggttttgaactcctggctttaagtgattctcacacattggcctaccaaagtcctgggattacaagcatgagccactgtgcctggactgccctctctctgacttttttttgagacatagtcacactctcttgtccaggctggagtgcagtggcatgatcatggctcactgcagcctcaactcctaggctcaagtaatcctcctgcctcagctttctgagtagctagtactataggcacataccaccatgcccaaataattttttaatttttatttttgtagagacagggtcttgctgtgttgcccaggctggtcttgaacttgtagcgtcaagcagtcctccagccttggcctcccaaaagtgctagggtgacaggtatgagtcactgcaccccgcctgagtccttgttttttatagtttatgttttcttataaggcatttagacacacacacacacacacacacacacacacacgtacatatacatacatactttcataaatcatagtttgaagccacggtttttattcttacggtaccaggcattgacagccattagaatggtctttagaaacttcgaataaacttttaagaattcaggaaatgtatcactaggtatctaatgatagattttttcatattaggtattaatgaacatactggatcaagtaatttggtaatgtaaggtagaggttttatttacttagtcaaggtagctttgagttcttaataaatcttgtggctgggcacgatggctcatacctgtaatcccagcactttgggaggccaaggtgggcggatcgcttgaagtcaggagttcgagaccagcctgggcaacatggtaaaaccctatctctagtagaaatacaaaaattagccgtggcgtatgtctgtaatcccagttgcttaggaggctgaggcaggagaatcacttgaacccaggaggcagaggttgcagcgagccaagatagtgccactgcactccagcctgggcaacagagcaagactccatctccaaaaaaaaaaaaaatcttaaatgattgcattttcttatccaaaattatcacctgacagtttcaaataaatgaagttcattagcaacagtggagtgacttctataattgtatgtgacatttcattaaatctatcctaacatattaggaagagatttttatctacccagattatatgttggctgcagaaagtcaacagagagttttaaattaagaaataattatattgatctttgctttatatcagaaagcagccaaaatggcacagtgcttatggaagaaactgcttatccagctttggaggaaaccagctcaacaattgaggtaaacttgtattttacactgtggatatatgttaaatagtatccttagaatactatttaaagcctctaattctatttatgcattctattcctattttgaattataagcaattttgacttctaagttagatgtcttagaggacatctaagcaaagtattttattggtattgtgttaaagatctatcttttcacctctaatataattctttttggaagtagattgcattcttgaattatattgaaaaattaaactgttaggtttcatgtctaaaatggtggttcattttaaaatttggtaacaacctgagacttatgctttggggttttacttgacttctgtataaaactagatagctagatgatcattttacatggtgttttagtcttgtactgatctgacaaaatacctgatactgggtgatttataacaaacagaaatttatttctcacaattatagaggctgggaagtttaagatcaaagtgtggacaagttcagtgtttgctgatgacatgctgtcttgtttccaaatggcattttgttgctacatctttaagaggagatgggcaaaaaaaggctggatgctgcatgaagcctgttttataaagaccttaatcatattcctaggggaggatcccttataactcagtcacctcctaaaggtcccacttcttagtactatcacattggcgattacattccagcgtagaaatttgtggggacaccttcagatacattcagtacaagatacagctgttgaagtttattacgtacataacctaaaaagttcagtgagtcttttttgggcttccacactacagagttgtgctcgaatagaaccatggaactcgtgagagaagtgagctcttttttctgtggttattgagggggcaaagatgggcttctcagcttctgcagcccactaggagaatgcagtggtctgatctaattctgagagttgtcaagggatctgatggtgttctcaagctatatgatgagcctgctattgcataattctttactaatagtaggaatcatatcttttattttaactcagatgactataatacttactactgttgtattctaagaaaatgtaagacccttaaatgattgttgaacttaccatctctaaaattatgattcttcaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactggtaagaatacactgataagagacttaaagacatgtacgaccacattttatataaaggcttgttttctacccctaataatttagtctctagttttgaatatgtttgggtaaaactcaagacaagactatttttgtgtgtgaaatctattaatacctagtgtttcgctagactgttctggagcatagcaatcttttactgtaacagtaaccatcttttgccattaaatagaagacaaaattgcttcagtgagatttgttaaaatcacaaatgctccaaaattcttttggtgctttttagatctttaagagtgggagattggggatgttaatatttttgcttgcagtagtgtacattttgtaatatagaaatagtgaaaaaaattgttattaaagtctcttcagatatattcaattattaatcatgcaacaaacatttattgagtacctaccatatgtgaaacagagttcaaggtgctatcaatacagctagtcttccaaagctcgtgaccttcagatcttttgttttagattctgttatgaaaatgtcactagtgtaagccacatttttaatgcaatcaatgcccgttgtacagacagactcattcagagattaaagtgtgagttgcttgatttctttctgctatgcttcagctcagttttagcagtatgtataacatcttttaatgtgatgtaagtatgtaggtataaagttcctggatatatcagttattaacccacaattataactaagcgtgagttatggcagagacaacttgaaacactgctagtgattctaaaaatttcctaatttgacgaagaaacaggaaacaggtagtatctattttagataatttttttagattttaccattctttaatatttacatttgccaaccagaatcagacaatagaatttctgtcattccagtttaagctaataaaatgtcaagtagaggttcttggctgggcatagtggctcatgccagtaattccagcactttgtaaagctgaggcaggtggattacctgaacccaggatttcgagaccagcctgggcaacatagcgagacctcatctctacaaataataaaaagccaggcatgatggcgtgcgcatgtggtcccagccacttgggaggctgaggtgggaggattgcttgagcctgggaggttgaggctgtagtgagctgagattgcgccactgcacccagattgccaacctgggtgacagagcaggatcctgtctcaaaaaaaaaaaaaaaaagtagagattcttggctatctcatttaatgagaagttattttcagttagtatatcagtggtttgcctataaacatgaacgtgaaaacactttttccagctatttgaatattcatgtgacattcttgatgttcagaggaaaacttcaggctttgttagaatagcattcatagtatctttatttatggaggggtattgtaattgattttagaatccttgttagtcatcaaattttattattatttttttaaactccaggatttgtgttgtattcaggtagtttccccacccccgcttcctttcctgcctctggtttaattagagaatattcatggcccagaaaagtcaaattgaagccagagtattatagaatggtcagatatataagaaactgacatagacgtaaaaggaactacatactgttgctgggcgtggtggctcacgcctgtaatcccagcaccatctcaaaaaaagaaagaaattacatattaacttttttcaggaagttgtatagttctaagaccattcttctaatatttatcttctttctgaattctgacttcttgagatttttgtggactaagaggaatatttgattaactgtatttttacccattgttattcctcctaaagatattgtttcaataaaccaaatgtttaaagacgaaattttggactatactgaaaacactgcatataaaccagttgccaaaagtttttgttttggggccgggcactttggctcatgcctgtaatccctgcactttgggagactgaggcaggcagattacctgaggtaaggagtttgagaccagcctgaccaacacggcaaaaacccttctctactgaaaatacaaaatttagccaggtgcctgtaatcccagctacttgggattagctgcctgtggtagcgcaggcctgtaatcccagctactctggaggctgaggcaggagaatctcttgaacccaggaggcggaggttgcagtgagccaagattgcgccactgcactccagcctgggcaatagagggagaccccgtctcaaaaaaataaaaaagatggtttttgtttttcccttttagtttgttaattttgtgctagccattgcttaattttgttttttcctttccctttcttcatccttaaggatttcaacttcaattttttcttctcctgacttatattcttgtggcagtgtacgttttgttgggttaagaacactgcctgcttcctctttatgaactctcttccctgacaaaaagcaaagttggtagtgtagagaagtttgtattgtgtgtttttaagaaggcatggttattacgttttaattttgtacggataacaatgttaagtgataattaagtatttttaattcttttttttctttttagtctttataatatagctttatgcctctttttttcctgtttattcacaaaagaaaggtggtgggagaagctgtggaagattcctgagtgcatatggggatgggatgatcagctgaaacaccatgttcctagccaactcgctttccaaggtggtgtgactaaatctgaccagcttctctagagctgagtgtgcctagtcacatttactatttaccgagtgctttaaagatacctgttgtcatccgcaatactctaaacaggtgttcagaatctcttgtaaaggagctggccaagcttattgcatgcctttgcattgcttgcatctatgggccaaattaagcttttttaaaagaagttaaaaatcaaaatatttcagctattatatgtatgggttaaaaaagttggaagcattagataaggacatgaatatattaatgtgggttaggctgttttgttagaatatataatgaaggtaatgttaatgtagaattgaacaattatttaaataagttttacaaatggtttgtttttacatttacctatcttaattttatgtcagaaagcctgacttaaatactctaaccatgatcatgaatgcctttgtattatgtaatgctttgtttaagtcttcctttctttctctttgtccaagaaatataatctcacacctgaggcgacggcatctttgaaaaactagtgatcaagaataaccagataaacatgatgggcataagggtcatgaccaaaaagatctctcagtggcatctgtatcactaaatattaggaatattcattcatttcagtagtgccttctgtctttgtgtttattgttgtaagtgtgaaagtgaactgaatactccatgatccatctctgaaaaatattgcctaacctaaatcaccagctttcctgtggcatggatatcctgtcttctgaagaactgtttttgcttttctggagcatgaatgtttgttgttttagagctctttgtattcgagttcatattttatccttatttttagtgcttttcctctaagtagcttgtggaaattatttctgagtaattgaagcttctgtgtcaacataatagtttgttgacataagaaacagtgttaagaaattatgcatttggaaaaaactgaaggtgattttttccagggaatttgtttcctggacttgggatttcttgtgcaaattttccccactagtttgtttttctctactattattttcataaaggagcagcaccagaatagtccttaatatcggagatagctgttgtgtcacttcctcatgctgacatatttactagagggtaaaattaataaccttctagtaagagtggcagtcgaagggaagggctcatctgacttctggaaacctatgttaaaatacagtgctttgaaccttgatcatgggctaattaggttggaaatgaaactagagaccagatacacccaaggaaacttttggtagttattttactttataagtcacaggaaatgcttgtgtactttcctgtgttccttaaatagttgcacttaaattacctctttgaaactgaatgaagagacagagagtattttttttctttccagaaataatacttgtttatacctgtaatagcaatgaaattttgtttcttttgagacagagttttgctctgtctcccagtctggagtatagtggcaggatctcagctcactgcaacctccacctcccaggttcaagtgattctcctgcctcagcctcccaagtagctgggactataggtgcactaccatgcccggctaatttttgtatttttagtagagaaggggtttcgccatgttggccaggctgatctcgaactcctgacctcaggtgatctgcccgcctcggcctcccaaagtgctgggattacaggtgtgagccactgctcctggccagcaatgaaacttgaggctatgcgaatgaaggattgttctaagagtgtaaactataaggcgaggaggattaaataaaaaaacagagataggctctcaaagcaccaaatagtatgattaacagattcttgtgtatcacatttgaaatgctttatgttttggctttatgttgatgagttgaaaacccgtgtttttgtttatgttgtttggtttttgtttttggctatcttatgtagaaaggcatgtaagggatggcattgattattctaaataatttttactgggaaagcttttccaagattttgaatagctaaatgtcaacttttttcttaatagtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggtaagtactcaaaaatgtgttatacataacctgatgggatagtgtagaggaacttaagagtgaggactcttgggatctgttttcagtgccattattaaatgtgtggccttgaaaacttgaagcctgtttgagcctcagttttctcattcgggaagtgggtgctgcctatctcacaaagctttttatttaaataaggtagtagttattaagaaatgtaaggataataaccatatatgtttgtgactcttttaaagttaaaagattggaagattaaaaatctgaaatgctcaccatgaggcaaatcatttacatttagaatcacacttaaactaagttgaagtgtgactttattaggaagattatttaaatcccagttgaaatagttacatttgaaatgtgtaaataataagtgttcattatttctactttgaggtttcatgtaagtatcatactttgtaactttcattgttgcttctgtgattcacatgaattgagagtttgtcatctttgttcttatactttgctctttattatgattgatactgtttatatatgttgattatcttatcaattcaaagcttttaaatgccttttgggtgagaagaggaaggtattctattggtgttactttactttttcatttaggagcctcacccattgactctctcctttgttttttggagacggagtcccactctgtcgcccaggctggagtgcagtggcacaatctcagctcaatgcaaactccactcccagggttctagcaattctcctacctcagcctccggagtaactgggataacaggcgcccgccaccatgcctggctaatttttttatatttgtagtagagacggggttttgccatgttggccaggctggtctcgaagtctttttttttttttttttctttttttttgagacggagtctcactctgtcgcccaggctggagtccagtggtgcgaccttggctcaatgcagcctctgcctctgggttcaagtgattctcctgcctcagcctcctgagtagctgggactacaggcgcctgccaccacgcccagctaatttttttgtatttttagtagagacggggtttcaccatcttggccaggctggtctcaatctcctgaccttgtgatccacccgcctcggcctcccaaagtgttgggattacaggcgtgagccaccgcacccagccagtcttgaactcttgacctaaggtgatccaccccactcagcctcccagagtgctgggattataggcatgagccaccgtgcctggcctgagtctcttatttaaggtatgtgtttgtacaatgactggagtatttgaaacctgaactttgactctctttgctatattggaatttggggtagagacactttaaaaggaaatgtcttagatcttgtcaacttcccaaattttagcttgctttacattaactacttttagatttttttgcctgcataatccacagtcttaacttttcgttttgctagttcattcgaaaaatgtatttcttatgcaaagattgaagaattacatgtaccctatgtggatttgtggaaaaggtatattattcaacatagcgtaatgttagaataaacttaatgaagacaatacctgtttaaagtcagagcttgcaagatgtttcttgtatttatattaataaaaatatgtatttagatttctgatggatacctgcttgaatttaatactgagatactattatttgtatcctttcttgaaatttgttgtaataagatttgatttgaaatatatatttacctttatagactatctagctgaaacaatcaataagtatttgagtatgattttccctccacaagtaaacatgagggtaacaatggagaagatcttatcttaatctttttttcttacttcaaaaaaaattggatagtgatttaaagtgttaatccaaattgcattaaaacttcaccatttacatgacctttgaatattttgtagaaaaataattttacagaagtgctttcaaaatgagaagttacttctctgttatgtaggattttggttattagtaaaatttaccttaatagttaattaataaaacattgtcctttacttgatattagccttttcaggctatgaaaagcctggataacatattatgaagtaggcctacatagtaatgagattagttgaattaacatacaagacctgacctaaatgacttttccaagtcactacttaaaagacatcacttttttttttttttgagacagagttttgctcttgttgcccaggctggagtgcagtgcgtgatctcggctcaccgcaaccttcgcctcccgggttcaagcaattctcctgcctcagcctcccgagtatctaggattacaggcatgcaccaccatgtccagctaattttgtatttttagtagagatggggtttctccatgttggtcaggctggtctcgaactcctgacctcaggtgatctgtccacctcggcctcccaaagtgctgggattacaggcgtgagccaccgcacctggcaagacatcacattttttaatttcagcactgatctcaacattctttggagttgatttcagagccgttttgaattttctattcaccgtaaagtcggtcattgcatcccatagtcattcattcactttataattttatttttttttgagacagagtcttgctctgttccccaggctggagtgcagtggtatgatcttggctcactgccacctccgtctcccaggttcaagcgatccttctgtctcaccctcctgagtagctaggattacaggcatccgccagcacgcctggctactttttgtatttttagaagagatgaggtttcgccctgttggccaggttggtctcgaactcctgaccttaagtgatccgcctgcctcggcctcccaaagtgctgggattataggcgtgagccaccgtgcctggcccgctttataataatttaacaataccatattactaattgaatcattctgcgtttgccagccctggtgccatacagatttgaattggcagatctatactgcagggaagagaaagctagcatgactaaggatagtgaggcagtgtactccaggtatttggttctgaaaatgcttccagaagttttattaaaaagtttcatgagaaagcagtctttcttattcttacatttgcttgtgactatcaacattccaaatcatcaatggagttcaattgatttggttttctcctcgagttgctttaagtattgatagactacccggctcttcggcagactattatataacaagatatctagatgctaagttatagagcacagaatgaattacagctcaaagggtacacttactgaattatcctggaggtggtaagatttaagttgtgtctaatcatagtaagtttatgatagactcaagggaaggtggaacattccagcgacagagaatctgataacctgaggaagacgtaatcttgggtttgggagcagtgaaaagactgcttggactacagcagagtgtaggtatttagaaataatggaataggtggggtgctattatagtcatcccttgatatacatgagggatgggttccaggatgcacccccataccaaaatccatacgtactaaagtcccttgactgcggacctcacatatatgaaaagtcacctctccatatacctggattttgcatcctgccatgtagttcaaactcatgttgctcaagggtcaactgtgtattgtaaaacgtcttggaatctagataggaaagtttgatttattgagtaacctgctatcaggttagagaaaaaagtgccggaactttttgctggtgtggaaaaggtggtatggaaaaatgtagaatagtcagtcagttaagagttctgtaatctggatatttggtgaggaggaccttgacaattggaataacagtgggaatggaataagggacattgaaggaataatggaaaataatggcaatttattaaattgtagaaaatgtgctagctgcttcacttttggagttggggttactggggaagttttgccagatgataaatagatggtaagcacagtttggtttggttttacccaaatttgttctagacaaatttggtttggggcaggtgttgaggtttgatttttttttttttccaccctacaaacaggccccctacacagctggatgtgttggctagaagctctgatgagaagttaggacaagatctgtagcttggaattcttaataggagtgatagcaaaatctgacagcgctgcaacatggtaaaataggcagcatttgtagacatgactaggccaaagattgtatcttgaggataagactttaggtagctgaaggtgcaggaaaaacccccaagtgattagtcagtaatattgtaaaaggccacattaagacagtaatcaagcatatgctatattatactatcttgaattcagacctcaacacagttttagattattttccagtgggcaaaggaattaatctcagcagtttgaaatagaaattgcagaagttttctgttactctgggaactatagataaatttcaacatttgaaaaaaatctgggattctgctgagtaattttgaaacaagcttgccgtgcttctataaattgagaaatctaaagagaggaaatgaattctaacacagaatatcatagctagactatgtaacagttacctgtaaattggcaaaagttgtttttggtgtttttcaagatgtattgaagacatttaaaataatttttatagcagtaagggaagaaatagtgatcactgcatcctttctttgtaaaattctatagtatctatactcagtagatgtaatgttaaggttgctaactgcattttgccttatttttgatttcgtggttttttccccccatacatgacgcatgtgaatagcatgtctgagtaaagtaacattttgatttttaggatgaaaatatgaagaatcctagttggtttaagattctttttttgagacggagtttcgctcttgttgcccaggctggagtgcagtggcgcgatcttggctcaccacaacctccacctcccgggtttaagcgattctcctgccgcagcctcccgagtagctgggattacaggcacatgccaccactccctggctaatattgtatttttagtagagacagggtttctccatgttggtcaggctggtctcgaactcctgacctcaggtgatccatctgctttggcctcccaaagtgctgggattacaggcgtgagctactgtgcctgtccaattcttttatcactgttgggataaggacagtgctactccagtacagatttaaccattgcagaattcttaacaaatttggccttgagaatggtgcacaatcaccattagccaattattttctgtgctgtactttttgggctttgttgtatccttaaggcaaaatattaaaaaaaaaaaaaattttcatttttccttattgacttacgacctgtgaaaaaataccagggtttgttcatttctctgtataagggaggctgaaacactttttgtacttaaaagataaccccaaaacaacaaagctgagtgccttcaatatagtaagataagaacattacataaattgttctcttggttagagccatatgggctggcctgtgtgttttaatacaaaagatagtgaactgcttaaatgttcctgggtgtatgtaaataaatgtttttaagaactagcctacttggccttacttatattacgttaacgttcaccaccatttgatgaatgattgatcatgggctttcatttacttttctttttttattttattttatttttatttttagtagagacagggtttcaccatgttggccaggctggtcttgaactcctgacctcaaatgatctacctgccttggcctcccaatgtgctgggattacaggcgtgagccactgtgcccagcctcagttacttattctctatttatgtaatcagaatttttaaagaacggtgaaatgctgatactctgaatgaaatgattgtcaagattacataggttatggccaggcacagtggctcacacatgtaatcccagcactctgagaagccaaggtgggtggatcacttgaggccgggagtttgagaccagcctggccaacatggcaaaaccctgtctctataaaaaattagttgggcctggtggcgcttccctgtagtcccagacactcgggaagctgagtcacgagaattgcttgaaccagggaggcagaggttgcagtgagctgagatcataccagcctgggcaatggagcaagactcttctcaaaaaacaaaaaaaaaacaaaaaaaagactacatagcttatatgcagattaccaatattaaaaaatacataaaacatttaatgataatatttttgttacatacctttaataaaaatatttattttaggcacaattcagattcagaagcgtcaacagttagtcagaaagatacatgaagatgaattgaatgatatgaaggattatctttcccagtgtcaacaggaacaagaatcttttatagattataaggtatgtaccactaacagtatttaaaataattgttagtaattattttgcttattagttagagcttattgtgcttattagtgcagattagtaaatcagtaataatgctgatcattgttgaattgagtacgggtatttagtgtgtcctagtcattgtcatgagtgtaccatatagagtatttctcttattctcacaatatgtgaattaagcaattactaacttttataggtggaaaagaggtttagaaaagttaagtgactttctcaaggtagcaactggcagagctagtttgtttttgtttgtttgtttatttatttgagatggagtctcgctctgttgcccaggctggagtgcagtggtgcaacctcaggttgctgcaacttccacctcctgggttcaagcgattcttgtgcctcagcctcccaagtagctgggattacaggtgtgcacctctatgcccggcaaatttttttgtatttttagtagagacggggtttcactatgttggccacgctggtcttgaactcctgacctccgtctacccacctcagtctcctaaagtgctgggattacaggtgtcagccaccatgctcggccatggcctttttttgttttgttttgttttgtttgggagagctaattaattgattctaaggatttgacttaagaactcttatccctagctgctattttatagttaacatcttttataagtgacattttatatgtgtatatagacatttttattaacattattttcacagagcgaagcaaacattttcagttggcaggagggaaagaggagagttttggttttatagcctctctaagatcttctcttgatcaggggacatagctattcctttccattgtttttttttattctgatggaagggagagcatgttatctttttctgcctataactcacctagatctcgtctcacaggactgtactgtccattctgtcattacctaacacctctgtgggtttatgaggatcagcaaaatagctggtctcttatctagttttttcctaagaaggttgtagagagaaatgcagggtagaaaaataagctatgtctgggtgtggtggcaacctctcaaattcccaaagttggtaaccttgggaagccaaggtaggtggattgcttgagcccaggagttcaagaccagcctggccaatatggtgaaaccttgtctctactaaaaatacaaaaatcagcctggtgtggtggcacatacctgtaatcccagctttttgggaggcttaggcacaagaattgcttcaatctaggaggcagaggttatagtaagctgagatcacactattgcactccggcctgggccacagaggaagactgtctcaaaaaaaaaaaaaaaaaaaaaaaaaggaaaaggaaagaaaagtaagctattgttttttccttcatttttccacccccaattctcacacttaatttatgtatgcttcccttacaggttatatttcttgaaaagacaaaaatactactttgtaactaaattgtatctttcagggaggtacttctcccatccaagtactaaccaggccagaccctgcctagcttctgccatcagaggagactggcggcatttagggtgttatggctgtagacacagggaggtacttctgaagttaattataaatagttcagtttttcctacctgtattagaagatgccattttcttcttcaccacagtgttttctggttccataggataacattggcttttggaaaactcaccacgcattaacctctagagagagtttgtagtttggtttgggtttgggttttttttttgttttgtttgttttttttctgagatggagcctcgctctgttgcccaggctggagtgcagtggcatgatctcagctcactggaacctctgcctcctgggttcaagtgattctcctgcctcagtctcccaagtagctgggattacaggctccctccaccatgcccggttcattttttgcattttcagtagagatggggtttcactatgttggccagggtggtcttgaactcctgacctcaggtaatctgcctgcctcggcctcccaaagtgctgggattacaggcgtgagtcactgcgcctggcctgttttttttgtttttgttttttaagagacagggtttcattcttattgcccaggctggagtgcagtggtgtgatcatggctcactgctgccttaacttctgggctcaagcaatcctcctggcttagcctctcaagtagctgcgaccacaagcacacgccaccatgtccaacttggtttttaaatttttcatagagatggggtctcactatgttgcccaggctattctggaacttctgggttcaagtgatcctcccaccttggcctcaaaatactgggattaaaggattgagccactgtgcccagctagagagtcagtttttacagatctcttatttctggctgttaagtgtggatcagatagattttgaagctctttggaagacctggtcaggatctgcttatcaatcacttatgtcaacatcatatttactgcacgaggaatgctgtactcttctttcatcctgtggcttcctgggcttgtgcatttcaagattatgccacaccagtgcatcagtctcttctactccacagtccactgctgttgggtagaagaaatttcttttctctcatacaggtagagcagatgaaatgactgtgattaaattttaaatctttatttgttctctgaagattaatgagccagaacgtgaagcagtcatttcagatagttatttttcaagtgtatattagtgtcattctcttaaaggacttgtatttttttttccttttttttttttcttatttctgaatccaggtaattgactgctctgactcaaatggggtaaccataacgtttgtgataaattaagccaaatttaagtatcattttgcagatttatacataggatatttttaactcgatgtataatgctttaagaacctgttgaaccatattgtttaagttttgactgtttttggttagattttgttactaatgcatatgtgtaaaagaaaattcaaatcagtcaaggatacccttattgaagcagtaaaattctataagccgaattgaccatgatttctaccacgggtgctgactttcagttatagtaatctatagattaatcttcagagttatattaatctgtacagattacagaacttcaaaaatttaccataaaattggataagttagttataaatgttcaagattcagtctgtcttctaacatggttatagaatttatggcttatctgtacttacttagaaatgttaattgcataggactaaaatgtttcaaataggactaagattgttagaatttcatcctttgaagggtacactgagtacaaacaatttttgaagccgtaagtcagctctcgatgtaattttacttttattttttatttgttttttttttgagacagagtctcgctctgtcgccaggctggagtgcagtggtgcgatctcggctcactgcaacattcgcctcccgggttcaagcgattcccctgcctcatcctcccaagtagctgggactacaggtgcatgccaccatgcccagctaatttttgtatttttagtagagatggggtttcaccacgtaggccaggatggtcttgatctcttgatctcgtgatccacccacctcagcctcccaaagtgctgggattacaggcatgagccaccgcgcccagctaataattttaccttttataaaaggtaatctcttttcctgattcagaaaagcctttagtcctgcaagctctagctaactttctgtcttttaaattcttccagccaggcgcggtggttcatgcctataatgccagcactttgggaggctggagagtcgcttgaactcaagaggcagaggttatagtgagccgagattgcgccactgcactctagtctggacgacagagtgagactccatctcaaaaaaaaaaaaattcttacaccatgctgtagttctcaatttgatgtagctctctgctctgcgttttcttgcatatgaaccttgtatttcccaatgtttatactattgaaaatactacccggggggttgtatctgtagaagtaaagacacaaaagcttatggggtattatatcttgaagatttaaattcagcttttaaagcatttgacattttatttcttctctttcaaaaaaaaatgtagtcattgaaagaaaatcttgcaaggtgttggacacttactgaagcagagaagatgtcctttgaaactcagaaaacgaaccttgctacagaaaatcagtatttaagagtatccttggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagtctaaaaattattagctgttacaaatggaacatttcattataacgtgatcactttgacttgagcaaatggtttaatttttatcttaaaaatcagttaagaatatataaaatcctactttggccaagtttgtttcttttcattatagtttatatgaaaagatcaccttaagtgaaattattttcctttaatcttttatgtatttattcacttttggaagctaggaatgagcaacacaaattttactctgaagtcagaagagctcatatataataattctaatgtcccacctattttcacttgtccattccatgtaccagcttagttatgatacttagtcacataattatctttgataaaggtagaggcacaaagaggcaaactaagcaagtcaaattctaatgtgtgtacttcataataattttttatccattttcatctttatattctgtaacatgaaacttacctaatcttcaaatgttagcttcattttttacctttgaaatacttaatctttctgaataaatataatgtgtctataaaataatgagactgattctggtgtctttagtcattaagctggtatctagtcctataatgaacaaaggtgaagctgccttgaggagacaagtgaaaaatttttgcttcaaaggagctcacaagctaagtaaataaatgaaattaaggtatggggcatggtggcctcaggctgtctggaggtgtttggaaaggcttcttgagtgaggtggcctttgaactgaacttagtttttaaagtagcttttggaagagaaatgaggatttgctatgcagacagggaagggaatttcacttaaaaggaaggtcatttggagatgtgaagatacactgctttaaggaagcagggtagagctggaggataagagatgcagaccatgaagggccccattttatgctaaaggttttgtcctgtaggacatggagaacttctgaagaattttcaaggcgggtgggataagattatattgtattttagattacagtagtccccccttatcttcaggatatatgttccaagacccccagtggatgctggaaaccagggatagaacataattctatatatactatgcatgaatttctttttccttctttacaatctcacacataggtttgttcttactatagatcttaccaatctcagcatacttttatttctcttgagaaccttcaccctttcacttaaaggaggcgctttatagcttctctttggcatatccaaatgccagcatcactgttgtattttggggtcattattaagttacttaatcatccttaatccttatcttagggatacttgaacacaaacactgtggtaggataacagtatatctgattaacagactgctactaggtgattaatgggtgggtagtgtaaatacacaagaaaaggatgattcacatcccatgtgggatggagcagaactgcattatttcattacattactcagaacaggcatataattgaaaacttatgaattatttttttttaattatttgagatggaatcttgctttgtcagccaggctggagtgcagtgacacgatctcagctcactgcaacctctgtctcctgggttcaggtgattctcctccctagtctcccaagtagctgggactataggcacgtgccaccacacccggctaattttcatatttttagtagagatggggtttcaccatgttggccaggctgttcttgaaatcctgacctcaagtgatccacacatgtctacctcccaaagtgctgggattacagtcgtgagccactgtaccccgcctaaaactgatgaattatttctgaaattttctatttaacattttcagaccacagttgaccacaggtaacggaaacctcaatcacagaaagtaaagccgtggatacggtgggactaatgtattggtagcagcctagaggattgatgggaaaggtatgaagctagaaggtggtcaatataatacagacatgagctgatgaacatctaaactgggactatactagtaggagaggaaaggaaaaaacatttggaaaatagtaacattgatatttcttgtgaaggagaagtagaaagtaacagtgacttctagatttctgggttgggtcatctgttgttggatagtagtaccactgagatagggaattcaaggtttggggcaagggtaattggagatgagaattgtgtttggaggtaactactgacattcaagtggagagggttagttggcagttagttctatggtcatctcttttgccgagactgtatatttatcagactcctgggagaacaccaacatccatggggttgtagggaaggctaaggacaagagtggggagtggtaccttgaaaatccaaaagccatctcaagtaaaaggaataaatgtgtcatgctttttaaaaagttgatgtgcggaaaatgttttcttggcttggaaactgggcggccaggggatgacagtatggacttccagtgaagtagtgacggaagcctgatcatagacattaaggaaagcggtgtaggtgttgtgagcttttgctgtaagaaaaagttgagacttttgttttgctttgtttgtgagagatgtgtatgtatttctgctgagtgataaagccagcggggagggactgatttttataggaaaggaggaaaaataatggaaacacatctcattattttattgtcacatttcttttctttgttatcttttgagtgtttcccttttttgccagtagagttattgtctattttttctttctataggacaaaaaaactaatacagactcctttatttttatatggatatactaggattgtaattcagatatttaatatcttttatcagtgttcagatcatagattaatggagaaaacatttaaaattgttttaaatttaaatacattgaactctaacatagatgaaaaatgtgtttactgctttcagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgctgagtactgtttcagtcaattttagaattgcctattctaattgctgtctacaactttttgcttaataaaagaattaacttataggaagtaaaatactttgatagttacagaactggggctaattttgactggagaaaagactaattatgaaatgtgggttgaaacagaccataaaaaggttatattatctatttacctgagggtttcctaaacctggggtaaaattaaaatactgagttttcctctttttcatgtttacttacctcttccaaaatgctgaaggtgatcaagtgagtaggcaatgatgcatcatcatgaaactctctatgtaaccagtttaagggatttaggtaaaatacatctgcttcatcaagataatgactttttccagtcaggtctggcgggcactggagaaatctcatgggaagtgggcagtgaacatggctatgaaaagaaaagttaccataataaatacaagtaaaacatgaaagttttcattagtcttaagatatgtcatttatacttagcaaaatgtgaaatctgaatctgtaaactgtgttgcagttaagtgaagaagcaagcctttaactcattttctcaaagataaaaaaaacatgattcttataccatgtacctatgcagcagcagcagtataacctataagcccaaactagtgcatagaagtccatttcaaggagggaagtaggtcagtagggggactcaacattctgtagcattggtattctgttccggaaacataaatggtcctcaggaccaggtaagttaacttgttaataggagagtaattctccataggtgtatttgataaagtaggaaactgtgatcataatcagaaaggattctttctctcttccctttctgctctgataggggatggatcacatacttatatggcaagttttttttttttgaagacaagagtttcgctctcgtcacccaggctggagtgcaatggcgcaatctcagctcactgcaacctccacctcccagcaattctcctgtctcagcctcccaagtagctgggattacaggcgcccgccaaccacgcctggctgatttttgtatttttttagtagagatggggtttcaccatgttggccaggctggtcctgaactcctaacctcaggtgatccacccgcctcagccttccaaagtgctgggattacaggtgtgagccaccacgcccagccacatggcaagtttgaagtgttttttttttttatttaagatgattgagaagtagagagcaacatatgtccactgattaacatccaaataagtaatggttttattgtggcatagaaagactagagtaggccgggtgcagtggcttatgcctgtaatcccagaactttgggaggccaaggcatgtggatcactggaggtcaggagttcaagaccagcctggccaacatggtgaaaccctgtatctactaaaagtacaaaaattagccgggcatggtggtatgtgcctgtagttccagctactcaagaggctgaggcaggacaatttcttgaacccagaagacggaggttgcagtgagctgagatcatatgccactgcactccagcctgggcgacagagcaagagtctgtctcaaaacaaaaaaaagattagagtataaaaaagatggattcatttctaataccagttatgacaatttaagccagttacttaggtcatgcaaaaagccatgtttataattgccttaggaaaaattaaacctcactgatacaaacatttaaaatttccagttagaaatggagttagtaattatgcaggaggtttatttatgaaatgcataaaaattaaatgtacacaagacctaatagtgatttatttattggaaatgaaggtcttgtttcaaagggaagcagaaattcctcagaaaaagctgccggcctactctagtctttctatgccacagtaaagccattacttatttggatgttaatcaagggacagatgttgctctctact

SEQ ID NO: 14160 - DNA, 23578 bp, Human
  misc_feature (1)...(23578): n = A,T,C or G
gactgggtgccttggacagtagacatttatttatcacagttttggagactagaaagtctaagatcaaggcacaggcagactcggttctggtgaggcttctctctttgggttgcagaaggctggctgtcttctctccatgtcctcagatggcctttcctctgtggtgtgtcaacagagagaggcctgtgatgtctcttcctcttctgatcaggacatcaatcctatcagattagagccccctgcttgtgacttcctttcaccttaattaaagtcctatctcaaaataatatccctttgggggttagggcttcaacatatgaatttgaggcagaaaacaattcagccataacacataccaagcacacaataagtgctagttgctattgttattactgctattattaccgttactagcattgctaccagtctaccaccattgctgctgctgctactaccctcaaaataataccactgcaatttccagcactactattccactatgattacatttctagggaaggtaggaactgaacagattggcctggcttatgcccaaaaggaattcttgaaaggtcccatgcaaattgaaaatgatgtgatatgtagatatactcgcaccaggacaagggagggcctgtcataaaggaaatccacacttggaatcctggcctttgtccctgtgtagtctgtgctcttactaagtctgcaagaaatcataattcagtgcacatattccatggggaagaagtaatctggaaactgaaagtgaaaagttgcagagtactggctctgctatggaggggctgtgtgacctcaagcaattcacttcccctctctgggctttgtttgtaattgtttacaacttatttacaaattgtttgcaattgtttacaagttgtttacacattgtttgcaattgtttacaatcgtttgcaattgtttaccaattctttgcaattgtttacaaattgcccttgtttacaaattgaatgtcagaataactctcaaaattctcttctttccatccatatagaccctgctgattcactcatccacttaccaagcatggagtttctcctgtttgccaggccctcttctacgtaccagggacacagcagtgaaaagatagatgtcttctctgctgttaggaaacttacattttcgtggggagagagagatgaaaaatgagtacacaactacacagacatgatctagttacaaatcctaaagactgctattcagggaagaaagaggcagagtaggaagacagagtggctggggtcaggatgggggggttagtttggataagaaggcccagaaagatctctaagaggagggctatttaaggagcaaaagattcatgttaaggtctacacaagaacattccagggactagcaagggcaaaggccctgggaaggatgtgaatcagatgtgttctagaaacagaaataagaccagtgtgcttggagcttattgaggtggggagacagtgggaggagatgaggagggagaagtaggcagggctgtatcatcatcaccttgatagatgcagccaggtttattctgtggcattcccatatatccagtgagatgccactgaagagtttcaggtttcagggagtgacctggcctgaggtccaattttcaaaggacctcagcccatacatgaatgagcagggtctctacggatggaaagaagagaattttgagagttatactgacattcaatttgtaaacaagggcaattggtaaacaattgcaaatgatttgtaaacaattgcaaacaatttgtaaataagcccagagaggggaagtgaattgctggaggtcacagccgatccatggcagagccaggactctgcaacttttcactcttagttcccatgtgcactgatactgtgtttactctggtgctgtgtccgcatagacttcagggggcaagagcaggagtgggaggagaagttgggccagtgatgagaaacaccattagtgattcatctcttctctgagtgcccaccctgaggggttaagcagccggagcaatgcatcttcttttgaatgttccgagctccccatctcaaaggaccacatggagattcatgtctcaggcagagtggcaatttccttacacttggcaaaaacgtatgcttggcaagaactgtgacagtaatactgtgtttgaacccctgttttgggctaagctgtgggggcacagcagagagcaagtcaggcatgcattccaatctcacggagcttccagtctagccctcgtccacctgtcacttgctagaaatacctggtcttgggtttgaagctcctgaagcagtgggagaggtggtttacccccaggaaatgttttcctagccttggatcacagcaggttgtcttatcctcccagggctgcaagtcattttgtacataaacgaagaggaatacaacccattcctcgtgtcctccactggagctaaggtgatcatccatcggcaggatgagtatcccttcgtcgaagatgtgggaacagagattgagacagcaatggtcacctctataggaatgcacctggtaagagaatattctcatttccataggcttggagagaacagatctttttttttccaaggataaccaatggggtgcagcttatggaaaagggtgtttgtttcaaaagggaacatggtcccagattttcccatggttatcccattcatttcaggagttacattaaaggttgtgtttgtatcttctggccggctgcagtggctcacacctgtaatcctagcacttcaggagaccgaggtgaggtcaagagtttgagaccagcctagccaacttggtgaaacctgtctctactaaaaatacaaaaaattagttgggtatggtagtgtgtgcctgtaataccagttactagggaggctgaggcaagagaatagcttgaacccaggaggaggaggttgcagtgggccgagatcacgccactgcactccagccgagcaacagagcaagactccatctcaaaaaaaaaaaaggttgtatttgtatggattaataggacagggtgccatttggggagagaatttcaagacaccagcatttatggaacctatgctggaagcaaggcattaggacactaactatatatttgtcagtaatacaaacagataagattaccgtctatctttctgggctgcttagaggcctatgaggcatgtcaataactgtattaaagcctagtggaaagtcactcagctatccaaagtctatttagcccattacactcctgtcaattttacctcatttaccaagaaccccttctccctccaaatttgacctttgtggacctcattgggcactgagaacatgcaaacctatcaacagaagcacaagtaagccgcagactccaatccccgagtcagccttgcccaatgggagctgaatggcaagatgaagagtggactctgatggccttggtcactccactgcttatggagttttcttgtttgcaggcctggggtctttttattccagtatctatctgcctctccctttctctctttcatagaatgactgttaagaacttatttagaccgggcacagtggctcatgcctataatcccagcactttggaaggccaaggtgggtggatcacttgagcccagaagtttgagaccagcctgggcaacatagcaaaaccccatctctaccaaaaacgaaatacaaaaaaaatcaccaggcatggtggcacaggcctgtagtcccagctactcaggaggctgaggtaggaggatcacctgacctcagggaggtcgaggcttcagtgagccatgattgtaccattgcactccagtctcggtgacagagtaagactctgtctcaaaaacaaacaaacaaacaaaaactgatttaaaggagttaggtgcagtgcatagacttgtagtcccagccactcaggaggctgaagtgggacgatcacttgagctcaggagttcaagaccagcctgggcaacatagcaagaccccatctctacaaaaaatataaaattagccaggcatgctggggcacacctgtagtcccagctttgcaggaggctgagtggggaggagtgcttgagcccaggagttcaagacccagcttgggcaacatagtgagaccctgcctctattttttttttaagaacttatttaaagagagtgtccacaccaaccataccaaggagtgtaccaagcagagtgtatctctcttccactcccgacatccagacttctccttcctctccagagggaccaccactgttgctactgtgtcttggcagggatattctagtcattcaagcaagtgcatataggtataagcatttctccttttatgcaaatacaaaatatttctcacttaatgctatagctgggaaatggttccatatcaaaacatatagatctgcatcattcttttaaaagattcatagtcttccattgcgtgaataagttattgatgcaaccccccattgatagacattaggtcatttcaggcacaactaaaagcaatggtgcaatgtgacgtgtatttgcccagttacttcctagaagtttgtcaaacaggacatgtgtttgccagattgtcccccaatgaggatatagcaattgagaaccacaccagcaatatgagagtagctatttccccacactctaaccaacataatgtattaatgtttaatctttgctaatctgtcaagagaaaaatggtatctgttatcattttaatttcattctttcataatgatgtttttcttttcttttcttttctttttttttttttttttttttttttgagacagagtgtcactctgtcacccaggctggagtgcagtggcatgatcttggcttactgcaagctccacatcccaggttcatgccactctcctgcctcagcctcccgagtagctgggactacagtcacccgccaccacgcctggctaattttttgtatttttagtagagacagggtttcactgtgttagccaggatggtctcgatctcctgaccttgtgatccgcccgcctcagcctcccgaagtgctgggattacaggcgtgagccacagcgcctggcccataatgacgtttttctttacctgtttatgggtggggagaaagaaacaaaatctccttgtggactatacatttgttcatgcctttatttaaatccaaccttaatatccccaattaaacttcctagcttttatccttcacaaacatatcctccagagaagtggtttccaaacctggttgattatcagactcaaagccactgaatcagaatctctagaagatgagcccaaggatctatatttttaccaagttgtagtggttattctaagaggcagcacccttgggagtcttggcttgacctttttttaatgtttaaatttaaaaaatttttagagtcaggttcttgctctgtcacccaggctggagtgcagtgacacaatcatagctcactggagccttgaactcctgagagccttggctttagagcaatgcagaattagaggaaaagctaattgtgtcttcccaagtaaaagtgaagctagaatgacacaaagttctagctatagctttgcattgggttacataaaaagatggtgggcaattagggcttggatatccgcctgtcatttatccattcaattgacattttctgagcaccttctatgtgctagacatggggcacctcagtgtggaggacaccgtccctgtcctgagagagtctagagtccagcagagaggattgagtaataaaccagaaataatacaaatgattcattataattgccataagtgctatgaagaagaaatgtaagaccatatgagtgcatattatgacacgactgacctggggctcattttcaatggggaagatgaggttcaaggaaggctttcctgaggaggtgctatttaagctgagacagcgagatgatgaaccggaatggaagtatgacagatgaaatgtggggcttcactgcctcatggtgccccatgaaaaggacaacactggacaagggaaaccatcaaaatggtctttctgggcccccagatgctctcaggaggcatgttacttaggggctttgttccagcatgggagggaagtaatgtgtatcagcttgagctgtgtgaatgaaaaaggaaaaactatctcgaaccctcaatctgctcaaactgtgacttgaaaagacttttttaagagatagccacttaagcagctgggcaactcattcttttgttcactggcagatggcaaaacctcagagcacaatggtgagcattttggtcagacatgtcccacacacttttatctgcaccctgaagtaggatccaggatttgcagcgcatccttcccttatcctttcgccctcttcccccttttcaaactggtgtaagttactagagcttgtaaaagtataagaactaaggaattctgctctcttgttttcttgctctgagcttggaaatacccaccacattgttaagcaaatgttctctttaccagtagtgggtaaacaaagacatgagtgagttttctgctacacctaatttaagatgtagaaaatcaaagccacagagcagggtcagtcagctctaggtctgatttatgagcatttagaacaacaacaacaaaaaaaaacagggtttatgaagaggtcagcagagtgtcactaagaaaaactccaaccaaactagacttccttcctttcttcttttctgattttatttatgtattgattgattaataggtgtgtgaagctggtaggctcagtcaggctggccaggcagttggtaaacaaaacttcctttattcactgagagattgtgtgtccaaagcactgaatattaaaaggtgaacccaacagagctcctaccttcaaagttcctaactttcagaggggaagacaaaagtttgtttgcttttttaaagacaaggtcttgctctgtcatccagctggagtgcagtggtgtgatgacagctcgcagatcacagcaacctcgaccacctggggtcatgggattctcctgcctcagccttccaagtagctgggaccataggcacatgccaccatatctggctaatttttacatttttgtagagatgggggtctcgctatgttgctcagactggtctcaaacccctggcctcaaacagtcctcccatcttggcttcccaaagtgctgggattatagatgtgagccaccacacctgaccaaagacaaaagtaagcacaactttgcaatacagtttccatctctgtggaaacagaccttttctgcctggttccaaagcttacttcttagaacataacagatcctcagtaaatattgatagatgacagatggatgggtgggtgggtgggtggatggatggatggatggatggatggatggatggatggatggatggataggtgagtgggtagatgggtaggtggatggatggctggctggctgaatggatagataggtgagtgggtgcgtgggtaggtgcatggatggatggatgcccagacagaagctactggagaaggctttctaaataatggatttagaaggacaagtgcaggcaaatagtcaagaagagccagtccagacaaagaatgtagcaattacagaggagtcacaaaaaggagtttatttaagctgtgtagagaaacttttcaaaaaatcattttagtggaagtacaatcagtacactggagacagcacatttgtagtaattctagaaagaaatgatgtggacctcagctgaggcaatggctgtggagatgagcagaggaaatagatttcacggatattatagcacagaagcaacaggacttgacagccaatgttagccagaagggccgggggaagttagattgatatttaggtcctggcttgggcagggagatggaggaatgccaggctcagaattagagaatccaagggcagggtatgtttttgggagaagatgaccacttcgatttgggacagacccaatttgttatgcctttgagaagtcaaggtgaaaagaaagcattcattagatgctatggacctggagttaaggagaaaaccttggggggtaattgtagacatggaaataaatgccatcacccaagacctgagacagaaccctaaacatgcaaatgtttaagggctgagcagaaagtaaaaggagaaagagaggcagataagtaggaacagaagccagaaagagttggcatcagataaatcaaggaagagaattttacagaaggtgtgaccaaataagcaagtacagtcgagaggtcaggcaaggtagaaggcaaaagtattctctggttttggcagccaagaggtcaccagtgttctatgccagagttgttttcagtggaaggagtggaacagaaaccgaagtgcagtgggtcgaatggtgaatggaaaatgaagaagtggacgtgggtggaccactcacccagtggggttggggaccaggccctggagaatggggagactccatgtcattacaaatcctgttgtacattttgattctaaagcacatagccagactttatttcacaagttcagtctatgccaaacagggattaagcgctctgatgggtcaggcgcggtggctcacacctgtaatcccagcactttgggaggctgaggtgggcagatcacgaggtcaggagattgagaccatcctggctaatacagtgaaaccctgtctctactaaaaatacaaaaaattagccgggtgtggtggcaggcgcctgtagtcccagctactcgggaggctgagacaggagaatggcatgaacccgggaggtggagcttgcagtgagccgagatcatgccactgcactccagcctgggcgacagagtgagactccgtctcaaaaaaaaaaaaaaaaaaaaaaaaaaaagagctctgatggctgagattcaaacccaccccagttttgcacattggttgtataatctctgcctcagtgatctcatctgtaaaatagggatgataataatgacgttacttcatggctggtgagaatttaatgagttggtgcatgtgaaacgcttggaaatgtgtttggcatatagtcagtgcttaaaatatattggcttggctgagggcagtgacttacacctgtaattccagcactttggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtggttttctttaggtactttttcacatgcaaaatagtgaatgtttacatagtcaaagtctttgttttcttctttaatcattatgttaatgagagttcttcctctttgagaccagatactaaattgagtttgcttccagttattttattatttcatgtaatattctaaaccatcagaatttttttcaccgggtacagtggctcacgcctataatcctagtgctttgggaggccaaagtgggagcttactgccgctctgacctcctgggttcaagcaatcctcccacctcagcctctcagatagctgggattataggcgtgcgccaccacacctacctaaatattgtatttttagtagagacggggtttcgccatgttagacaggctggtctcaaactcctgacctcaagtgacccacccgcctcagcctcccaaagtgctgggattacaagcatgagctatcatgcctggtctattgttgttattgtttaatcaaaatcaaatagccactaggtagcacagtgggaatctgatttcagacttgttcggatccaagcctacattcctgaccccttagctagcctgcctggtgctcccggttgtttaggggtgaatgaccattgaccataatacggtccgttgagaaaaagccttctagaagggcccagaattcaacccccttacgcccacggtcagaggagaccatcaggacagggtcatgggaggggccctgagacagcctagagacccaaagcaaacaaaacctcctcaataatgagtccaagctgggcacagtggctcatgcctgtaatctttgggaggccaaggagggcagatcacctgaggtcaggagttcaagaccagcctgaccaacatggtgaaaccccatctctactaaaaatacaaagaaattagccaggcatggaggcacacacctataatcccagctgcttgagaggctaaggcatgagaatggcttacacccgggaggtggaggttgcagtgagctgagatcatgccactgcactccagcctgggcaacagagtgaggctccatctccaagaaaaaaaaaaaaaaagtccctcccaggtctgcacaggttcaagaagaaaaccatccacctgttccatccccagcctggccatccctgctgtcccctccctggcagaagcagcagcagtccattctgagaaacaggggtatagcatggaaaccaagggaaagaaaagccccccacccacccccagagcccagctgccactttagcctgttgactggggctggtagacacctccaccatgccctcagtggctgggggaggaagtcctttttactactgggagaatctctcactcaaacaaagtcttacccagaaatgtacacaatggaaacagaaatgcaggatgaatgtagctgagcctgggaaaccagcctgcttaccgcccaccccgctgtgatgggccctaaaacagggtgcagacagaacagaatttgcaaacctctaagctgtggcaagacaggcaatctttctgagaaggtgacttgggattactggctgggacaagagttaccactgaaatgtgagaacaatggtctgatagccaccttgtctgggaatagcttggctggactgaccaccttacagatgagaagtgattatactggttggaaggtctcaaggttgcaagaaggtgggagctggctctctaaccccagaagctgtgggggctttgataaaggccctcctcttgtcacctcccttcccctcaggctctgctgccatctgggctttcccccttagcactgtttataccttaaagaatgagcttgctgggtgcagcgccccatacctataatcctagcactttgggaggctgaggtgggaagattacctgagcccaggaggtcaaggctgccatgagccatgattgcaccattgcactccagcctgggtgacagatcgagaccctgtctcagagagagagggtggtgagctaaggactcctatacaattgtctccttcccccaagatcttcagaaagaagcagaaagaatctggtttgatataaatgggctccgtgtcccacacatatacccctatacctacacatacatgcccacatccactcacacacatccacacatacctatgtgtgcacacacatacacacttttacatgcataagtgtatgcatagatacacatacaaactcacacatatgcacacatatacacactcttttttgtgtgtccctaggggtcaggatagaagtcaaaatgtcttcctagcctccacaagccagcagttctagaaaactgaaagctggggccgagggaagagcattctgtcaaagttcatgcattcgaggcatgaacagaaaatttgctccatttgctctacttctggttgcttcggaaaacaacctgaacctttcaagagctgtgagtttgataagcatcgttgcagaatgaagggccattgagtactcagaaagcgttgaaatccaaatggtttctcataatcagtttcctggaagcaggccatgggctggttttcagggtagagggagccccagccacccctgctggctgcactcggcttgcctaagtggacagacccctcatctggatgccagagtattatgctttcctaccccaggaagctagagcctgtagctgacactctagactctgggaacagttcagcaggaccggggggaccaaaggaacgcttctgcccagggatcctgctgcttggagaagcttagaggatggcaaggaattgtgacctcaaggaaggccactgcttggcatctttgcacctctgtgcccagcccagccctggtgtgcactagaggccctgcatgcatttgctacccatctattaagtctatttattctgtactgacatagaaagacactcactcttgttagtgagaagggcgggttgcagggcaaagtaaatgtatgagtccatgtctgtctgtctgagatgcaagatctgatctgctagtgcgggcaccctgggaaagaggggaggccagacagccactttcccctttgtttgcttctgttgtttaaacagttttaaatgagcatcgtcaattgccctggaggtacttgcagctaattgagggagactaatgggtcagcagatgaaatgcaatacaaacagaaagggattataccagttgagatggctagtttccacctgcctcaaacctcttaattccttccccctctacccgttttcattctttcttcaaagagaaaataattttcttccctcccacaaatctgccattctttttctctttacccccatctccccaaccaaaaaaataaaaacaattatacatgggcacgtggatgcacacagcacacaaacacacagttgtaataaactggtcactatttatcttccattgagttgctgaccttagaagatgttatcctcccacccccatttttgcttgtttggcttggctggattatttatttgcagtgacaaatattaagctagagcaaaatttagtaatccacaataaaacatcattgaagccaggtgcagtggcaggagcctgtggtcccagctactcagagaggctgaggcaggaaggtccattgagcccgggaggtagaggctgtagtgacccttgattgtgccactgcactccaccctgggtgacagagtgagaccctcatctctaaaaaacaaaagcaaaaaaaattattgaataaggattttgaattttgagtgacaatgctgtttacctcctctcatgatcagggtagcattctactctgttgagctttccttagcttttttctaagaaagtcaacatccttcaagtcaacttctgggaccagaaaacaaggcaatgggtccttcacctgagcgagaatcccaagcactcacagtccctgctcccgcttccttttctctcccttcccttcccttcccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctgctcatctttctaatccctcctcccacgtcccagtggtatttgccaactgcaaattcatttcattcagacaatcaaatccaaatttctcagctgggcatgatttggcctcaacctccccatctgactttatctccagcaatttctctattttgccattttcagccataccagcccatcttgcttcaagcctttcctgtttgctctacccaatcgtactctgtccacttcatcctcttttttaaagatagagtctcactctgttgcccaggctggagtgcagtggtacgacgatggctcactgcagccttgacctcctgggctcaagtgatccccccatctcagcctccctagtagctgtgactacaggtgtgtgtcaccattcccgacttcctgtccacttcttgacaagaccagctctttcttgcagttccacgctaagccaacaggtccctttttcggaaataccttccctaatcactctatgggaaaaactgcccatctgctcttaacgcctccagtttccctaccctatttcattaaacaccatccagatttatccaaaatatcttgtttatttatttgcttgctgaccatttgtttaccccactggaagctatgttccaggagagcagggaacttatctatcttgatcattgctgatttcagtgtctaccacagtaccaggcacctaataggttctcactaacttttcattaaatgaatgaccaaatagcttctcagctcccaagggctgcttgcaaagtcccctgtctggtgctccttgcaaagcccccgcctgggtccggggggaggacagggctgagtgtgtgctgctgtgattgcagacagagtccttcaagctgagtgagccctacagtcagtgcacggaggacgggagtgacgtgccaatcaggaacatctacaacgctgcctactcgctccaggtaacagattggcgggggcacccagccctgggtttatggcccggacccaggagacaaagttatatctaggctggggtgtggcttgcaccaggaactctggtgaggatccctggggttcatccagagacctcaagaacaaatgatgccggctggttccagtcctctgcagttcgtctgtaaccagagcttaattgatacaccgaggtttccgtggaactcaatgtacagctgagacagacccacctcctaagtaggccttggcaagggaggaacaggaaagaagcggtctgggagagacactggctgaagggtcaagagcatggcttccgggcctgctggtgcccctcgctggatgatggccttgggccagctgggttcccctcagcaaccacaaggggaggtgggattggatcaggggctgctaatttgcagctcccagtcgccttccaggtggcatacctggtttttcaagagcctggatggtgttcgaaagtcaaggaatttcacaagaaaatccagattcccagcctctcgaaaaaatgaaacgatacggcaacattgagcccatatttcctgcaggataaacagtgggtgtagctaccccaataaatgaagcaggtgttctctggctcccacagttttcactacccctccagtatgtcacttacatcactgtctcctgtagacatctgacttttcaacacttaagtgagatgatctgttctgcctcctctcacattctgggaatttatagttcacctcctaccaggataccccagagagtccatgagaatcatcccagcagaacaaaaggaccagaaaccttcagcactgagtcttccaacttagataagagctgagctgagaggtggtgtagacactgagtaaaagaggacttttgggccaggcatggtagctcatgcctataatcccagcactttgggagacaaaggtaggaagatcacttgagcccaggagtttgagaccagcctgggcaacatagcaagaccttgcctctaaaaaaaaaaaatttgttttaattacctgggcatactggtgcacacctgtaatctcagctataagggaggctgaggagggaggatcccttgagcctaaatgttcaagcctgcagtgagccatgatcacacgactgtacttcagcctgggtgagagaacaagaccctgtctttaaaaataaaaaaagtgagctcatcagaaagatacttctggatgacatttagtgagaactaccatgcacacacacaccttacatgtatcaattcatttcatgctcacaacttcatgaagttgatattattataaagaaagcaaagcatctgagaggttaagtaacttgcatgatgccaaacagcagaaaaatagcaaagattggatttgacctgagtagcctgccttcaggaactctgccattagcttttatgctataagctccatggatattgtggtagcttatgatccatgaagatccaacatggaggggttgggcttgagaataggaacacagggactgtgtttatttctctctgtttcttgacaactcctctaattttcccacttatctttgtgttggcacccacatgatggaaaatgaccacccaactactgcagccccagctcagccccatctccatatctcagttagtctaaattcttaatacatcggccaggtgtggctcatgcctataatcccagcattttggaaagccaaggtgggaggatcacttgaggtcaggagtttgagaccagcctggccaacatggtgaaaccctgtctctaccaaaaatacaaaaaaattagctgggcatggtggtgtgcatctgtaatcgcagctacttgggaggctgaggtgggaggatcacttgagcccaggaggcagaggttgcagtgagctgagatcatgccactgcactccagtctgggcaacagagcaagactgtctcaaaaaacataaaaaataaaaataataagtaaattattaatacatcttccaggttgggccctttgcagttccgggaccatgcccagcccagttggcataaggggcaggttcatgtggttggccaaggttaagggaggctgaccccctgggctgagggatgtgcaggaaactccctgacatccctgagcaaagacatgaatggcattcctgggtctcctctttcagatctgccttcattcatgcttccagacaaagatggtggagaaatgtgggtgtgcccagtacagccagcctctacctcctgcagccaactactgcaactaccagcagcaccccaactggagtgagtgagacccagctccagccttgcatgccccaggaccagggtcagcctagtcctggcaataggcactcctgggactccacccctgttgccttttgcgtgagggaggtattggttgagagccattaactagagttttacttctgttgtcaagcctggcttaaattatactttgcaactgaccaccttagtcaactccaggaggtaggaacggtggatattaccttttcacagaatagataaccaaggcccagaaaggctaagtggcttgcccaaggtcacacagccagaaaggaacagagctggatccaaaccaagggtggtctgaccttcaactcacatcctcaaccgccattgctttctgtttcccaacatcacaatgcaatatgtgtttccagagagttggtagaaagtgggaggagaaatcattaaaatgagactgcggggctgtccttggtgacctggggatggccaggaagggtcctgtggctccaaagctcatgctgccctctcccttgtccctcagtgtattgttactaccaactgcatcgagcctttgtccaggaagagctgggctgccagtctgtgtgcaaggaagcctgcaggtatgtggaccccaaggggtgagacgggtggctgggttgggttgggctgcctacactcatgctgtcccctcctcccttagctttaaagagtggacactaaccacaagcctggcacaatggccatctgtggtttcggaggtaagttcttctgcccacccttccccactgaagcccccagcctggagccccactgacatttttgctgtgtcctctggcctgggacatggtccagggggaaaagaattaccttgtggaggctgggggacaagttggggagcctgaggcgggaggctggccctagcctctcaggcaccctcaggcccacgctttctctctccgttgtagaagtggttgctgcctgttctcacttgggaccaaggccggcaagtaaacaaaaagctcaacaagtaagttacctctaccctgttcctctgtctcttcccaccacagcccccagccttctcacttgcttctgtatgtgtatggccaaatcctctttttttttttttttttttttatggagtcttactctgtcacccaggctggagtgcagtggtgtgatctcagctcactgtaacttctgcctcctgggtttcagcaatcctcctgcctcagcctcctaagtagctgggattataggtgcgcaacatcacatctggctaattttatatttttagcagagatggggtttcaccatattggccaggctggtctcgaactcctgacctcaagtgatccacctcccttggccttccaaagtgctgggattataggcgtgagccaccaagcctggccccctctccttttcattcactcactcattcatttcctcaaagctgggagacggtgaactcacatctgtgaatcatgccatgtgaactcacatttctctaagccatcactatctccctcatgcgcactgctgggcctgcctgccatgagagccaatctggccaatcttgcgtccaacattcatagagcaccccctaggtgccaggtgctgtgtgaggtgctgggggaaccaggacaatcaagcagacatagtctctgtcccccgaggtacttacactctaatgagaaaatagactttgaccaagcaattgcaaaccattaaaccaagtgttgcaagctggtgactgatccttggcccaaatctagcctcatgaaagcaacccattatttccaacttttcctgaaaattcaaaagttctggcaagaacgaccctccactgttttgtagcaccaaacagctgagtaatacttgctcttttggctgagtcatggtccagttcaccatcgtcctatcaagaggcagtttagtgcaatggttaagagcatggactttgaagctagatctaaatgagttggagtactggctcagccaattattgacagcatagtcttggacaagttccttaaccaatctgcatctcagtttccacatctgcgaaatgaggatgatgaaaatatacatacctgcctcatagggctgttggtagaattcaatgagttagttcacataaagttcttacgacagtgcttggcaacacaggaagtgccccataaatgcttgttgccattgtgcctattatcatattacctcaactaccctgctcatgtacattacctgtacatacttgagattgcaatcaatcaattacaaatgtcaatgtttaatgaagaacagggtacaatggcagtatggctgggtcgactgacttaatctggaagttggggagcagttcttgagtgaatgaatgacctgtggaccagatccaggctggagatatgctctggggtgtagacggagcccttatgggccaggttctaatatccccaaggagctcagtgccttggccatgctgccagcttgggtaggagggagacagccatgctgaggactggtaatctggtaggatgccaaggctcttgattcacctgttggaattttgcaggacagacttggccaaactcttgatattctacaaagacctgaaccagagatccatcatggagagcccagccaacagtgtgagtagagtggcttccttccaggacctgtcctgggcctacaaatgtgagcatcttcctggccttggggagcagaatcagggtagggggttccagcctactctaggagggctgttgtaggctagccaggtctcaggtcggaatgcacagagtaagaggaaacaggaaggctgcctgcttcttcctcccagcctgtgcagggtcggggctgacccgtggctcccttgggaatcagggttcctgtgtgaggccaacttggggggaggttcctcttgatggtgtggcttggcctgtcttgcagattgagatgcttctgtccaacttcggtggccagctgggcctgtggatgagctgctctgttgtctgcgtcatcgagatcatcgaggtcttcttcattgacttcttctctatcattgcccgccgccagtggcagaaagccaaggagtggtgggcctggaaacaggctcccccatgtccagaagctccccgtagcccacagggccaggacaatccagccctggatatagacgatgacctacccactttcaactctgctttgcacctgcctccagccctaggaacccaagtgcccggcacaccgccccccaaatacaataccttgcgcttggagagggccttttccaaccagctcacagatacccagatgctggatgagctctgaggcagggttgagaagacagatctagtcaggaccaccagccatggtctaaggacatggatcgggtgcccccagacgtgtgcacaggggaccctctgccccactctgggcttttcagatactctgaccaaaaagcctgctttaaaccgcaagatggggcctgggcatgcgcaggaggagccatcgggtactacgcagcaacactcacaactgtccaggctgagataaatcccgggacctgaactattagcacgtcactagagactgggagccgaggcagtggtgctggcccaagtgaaggccagagtgaggactgatgcagctctttacgggtcttgagagggaaggactcttccaaagccccaaagccgagggtttcacccacactgccagcctgggttggggcccaaggatgtgaccttgagtgtcaaggctggacagctactgccagatgccaaagataggagaaagtgccagccctgaagctggagccgtttgtgaataaactgttcttcatcattgacactggagaaaggtgtcctccatgccctcaggcagcagagaactggcccagggcccttggagtgttggtggagatcagagtgccgtggtggaggtctgggactatgtcagagtgtcctcactttggggcatgggtgggcccaggagatggatttagttattcaattttgtggatgaataaattgaggcacagaaagattaagttaccggcccaaggtgacacagtgaggaggtggcagagctaggatttgaacccagacaatctgactccatgattttgcatccaattcgtgtctgtgccttttaaagggtgaggtctgtgtcactttgggtggggagggggagcatggtgggccatgctctgggcagctgttccaagacagagctgacccttccattaccaatggcctgtccctcaccaacaagccaactgccacagatgacccacttcataccacattcacatctttccacctgaaatggctaacaggtattaaatccttggttggtgtttaaagccaacccaagaacagggtgttaggtactgttttaagcacctagataggttagcataggggactgcaaatggtgttccgcaaagcaaatcctgtttttgaccatgaactaagaattttattttattttattttttattttttgtagaaataggatctcactatgttgcccaggctgttcttgaactcctggcctcaaatgatcttcccacttcagcctcccaaagtgcagggattacaggcacaagccaccgtgcccagccaagaatttttatttttgcttttaaatagcaaaagaagaagattctgtgactcatgaaaatgatatgagattcgaattccagtgtctataaataaagttttattggtacacagccacatccatttgttcaagttttgtttatggccattcatgcactacagtggcagagttgagtagctacaacccagacctgcaaagccagcaaaccctaaaatattttccctctgtccctttacggaaaactgtgctgacccttggatgagcacattcaatgggtatgattatcccattttgtggatgaagagactgaggcataaaagattaagttacttgcccaaggtgacacagctaagaggttgcagagctaggatttgaccccagacagtctgacaccagagctggtgccttttatcactccattattttgcagccattctggtctgtaccttttaagagtgagtccgatgtcattttgggtaggaagagggagaggctaaataccctggctctagggctaaaggaagtccttcatccatgggtggggaaggtccacatttcaggactaatcccttcatgagaatggctgctagtaagggcaagagtcttggtaaaagagaggggctgtagggaccctgtctggacctgggcatccctggtccaactcaaccccaggcctgtggctagagtaagcctctgctctatctggtgtttccaccagaccttatagggcagggcattgccaggaggcatgccagccagcaaggaggaggtcatagagaccccagactggagggagctcccctgtgaagtgggctcaggagccaggcccatgcaggtgaggattgggctacagaggccgtgagcctggctttcgtccatgctgggctctggcggctgtagccggtgccgacagggaacttgcagctgatgtctacctgagcacagcacagacaggagcttcctcctcctccccaatggtggggacaggaggtgccctcagattcgtggaattggccagcctctgcctgatggaggaacacttctagtaggcttgtcaaaggcaaggccatgagaatccaaagccaacagccgctcaactccccccaagcacacgggcgtgcacacccagcaaactccagctgtctccattcttgtttggctcttgcagtgcccagcatcgtcttccctccttctccacttcacccttccaggccagctgcaaatgtcagcacctctgtaaagttttccctgaccctcttcccttgccccaagaagttggagcttccaccattacacaactttcacccatatatatatataatatatataaaatatattatattatattttatatatattatatattatatatattatatattatatatatacgtatttatatattatatatatatatacgtatatatatatatgaaacaggcagggtcttgcctctgttgcccaggctggagcgcagtggcatgatcatagctgactgcagccttgacctcctgggctcaagtgatcctcctgcctcagcctcctgagtagctgggattacaggtgcttgtcactacccatggctcatatttaaattttttatagagacaagatctcactatgttgtccaggctggtcttgaactcctggacttcaaacaatcatagctcactgcagcctcaacctcctgggctaaagcaatcctcctgcctcagcttcccaggtagctgtaactatagaagcacacaattatgtctggctaattttttattattattttttgtagagatgggttcctgttatgttgcccaggctagtctcaaactcctggactcaagctattctcccgcctcagcctcccaaagtactgagattacaggatgagccatggtgcctggccctgtatacaattttttatccacatctgcctctatcattagactatgagctctgcaagggcaggaattgtgtcttatctccttgtccctagatggggacgggacagagtacagtgttggcatttaggaaaagtttgtggcgcttataaaaacagtgacaatactaacaatggctaatatgcattgagctcttatggtttgccagggattctgctaag

SEQ ID NO: 14161 - DNA, 41893 bp, Human
  misc_feature (1)...(41893): n = A,T,C or G
tcagtgaaacaaacaaatggaaaaacaattgtagtaattaataaaaccatgagctggttctttgaaaagacaggtaaaattaataaacatctagctggactagtgaaaaaaggagaggacacaaattaccaaaatcagaaatgaaaggacacaacaaagaaaacaacagagtgagagaaaatatttgcaaaccatatatccaataaggggttactatcctattctaaatatgtgaagaaagcaaacaactcatagcaaaatcagatcacacgactaaaaagggggcaaagggcaccaggtgcactggtttacacctgtaatcccagtgctttggaaggctgagacaggagaattgcttgaggccaggagttgtgaaaagcctggacaacatagaaagaccttgtctctacaaaaaaattttagattagccaggtgtggtgacatatgcttgtagtcccagctacctgggaagctgaggtgggaggatcacttgagcccaggagttagaggttgcagtgagccatgattgcagcactgcagtacagtctgggcaacagcttgatagcttgagaccctgactcttaaaaaaaaaaatcatttatcaaaagatgacatacaaatgatcaacaggttcataaaaatgctcaatattggctgggcacagtggctcacacctgtaatcccagcactttgggaggctgaggtgagcagatcacctgaggttgggagttcgagaccagcctgaccaacatggagaaaccctgtctctactaaaaattccccagaggctggggaataaggggctgggggagagaatggggagatgaagatgttggtctcagggtacaaagttaacagttaaacaggaggaatacaattttgagatttattgcacagcatagtgactatagttaataataatttattgtatatttcaaaatttctaagagagtaagttgaaaatatctcgccacaaaaagaatgataagtgggctaggtgcagtggctcatacctgtaatcctagcactttgggaggctgaggcaagaggatcacttgaggcgaggagttcaagaccagcctgggcaacatagcaagaccctgtcgctacaaaaacttttttttttttttttgagacggagcctcgctctgtcgcccaggctggagtgcagtggggcgatctcggctcactgcaggctccgtcccccggggttcacgccattctcctacctcagcctcccgagtagctgggactacaggcgcccgccaccacgcccggctaattttttgtatttttagtagagacagggtttccccatgttgcccaggctggtctcgaactcctgacctcgtgatcagcccgcctcggcgtcccaaagtggtgggattacaggcctgagccaccacgcccggccccaggggacattctagaggggacttcaccccccaagccgcacttctccatttccctgcggtcgtcgctaaccgaaggcgccatccggtgacgactggatgtgcgcggcggtggtgagaggccgcgagaaccaccaggtccaccgctgcctcggcccgggcggaatctgggaaggtctctgacaaccattcatcctcagattttcccaattgtgcatgggtgggcgggccccgcatcctaatgggcactgggcatgtgaagtgtgaaccacccgggcctaactagcccctgaaggcctgacgaaaccgccaggcccaccagggggcagcagagatccgacggccgcggaccgagggaagctggcgggaagtaggaggcagagggcgcgcagggaagcggcagggcgagcggctcagaacgtaaaagccagcaccgcgcctccaggttgctttacggctgccgcagaaggctttgcggctcttttcccctccgacttgatttacggttccttctctggtctgtgtttttttttttcccctccggcgctgggcgtgggttcggaccttcttcccagagacgctcgcgcacccttcccattctcctctgcgcggcctccatctaagatctcttccccttgtccatagcctagatcgagctccctgtgtgcaccgcgcgctgcccgaggcgcgtaagtgggggaggagagcggcttcccccggggtggttctagccgtgggtgtggagcgtgggaaggctcagcttccgggtcgagaacctggggctgcggtggacctgatcctgaggtctcagcgtagagatgctgagtccagaggcctgttctagttcaccagtgcagtgaggggctcagtatccgggcctcccgagaggtgggtaggaaggcggggtacaggaaacttggcaccaacgcgccgggaccccaccgcggtgcggacagccaggtgtccgtggtggcgcttccttggagatgctgcctgcagacaggcgtggggaatctgaagtttgtgttaatagctaaacgaagttgagttgcagggagcgggggacgctgggaagaaatgattgatttaaaaggaatttgacgccgggcatggtggcggcatgcccccatgttccctggaggtcaagcctgcagtgagccgagatcgcacccgtaccacgacactccgtcccgggcgacagagcgagaccctgtcacgggggaaaaaataaaaataaaaatttgacgctcactttagctgagtattgagccttgttataacattgagatagaggtctggcgcggcgtctcacacctgtaatcccagaactttggaaggccgatgcgggaggatcgcttgaggccaggagttctacgccagcctggctaacatagcgaaaccccatctctactaaaaatacaaaactaggcaggcctggtggcgggcgcctgtaatccccgctactcgggaggcggaggcatgagaatcgcttgaacccagtaggcaggtgtgccggtaagccgacatcgcaccactgcactccagcctgggggacagagcgagaatccatccaaaaaaaaaaaagttataattcacgtacaattaaattcactccctttttttaaaaaaagtggagacatagtctcgctctgttgcccaggctggagtacagtggcgccgtctcggctcactgcaacgtccgcctcctgggttcaagcgattctttgcttcagcctctcaagtagctggaattacaggcgcataccaccacacccagctactttgtatttttcaccatgttggttaggctggtctcgaactcctcgcccttccaaagttcagggattacaggtgtgaaccaccacacccagtctaaattcacccttttaaagtgtgcaattcagtggttttaatatattcacaaggttgtgcaatcaccactattatctaattccagaacatttttatcatccctaaaagaaaccttaaaaccattagcagacacccattatttcctcctactcccagcagcactaatctatgaatttacccattctcagtactgtattatacaatagttgttcttttgtgtttggtttatttcacttcatgattcaaagtccatctatgttgtatgtagcatgtatcaacttcattttttaaataactgaattatttattgtgtggatataccacattttgtttctccatttttgatggatactggtgattttctaggctttctaggtctagtcctccacagaactcgcagtctgaggcacagacatttaaaacttaagtttttggaaactagcatttaactcttgggttgggtcaggtaattcagtggcctcaggtctggtatcgtttagggcagttttttttttgttttttttttttttgagatgaagtttcactcttgttgcccagggtggagtgcaatggcgtatctgggctcactgcaacctcacctcctgggttcaagcgcttctcctatctcagcctcctcggtaactgggcttacaggcgcatgccactatgcccggctaatttttggtatttttagtagagacagggtttcaccatgttggccatgctggtctcgaactcctgacctcaggtgatccacccacctcggcctcccaaagtgctgggattacaggtgtgagccaccgcgcctgggtgggagttttgtttttttgtttgtctgttgttttttggggggacagagtttctctcagcctcctcggtaactgggcttacaggcgcatgccactatgccgggctaatttttggtatttttagtagagacagggtttcaccgtgttggcaatgctggtctcaaactcctgacctcaggtgatccacccgcctcggcctcccaaagtgctgggattacaggtgtgagccaccacacctgggcgggagttttgtttttttgtttgtctgttgttttttggggggacagagtttcgctcttgttgcccaggctggactgcagtggcgagatcttgactcactgccacttctgcctcctggattcaagcgattctcctgcctcagcctcccgagtagctgggattacaggtgtgcaccaccacacccggctaattttgtatttttagtagagaaggggtttctccatgttggttacgctggtctcgaactccctacctcaggtgatcctcccgccttggcctcccaaagtgttgggattacaggcgtgagccactgcgcccctctgggagtgttttttaaagtgttctattctcagttcaccacttaccaggccgttaattatcgtggtatcaagcagagaaatgtttgtgtgctggtcttctcagggaggcagaaaccgtcagagattgctgttgtgtaatgtacaccaaaacgtgttatcttgtagtataaacggtgtagttgcagatgagtgtatgaaaaatgtaactgagctagctgtgggagagactagttgtgaaaaattttgagtcacccactgtatgctttcccagctatgttcaaataaggtgacactctgccttcctgtttcagctctaaaactgttcataagtgttattttggctgtatacgtagtgccatgtttttttgtatttttgtgcttttggtgattttgctgtttatagtggcctccaagaatagaagtgctgtctagcatttccaagttgaaggctgtgatatatcttatagagaaaagataagcttttagattagctttgttcaggcatcacttttgttgttggctgtgagttcatgttactgcatcaacaatatatattaaataagatatctttaaacagaagcacacataaaacaaggttatgtattggcctgttgagtaaccctgtatttcccctgggagcagtggctcagtatttgctagttcagtgttcatgatggctttacaggacataactaccctgaataatgagaactgactgtctcagtagtgcttcaagggcagaaagcctagtggatatttttccatctctgcagcttttagcatttcttcactcaaggcactcatttttaatattgaactggcagttttgatgtggagagaagctaaaataaggctaaaatgctcttcatactatgtgctgagtggggactgtgctgagtgttggggattcagtgattagtgtatggccccgcagttctctaatggctgagtgtgggagtgcagagaaatgatcagtgtgagggaattaatcctatgttcccaccgtgtttttttgttttttttgagacggagtttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctaatttttgtatctttagtagagaagaggtttcatcatgttagccgggctggtcttgaactcctgacctcaggtgatctgtctgcattggccttccaaagtgctgagattacagatgtgagccaccgtgcctggccactttttttctacttttgctaatttttttaaagtttcatgaacattatagtactgtgttcataaatgaaaataaaagaaacttgctccagtcttgttcatcaagccgttcttgaccttcacagtcagaatctcacccatcaccttgtcacatctccctcttgatctgtatatccagagtccacctgacatgcttcttcagccctccacatataataagaaatggttttgtgagccgagattgtgccattgcactgcagcttgggcaacagtgtgagactcctcaaaaaaaaaaaaaaagaaagaaaaatgcttttaggtgataaggaaatggagaagaataaaacatctttgccagtctttacctttttaatatcttgaattcatgatttcttgccatagccactatcctagtccaggctctctcccttctacccctgagttttttttttttttttttttaccatgtttttatttcctctgggaaaacacctatcagaattttgggatcatatgacagatacatatttaatttctttctttcttttttgagacagggtcttcctctgttgcccaggctggagtgtagtggtatgatcatggctcactgcagccttgaccccttcctcgcccccgctcaagtgatcctcccaccacagcttcctgagtagctgggactgccggcatgctccaccatgcccgactaacgttttgctgcttgtagagacagccatgttccctaggcttgtcttgaactcctgagcctcaagcgatccttccacttcagcctcaagtgctgggattacaggcgtgagccaccactcctggctacttaatttctttctttctttttttttgagacagtctcgttctgtcacccaggctggagtgcagtggggtgatctcttctcactgcagcctctaccttccaggctgaagcaagccttccacctcagccccctgagtagctaggactacgggaacattccaccaggcccagctaatttttgtattttttgtagagatggagtttcatgatgttggccaggctggtcttgaactcctcacctcatgcaatccgcctgcctcagcctcccaaagtgctgggattacaggtgtgagcaactgcacccagcgggccccgcccagacctattttcaaaattagaaaaccgtgaggcttctggaagaagatgagaagaatatcttcatgacctgagtgtgtgcaaaggtttcttagggctcaggatgccatagagtcacttaaaaaagcaaaaaaaacccaaaaaaaaaaccacacacacaaagataaatatgattgattacatcaaaatgtaatcacagactactctaagaaaatgaatggggaaacacagggacctatttgacaaaagactgatattcaagataaataaagaactaataggccaggcgcggtggctcacgtctgtaatcctggcactttgggaggccgaggcggggggatcacttgagctcaggagttcgagaccagcctgagcaatatagtgaaaccccatctctactaaaaatacaagaattagaattagctgggcgtgatggcacgtgcctgtagtcccagttactcgggaggctgaggctggagaattgcttcagtcaggaagatggaggttgcagtgagccgagattgtgccactgcactccagcctgggcgactgaacaagacttcgtctcaaaaaaccagtagggctccaggcctgggattgggcctctgctgctctactccctggacgtgtggctccgtccttggagtcggcctttggttttcatgaagagtagtgtgcattaacagctgagtggttttatcagcctgtttcctgccaacagtgtatgagagttccagttgctttacatccttgccagcatttggtgttgtcagtcttttgagttattctgatgggtgtggtgtgtcatggtcttaattttagtcctcagtcactaatggtgtttagcactttttcctgtgcccatgacaatgtgcatcttcctttgtgaagtgcctgctcaaatcttttgcccattttacattgggttgtgtgtctttttattattgagttgtagcagttatttatataacctttatatcctggttacctgtcctctgtctggttgcctattcattttcttagagttgtctgatgaacagaagttttacattttgatgtaatcagttttctcttatattttcttttatagttactgctttctgagtcctaggaaatcttggctaccttcaggctgtgaagataatctttcatgttttcttctgtaagttttttttttttttgagacagagtcttgctctgtcgtccaggctggagtgcggtgatggcgatctccgctcactgcaacctctgcctcccaggttcaagcgattctcctgccccagcctcccgagtagctgggattacagacatgcgccaccatgcccaactaatttttgtatttttattagagacagggtttcaccaggttggccaggttggtcttgaactcttgaccttgtgatccacccgcctcggtctcccaacatgctgggattataggcgtgagccaccgtgcccggcctataaattttatagttttagttttatgtttaagcctatcacccatttctagtttaggtgaatggtgtgagatataattaaatattaatttcttttccatatagatatccagtcattccagcaccatttgttgaaaatactattgtattgcgttttggaaattaagatgactgtacaaatggtaattgatgtctgcactcccttttctgttccattgttcaatccttgtgttagtaccacacttttaattactgtagctttttagtaagtcttgaagtcatgtagttgtaggtcttccaattttgttgttttcaagcttgatgtgaatattctaaatcctctgcatttccatataaatatcagaattatctttaccagttttacagaaaagtctggtaaagttgtgattgggattgcattgaatctatggatcaatttggaaagaaatgacacctaaacagtattgagtcttcaaatatatgaacttggtgcattttccttcttatttaagccttttaaaatttctttttaggccgggtgcagtggcttatgcctgtaatcccagcactttgggagtctgcagcgggcagatcagctgaggtcaggagttcgagaccagcctggccaacatggtgaaaccccgtctctactaaaaatacaaaaattagccaggtgtggtggcaggtgcctgtagtctcagctacttgggaggctgaggcaggagaactgcttgaacttgctcaggaggtggaggttgcagtgagctgagatagtgccattgcactccagcctgggcaacaagagcaaaactctgtctcaaaaaataataataataaaaataaaaattttgggccaggtgtggcggctcacacctgtaatcccagcaatttgggaggctgagccgggtggatcacctgaggtcaggagtttgagaccagcctgaccaacatggagaaaccctgtctctacgaaaaatacaaaatttgccaggcatggtggcgcatgcctgtaatcccagctactctggaggctgaggcaggagaatcacttgaacctgggaggcagaggttgcagtgagccgagatggtgccattgcactccagcctgggcaacaagagtgaaactctgtctcaaaaaaaaaaaattcttttagttctgttttatggttttcagttcagaagtcttatacatattttgttaaattgatttctagatatgtttcttacctttattgtaaaatggagccatcatttgcatcattcattactctgtatgtaatgtgttatcattctctacctgctttcaagattttctctttatttttgttttttagcagtttgtctgtggtgtatctaggtgtcattttatttgtatttatccggagatttattcttgagatttgcagagcttcttaaatctgtaaatttatgtctgtcggccaatttgggaaatttggagctattagttttaaaaatatttcttctgttccattctctttcacttcttctgtatgtgagttcaatttcacttcaattgtatgtgagttagacattttgatattagcccacaggatcctgaggttctttcattcttttcaatcttttttttttctcgaagtttgcatttcgtgagcaggagtgacagtcattcaggatgatttttgagattcctagttcaagagtagttcctattcttttctaggtgtagtcaagtatggcttctaattctactagaaggcttttttgtcggggaggtggttctatgtcctttggctcttacattttctttgtgtctttcacagcacagttttcagagggtaccctttctctttggttttgttttgttttgttttgttttagacggagtcttgctctgtctccaggctggagtgcagtggcgcaatcttggctcactgcaacctctgctcactgctacctctgcctcccgggttcaagcaattctcctgcctcagcttcctgagtagctgggactacaggcacgcgccaccacacccaactaatttttgtatttttagtagagactgggtttcatcatgttggcaaggctgttctccatctcttgacctcgtgatccgcccgccttggcctcccaaagtgctaggattacaggcgtgagccaccgcgcccggccaacagagggtaccctttcattctttttctccttcttcccagaaggcttgcgttttcaagactacctcatcaagttctgcatgtgtttaaaagtgtctctacccgaccttcccttcctccctcccgatttaacggaattctttgttggtgttttcatacttaccgtgagttttctttttcagggtgatattttagttccatcttaggctctccattgtcctcttctctcttctttttttttttgagacagagtctcattctgtcacccaggctggagtgcagtggtgtgatctctgctcactgcaacctctgcctcccaggttcaagtgattctcctgcctcagcctcccgaatagctgggattacaggcgcacacaaccacgcccacctaatttttgtattttcagtagagacggggtttcaccatcttggccaggctggtctcaaactcctgacctcgtgatccgcctgcctcagcttcccagagtgctgggattacaggcatgagccaccgcgcccggtgcgcccagccctcttctctcttctttgcatctctcttcctatctggatccctctttgctgtccttaaagagctgagatgagagattgagaaacatctctacaagaaattgatgtttttctacttatgggtaattagaagcttgtagtattttcagtcttctaagtatgttgaagatatgagacgttggtgattttctttgtttctccggttggttggtctgtgtagtttttggacatgtgtttggatatttggatttatatagctgccataatcttggctatgcaggtagtctttcctgacacttcatcctgaaagatttgaagcctttggacaaattttacagtgggctgggtgcagtggctcacgtctgtaatcccagtgctttgggaggctgggcaggaagattgcttgagcccaggagtttgagaccagcctggacaacatagtgagacccgtgtctctacaaaaaataaaaaatatgccgtgtgtggcgttatacaactgtagtcccagctacttaggaggctgaggtgggaagatcacgagccaaggagtttgagggtacggtgagccatgatcgcctcactgcactgggtggcacagcgagactgtctcaaaaaaaaaatttacaattaatgtctgcatatccttcacctaggttcataaatttgtacttttgctttatctacttgcctttttctctctctctacacacacacacacacacacacacacacacacaattagttgaatgaattgagagtaagttgcagaaaacatgacactttactccaatattgcatcatacaaaatcatacatctagtgataggccattgtcctacagaatcacgatataattatcacactaaccagctgtggtggtgcacacctgtagtctaagctactcgggaggctgaggcagaaggatcacctgagcccaggaggttgtggctgcagtctcatattcatcccatcatcagatttctcccattgtcctaataatattctttatagcttttctttatccctgatccgaaatttcattgaagatcacacagtgcatttagttgtcatgcctcttaagtctttatttatttattatttattttttgagatggagtcttgctctgttacccaaactggagtgcagtggcatgatcttggctcatgcaacctccacccgctgggttcaagtgattatcctgcttcagcctcccgtgttgctgggactacaggtgtgtgccaccatgcccagctactttttatatttttagtagagacgggaattgtaccatgttggccaggctggtcttgaactcctgagctcagatgatccacccgccttggcctcccaaagtgctgggattacaggcgtgggccaccacacccagccttaagcctcttttaacataaaagagttcaccagccattctattttgttttgctttttgagacactgatgctttggagagtccaggccagttgctttgtagatttcaacttgtttgattgtttcctgatgattaggttggtagaaatactacctcaatgatgggaccttcttagtgcgtccatcaggaagcacatgatgtgactgtaattggtgacattaagtttgattccttaataattaaggtggtaactcccaggtttctacattgtaaaggcatcttttgccgccctcctttttattcccaagtagtttatttggagattagtcctttacacagtagaggagcggggaagggagacaggaaaggaaagtttgacaacaaagggtgagttttcaagcctgttgccacgggggaacctaattccactggagaagctcatggcttggtgatgttccacagaggggtcagaaatttagcgtatttcaacaccagctcctgtcaggcaccatttgagggctgctgccagggtggttcaattttctggtgcttacagcttgccataaacaggtgcaaagtagtctggataccaaagaaagctctcaggtaacaagatgcagatgttggcatttggaagtcagaatagggtgcactattgtggtaagagctgaagggatggctgggcgcggtggctcacacctgtagtcccagcactttgggaggatgaggcaggcggatcacctgaggtcagaagttcgagagcagcctggccaacatgacgaaaccccgtctctactaaaaatacaaaaattagccaggcgtggtggtggatgcctgtaatcccagctattcagtaggctgaggcaggagaattgcttgaatctgggaggtgtaggttgcagtgagctgagatcacaccactctgcactccagcctgggtgacagagcgagactccgtctcagaaaaaaaaaaaagctgaagggatgctgagtagagcatccgtagtgtctgctatacctgggtaccctagaacctggagaacctacagcttgaggcaagagcgtatgtgctattattttttcaagaagtgtgctctcaggaagcagaggtaggggaaaggtgagtgaagggagaaggaagattaagtcagttcaagggtgcattttgaagttggttgcccttggtgcaagtacagttggttgcttgttctcctaaagctgtctcccaggaggatgtatacataactgcattccagggcaatccatctaaaggaagggtggacggacccctcagcttctgtatctcactggaaaaaggtttgcttcatggcacattaattcccatagacttctaggttgtacatgtgtgggtaccaggtgggtcccacagacccttacacctccaaggcaagcggcaagccacgggtgggaagtgataggtacccagtatgagcaggaggtaagggaccgtggggttgtgcctgtgggcagttggttataacccagacgtgtttgatcagcccagtgacagctggagtggacaaagtgaccaagggcctcaaggacacacaaggccaagaagatttgaagtgctgtgtaagatatgcctaatgcatttggattctacctttgtttaacgaatatgcacacataaaaaacacttgaactccttgagcccaggagttcaagaccaacctgggcaacatagtgagacactcatctctaaaaaaatttaaaaaaaaattaacctggcatgatagcactcacctgtagtcctgtctactctggaggccgcagtgggaggatcacctgagccctggaggtcaaggttacagtatgctatgattgcaccactgcattccagcctgggtaacagagcaagacgctgtctcttaaatttttttttttttttttttttacttttataatggaaaaaccattgtagacagttttaggaaggaaagcagaatagtaagacatctttttcaaagtaaaagagcaaaaaaggcaaaaaatatttcacatttactttatggacaaagataagattgtccttcaataaaagactgaattttttttgtttgttttgttttgttttttgagaaagagtcttgctccattgcccaggctggaatgcagtggtgtggtctcggctcactgcaacctccgcctcccgggtacaagcaattctccagcctcagccccccgagtagctgggactacaggcacgcgccactgcatctggctaagttttgtatttttagtagagatggggtttcaccatgttgaccaggctcgtcttgaactcctgacctcaggttatccacctgcctgggcctcccaaagtgctgggattacaagtgtgagccaccgtgcccggccacaagttgctctttaaatgtgagaagtgttctggcatggtggctcacacctgaggcgggtggatcacttgaggtcaggagttcgagatcaggctggccaacatggtgaaaccccgtctctagttatttatttatttatttatttatttatttatttatttttttgagacggagtttcactcttgtttcccaggcgggagtgcaatggcgcaatctcggctcactgcaacctccgccttccgggttcaagcgattctcttgcctcagcctcctgagtagctgggattacaggcatgcaccaccacacccggctaattttgtatttttagtagagacggggtttttccatgttggtcaggctggtctcgaattcctgacctcaggtgatctgccctcctcagcctcccgaagtgctgggattacaggtgtgagccaccacgcccggccctgtctctactaaaaatgcaaaatttagccgggcatggtggcgcacacctgtaatctcagctactcaggagactgaagcagcagattcgcttgaacccaggaggtgaaggttgcagtgagctgagaccacaccactgcagggcagcctaggcgacaagagcgaaacgcttacaaaaaaaaaaaaaaaaaaagattcacaggtgatggtgatgctgctggttaaggaagtgaagtggctttttgctctgtagccttcctgaatgttggggcctcctgctcttcatttgtttcatttctattaagtctcctccctccagctatcttgttagctcctggaaagcatttcagtgattgtggcttctatttctttttgaccccacagtgtccagggtcatgctgcctatatagtagtgagcagtaagttgaggtttttaaaaactttattattattatttttgagatggagtcttgttctgtcacccaggctggagtgcagtggcacaatctcagttcactgcaacctctgcctcccaagttcaagtgattctcctgcctcagcctcccgagtagctgggactacaggcgcctgccaccacatccggctaatttttttgtatttttagtacagatggggtttcactatgttggtcaggctgatctcgaactcctgacctcaggtgatccgcctgctttggcctcccaaagtgttagggttataggtgtgagccaccacacctggccggtttttttaaactttaaaacagattcacttgatttttcttccctaccccccagcttttttgaggtatgactgacaaaaattgtatatatttagggtgtacaatgtgatgatttgatatgtgaatgcactgtgaaatgattaccacagtcaaggtaattcacgtatccaccacctcccagttaccctcttagctagtacaggttgggtattgcttctctgaaatgctttgggaccagaagtgttttggacttcagattttggaatatttgaatatatataatcagatatcttgggaaggggacccaagtctaaacatgaaattcatttgttttcagagcctaaagatgattttttttttttttttgagatggagtctcactctgtcgcccaggctggagtgccgtggcacaatctcagctcactgcaacctctgcctcccaggttcaagcgattctcctacctcagcctcccgagtagctggaattacaggctcgcactaccacacccggctaatttttgtatttttataaagacatttcaccatgttggccaggctggtctcgaactcctgacctcaggtgatccgcccgcctcagcctcccaaagtgctgggattataggtgtcagtgactgcgtctggctgataattgaatttttctcttggagaagctgaataaactgtgtgttgtgtgcctgcctttttttttgtttttttttttttttgagacagagtcagacactctgtcacccaggctggagtgcgatggggtggtcatagctcactgcagcctcaaactcctgagctcaagcgatcctcccacatcagcctcctaagtagcatagcaccacgcctggctaatttttaaattttttgtagtgatggggttttgttgtctaggctagtctcaaactcctgggctcaagcagtccttctgccttggcctcccaaggtggtaggattataggtttgagccaccatgcctggccattacctgtgttttgactataacacatcatgttggcactcaaaacgttttggattttggagcattttgaattttggatttttggattagcaatgttccacctatagtacattttttgtttgctttcccataaagaattttttgtaattttgattttatagttctaaatgtaatatattcttattgtaaaaatcacctttaatagcaccgccagaatagcaaacatgttaacagaaaggtagaagtagaccttaaagaatcttcagcagcttgagagaccacagctaaccactgaggaactctgttctggattggagcagtgcttagaagcttataaataactcttagggtattgcatagggattcttttttttttttttttcctgaaatggagtctcgctctgtcgcccaggctggagtgcagggtgtgatctcagatcactgcaacctccgcctcctgggttcaagcaattctttgcctcagcctcccgagtagctgggattacaggcgcctgccaccatgcccagctaatttttttggatttttagtagagagggggtttcaccatgttagccaggatggtctccatctcctgaccttgtgatccacccacctcggcctcccaaagtgctgggattacaggcatgagccactgtgcctggccgcataaggattctttatgtgatttttcagtagaggctcttgccttttactttaaacattctttgagggttgttttttttttccgctttttatttatatagaggtcaaccagaatcaagatgtctgggactgaggaagcaattcttggaggacgtgacagccatcctgctgctggcggcggctcagtgttatgctttggacaggtaactgtggttccttcatgccgggaaagaatgaggtgaagtgagtaaagttagggcaaggcagtttgtagagcatcgtagtacatgtgtgagcagtacctagtacgtttacctagtacgtgtgtgagcagtacctagtacgttgacgcggtgcgtgcgggggcagtacctagtacgtttacatagtacatgtgtgagctatttgttattggtttttcctttagatgcattttttgggagtcttgtgaactctggagggcattttggaatgttagctatcaaaagactgatagtactggggattagatttagattttaaattttttgtggggggggatagataacatatttgtatgacatcaaattcaaaatgaaactgtgaaaatctccctatttcctattgcccctgtgtgcatgccacccagttctatttcttttttttttcgagactgagtcttgctttgtcacccaggctgcagtgcagtggtgcgatctcagctcactgcaacttccaccctctggattcaagcaattctcctgcctcagcctcccaagtagctgggataacaggcatgcaccaccatggccagctaatttttatatttttagtagagatggggtttaaccatgttggccaggctggtctcgaactcctgacctcaggtgatccgcctgcctcggcctcccaaagtgtttggattacaggcgtgagccaccacgcccgggcttaatttttttgtatttttagtagagatgtggtttcaccatgttggccagggtagtcttgaactcctgacctcgtgatctgcctgcctcggcctcctaaatgctggaattacaggcatgagccaccgcgcctggctccagttgtctttcttggaggcatggaaagttactgggggtcctattccttgtagggacattgtgtgcacagaaaagagtttcttgctttgtccacccaaactccatctttgtctttagcagagagttgtgagtattcatctcatccgagcagggcaagggggacaaaacccaaatcagcaagcagtagtgtgtttctgtttgtgcaggatgggaaattgttgtattggagaaggcgtcaatctctggaaaggacaaatggaagcaaggcttcctacccccgtgctctttccgtacttgcttcctgtgctgacgtcatttacagatctggaggcagaacattttagcttcctaagcttcagaaacatttataaggatggtagcagcagctaaggcagcagttctcaaaatgcagttctcaaaaaccctggggtttctgaagatctttcagagtccagaaggtcaaaattatcttcataataatactatttgcctctttcacactcattgtctcatgagtgaatggtagagttttcagagagtgcatgatatgtggtgatgtcactgctatgatgcctaatggcatgcatgccttaaaagtttctcagttttgattcctaataggatacatagaacccacataaacaaaggttctggggggtctttttaagagtataaagtctccataaaggatggagactcaatgatgtgaggaatggtggaagtgtgaatttaattttcttttttggggttgcagtgccagtacacagcagaagagtaccaggccatccagaaggccctgaggcagaggctgggcccagaatacataagtagccgcatggctggcggaggccagaaggtaggagaattcgtgtgcctggaaagcaggcatccataccgcagactccgatggtcttgccagttccctctctgggtcctcagggattcggaagtctgctgttaactgttcctggaggtctcccagtgcccctgggaggggatgggttccagacttcattctcatccgaaggggcctgggcatggtcttgacactcgcataaccgccgtcttaagatttttacatcatctttttttttttttatttttaaagacagggtcttgctctgtcacctaggctggagtccgaccagtggtgtcatctcagctcactgcagcctccacctcccaggctcaagcgatcctcctgcctcagcttcctgactagctgggactacaggcacacgccaccacacctggttaattttttaatgttctgtagagacgacatctcgccatgttgcccaggctgatctcgaactgctgggctcaagtgatcctcccacctcggcctcccaaagtgctgggattacaggtgtgggccaccatgcccagcctttacaccattaaaaaaaaaatgttccttttgccatttgctttttttttttaattaaacactttttaaagaacttatgattgacacataataattgcatatcatttgcttctaattttaacttctgtgtatatttttggtcttccataaaatatgtcaaacagatttgtactttttgcaaactgaattttagcaactgctgggtgagttcctcctcccaacagaccattcgttctcgcgggctccatctagaagatttttgaaataaattcattgagaattttcttgaaaaaaaaattttttttaacagactggttctcactctgtcacttaggctggagtgcagtggcacgatcctagcttactgcagccttgagctcctgggctcaagtgatcctcccacctcagcctcccgagaagaatgtttaaggacagtttatcgaaaaaagtagatgaggaataaattatgtcaattttgattcacatttaagtgtggtaaggaattaacacagcttttccttaaaaacatttgtttttctaggtgtgctacattgagggtcatcgggtaattaatctggccaatgagatgtttggttacaatggctgggcacactccatcacgcagcagaatgtgggtgagtatgctctccagcagtggggacttctgcactgtccagctcctgctgaaagtctgctgtgggtgaggaggtaaggtaggtggactcagctgccagcaggaggaatggttgtggcccagcggtcagtgtcctcttcaacttgctctctttcccactcctagattttgttgacctcaacaatggcaagttctacgtgggagtctgtgcatttgtgagggtccagctgaaggtgaggggatggagtagacctgctgcccggaaggatcagtgggtggtaggagaaggtgagcaggtagggaagtaggtagctggacggggacccaggctccagagttgtgtctcagccagcgttccctagagtggtggaattcaaatactcttgctcatgtgctccctaaaagaatggaaaaactgttctcttgcacatgttcaagctgacacctaaaagttttcaccatatataaaaattgttgcaaaggatgtattttttggcatatggtaaaatctgacattttaaaatacaataattttaccatcactgataagtgtttggaaactcaactttaggcaaagcaggtccttttgttataacattgatgaaaacaaaaatatgttttgttaataagttgtttcacttcaagtcacagttatttaaggtgttaagtgagcacttaccgtaaatctgttgaatcttgttaaatattccagtggactctaaatactatagaggataagatctatcatttatttgaagaaatacaatgaacaagcttttttttaatcattagaaattttacattgttctttctttatctgaactcatatttctattctatttccccactggttttaatcctaatacatatttatggttgaaagtttggctaggcggggtggctcattcgtgtaaccccagcactttgggaggcccaggtggaaggactgcttgagcccagggatttgagaccagcctgggcaacatagcgaaagcccgtctctactaaaaatacaaaaaattagctgggcatggtggtgtatgcttgtagtcctagctactcaagaggctgaggtgggaggatcacctgagcccaggaagtcgaggctgtggtgagctgtgattgcgccactgaactcctgggtggaaaaaaagaaaagttttatcggtagccttactgtgcttctctgcctttgcctgtgtataaaaataaaaatttttggtaaattttcagtgcacttaaggctctaaatattaaaatatttcttttggatttagttatattatagctactgttaacacacaattgaccagacaattgtgtttatggtgaagagaaaacataaatacagcaaaattttgatacttagaaaaattaaagatatgaaatcttgccacaaaaataaaaaatttaaaatataaaatttatggaaaatgtatatcttaatgagatggatggtgctgttttttcttttcagttagtttatatatccatatatccataactgaatattacttacttcttttttttttttgagatggagttttgctcttgttgcccaggctggagggcaatggttcaatctcagctcaccgcaacctccacctcctgggttcaagcgattctcctgcctcagcctcccaagtagctgggattacaggcatgcgccaccccgcccgcctaattttttgtgtgtgttttcagtagagacgcggtttctccatgttggtcaggctggtctggaactcacaacctcaggtgatccacccgccttggcctccaaaagtgctgggattacaggcgtgagccaccgcacccggcctacttatttcttgaatgaacaattcagcattaattctattctgacttatttttctaaatagtactaaaaaatcttgtatctatgagtgagtagctgagaatggaaagaattgtgttatagtgtcactcatttatttgagtgctttctgagttattttttaaaaatcacagagcgctgtcatcaaacattgtatttaattctcaatcagcgaatgatgtgctcaggtccaccttctcttttggtgagaggcaggagctggacgccacctgatttacaaagggtttgctctcccgtccttacagaccattagatccagtgttcaaatcatccctttgtttcatatcccagaggtttttttttttccaagacgtagtctcactctatcacccaggctggagtgcagtggtgcaatctcggctcactgcaacctctgcctcccaggttcaagtgattctcctgcctcagtctcctgagtagctgggattacaggtgcccaccaccacacccggctaatttttgtatttttagtagagatagggtttcaccatgttgaccaggctggtcttgaactcctgacctcaagtgatccacctcccttgacctcccaaagggctgggattacagcgtgagccaccacgcccggcccggccatcccagaggttttttttaccttagggtgatgcacactgataggatttggggtgagtttctaatgtgccctttgtgtgttgggaagttgggaagggaggatcgtcttgacaccttgaccacaggcacatgtccaggcagcccaggtctaggaagcagcactcgcgatggattctcacccagccttctgcccgtgcccctgtagcaaggccgccaggtgggagagtccggctttgaaccctgctgcttgaggaacaggggagttgtggcacgcctgccgctctcgtgtttgagttcaaactccttttctgcccccaggatggttcatatcatgaagatgttggttatggtgttagtgagggcctcaagtccaaggctttatctttggagaaggcaaggaaggaggcggtgacagacgggctgaagcgagccctcaggtgagcgcggggctgggagtctaacctgcgtcatttcagctcttgcttcagagcagatttcgattttttttggaagaggtaacacatccacatggttcaaaaatccaagcagcgtggaaggtaattctcacccctgccctggttcctgtctgccgttttcccactttcgttagtattttttcaatgtttctgtttcaggcttcccttgctgggagtaagtggtagaatcctgtactctctcttctccgtgcactcagtcatgtgtgccggaggccttcccactcctactgcgagtgcacagacagcaccctcctctccgtgctcctcagcagtcctccgctacgcacaggtagcatagttaacttagttacacagtcacgcagatgtccgtgttagtccatttatgttgctatacaggaataccagaggctgggtaatttataaataaaggaggtttgattggcttatgattctgtggactgtactggaagcctggtgccagcatccacttctgctgaggcctcaggaagcttctaatcatggcagaaggtgaagagggaacgtggagagagagggagcaagagagagaaggaaggagtcccaggcttatttatttattttattgttgtttttcattttttgagacagggtcttgctctgttgcacaggctggggtgcagtggtgccgtcatcgctcagtgcagccttgaactcctgggctgaagtgatcttcccgcctcagcctcccgagtagctgggatcacaggcacatgacaccacccccagttaattaaaaaaaaatttttttttttttggagagacagggtctccctttgttgcctaggctggtctcaaactcctgggctcaagtcatcctcctgccttgtgcctcccaaagtgccgggatcacaggcatgagccatcatgcccagcccccacactcaaaaccaccagatctctcatgagctgagtgagaactcactcaacaccaaggggatggcactaagctgtttatgaggaatccagccccaggatccagtacctcccaccaggccgcaccccccggcattggaggtcacgtttcaacatgaaatttggaggggataaacatccaaaccatatccgtgtctttgagaattgaagtgaattgaaccagaaaaacctatgagttctgtgggggagtccgtagatcccaagttaagaactctggtcatgggaggttgtgcccttgagcccccggtccccaagtgtgtgttgcctactcctgctgggaaattggagcagcctttggggggaaaaaaaagaaaaactctctgcagtttgttctccatgtcaggaggtggctggtgggttttgtgaatggcgccgtaatcttttcatactcatcttctctgtgagggcagggacttgtgtcttgtcctcactgcagtattctcagaaactaacacagtgcaggaacatgctagatgcttaccagacatcaatggggaatgcatgttagggtccacttcctctgctgctcctgagaagcaacctgtacaaaagttgtaattctattctctgatattcatgtgtaacaattcttaaccctgtttcacctttttttctcttgcccttaggagttttgggaatgcacttggaaactgtattctggacaaagactacctgagatcactaaataagcttccacgccaggtatatcagacatggatgagtggagtgaagataatgcggcaaactcttgtgtgtcatgggttgagtatttggaggatgcaaggagaaaaagtgaggactcagctctttagagggtcgggaatgttgatttcagatttcgaatgttagagacagcaggaactaatcccaacattttccttttttctaaagtacatcatgtgggccggggaccgtggctcacgcctggaatcccagcactttgggaggtggaggcaggtggatcacaaggtcaggagatcgagaccatcctggctaacacggtgaaaccccgtctctactaaaaatacaaaaaattagccgggcgaggtggtgggcgcctgtagtcccagctactcgggaggctgaggcaggagaatggcgtgaacccgggaggcagagcttgcagtgagccgagatggcaccactgcactccaacctgggcgacagagccagactccgtctccaaaaaaaaaaaaaaaaaaatcacaccatttgacaagaatgtgaggtctagagaatttgtgtacgtgtaggtagtgaactgtggttgggggtagtctgtgaagcctcaaagcaagcacacagccctctgcagcaccactgtccttcccagacactcccagcctcgctgttgagccttctttcttttccttagttctggtgtcattacatgtctgatgtcattacaatgtcatttacatgtccattatttctgtcaatacctataacgtgatctgagcctttgcctttggagaatggggtctgtggtggggcagccctggagtcacactgccttgccatgagtggcttctggagtgttcctcctgcctcatctgctctccgaggtccctgccatgtcgctccccagggcagcattcccatcctgtgcctgagggattcttgtcctcatggagccccacaaggtgtgtgtcactgggcatctgtaaaaactcctttaaaaaaatcatttttaaacattattggattcagtttgctaatattttgttagacttttttttttgagacggagtctcgctctgtcgcccaggctgaagtgcagtggtgtgatcttggctcactgcaacctctgcctcctgggttccagcgatgctcctgcctcagcctcctgagtagctgggattacaggtgtgtaccaccacgcctggctaatttttgtatttttttagtagagacggggtttcaccatcttggtcaggctggtctcgaattcctgacctcatgattcgcctgcctcggcctcccaaagtgctgagattacaggcgtgagcccccgcgcccggcctttgttaggcatttttgcatctatgtttatgagagatattagtcaagttttctttttctttttttttttttgagatagtctcactctgtcgcccaggctggagtgcagtagtgtgatctcagctcactgcaacctctgcctcccgggttcatgccattctcctgcctcagcctcccaagtcgctgggactacaggtgccagccaccaccatgcccagctaatttttttatttttagtagatggggtttcgtcctgttggccaggctggtcttgaactcctgacctcaagtaatccgcctgcctcggcctccgaaagttttgggatgacaggcgtgagccaccgcacccggccttttctttttttaaattgtagtaaaacacatcacattttaactatttttagtgtgtggtcgagtagtgttaagtgtattcccattgttgtgaaattgatctgcagaactaagaccctgcacccgtaaaacaagaactccgcatttccccctttcccagacccttgtaactacttccactttctttcctttttttttttttttaatttattttatgaaagatgaggtcttgctctgtcagccaggctggaatgcaggagtgccatcataattcactgcatccttgcactcctgggcccaagggatcctcctggatcctcctgcctcagcctctcaggtggctgggactacaggtatgtgccagtgcacctagctaatttattttttaaacaattattactattttttttgtagagacagaatttctcagggctggtcatgaactgctgggctcatgtgatcctcctgcctcggcctcccaaagcgctgggattgcagcgtgggccactgtacctggagccagctaattaactttttttgggggcttttttttttaagaggtgagttcttgctatgttgctgaggctggtcttgatctttttttcttttttaaaaaattaggttaggcgctgtggctcctgcctataatcctagcactttgggaggccgaggtggttagatcacttgagcctaggagtttgagaccaccctggccaacatggtgaaaccctgtctctactaaaaaatacaaaaatcagctgggcatggtggtcagcctgcctgtaatcccggtggtcagcctgcctgtaatcccagctcttctggaggctgaggcatgagaatcgcttgaacctgggaggtggaggctgcagtgagccaagattgcactactgcactccagcctgggagacagagtgagattctgtctcaaaataataataataaaatataaaaataaaatacttttttgtgtgtggtcatggagttttgctattgcccaggctagtctcaaactcctggctacaagcgatcctcccactcagcctccttaagtgctgagattataggtatatgtgtctactttctgtttctgtgaatttgtctactctggatacctcatataaatggaatcacataatttttgctttttgtgactggcttatttcacttagctagcattaatgcctttaagattcatccatgtagtagtgtgtatcagaattcccttctttttgtggctgaatattctgttgtatatatagaccacattttgtttatgcattcatttggtgatggggatttgggttgctttcaacctcttggctattgtgaataatgctgctatgaacgagggtgtgtaactctctttgagatcttgctttcaattcttttagacatattctgaaggggattgctgggtcatggtaatcctatttttaatttttcgaggagctgccacactgattttcatacagttgccccattttaccattccaccaacagggcacatgagttcagatttttctaaatcctaaccagcacttgttattttctgagtttttggttttttttttttttttttttttttaagccaacctaatgggcgtgatattttattggggttatgatttgcataccccctgatgattagtgatgttgaccatattttcttttttgagacagaatctcactctgttacccaggctggagtgcagtggcacaatcttggttcactgcaacctctgcctctgggttcaaacaattctcctgtctcagcctcccaagtagctgggactataggcgcctgccaccatgccgggctaatttttgtatttttagtagagatggggtttcaccatgttggtcaggctggtctcgaactcctgacctcaggtgatccgcccgccttggcctcccaaagtgatgggattacaggtgtgagcccccgcacccagccaaccatattttcatatgcttgttggccatctgtttatcgtctttggagagatgtctattcaagtcctttgtcattttattttgttttattattttaatttaatttcttttattcatctcatctcatctcatctcatgacaagatctcgccctgtcacccaggctggaatgcagtggtctgatcatggcttggctccctggagcctcgacatcctgggcttgagtgatcctcccacgcaggctggagggcagtcgtgtgatctcggctcactgcagcctctatatcccagactcaaatgatcctcctgccttagcctcccaagtagctgggactacaggcatttgccaccatgccaggctaatttttttattttttgtacagaatacaaaaaattttaccgtgttgcccaggctggtctcaaactcctggcctcaagtgatccacctgccttggcctcccaaaatgctgggataacaggcgtgagaaacccatatggcccaactcctacttttattgagctttttcgtattgtttttgtattctctctttcacttatgtttgctgtcatctttttagaatttcctttcttctagctttgggtgtaactttttttttctagttctttgaggtatagcgtagatttgagatcttttttttttaactatgtgtgtaacttccctcttacgacttctttccctgcaccccagaagtttggtaggttgtgttgtagtatcatttgtctctgggaattcttctaagttggcttgttacatttcctttgactttaagagtgtggtgtttaatttctactgatttgtggattttccagttttctttttgctgttgatttctagtttcattccattgtgattgaaaagatactttatatgatttcaatcttgaatttgttaggacttgttttgtggcctaacatgtagtctgtcttggagaatgttccatgtgtacttgagaagaatgtattttctgctattggtgggtggaatgttatgtatatgactgttaggtccagttggcctatagtattgttcaaatactctatcgccttattcatcttttgtttggttgttttatctattattgaaagttgagtagtgaagtctcctactattattgtgttgcttttatttcaccttacaatcctctcaaagtttgcttcatatatttaggacctctggtgtttggtgcataaatatttataattgttatatcttcttggtgaattgacattcttttttttttttttgagacggagtctcactctgtcgcccaggctggagtgcagtggcggtgcgatctcagctcactgcaggctctgcctcctgggttcacaccattctcctgcctcagcctcctgagtagctgggactacaggcgcccgccacctacgcccggctaattttttgtatttttagtagagacggggtttcaccatgttagccaggatggtctcgatatcctgacctcgtgatctgcccacctcggcctcccaaaatgctgggattataggtgtgagccactgcacctggctgacattcttatcattatataatactctcgtctcctataacaattttttttttttttttgagacggagtcttgctctgccgcccaggctagagtgcagtggtgcgatcttggctcactgcatcctttgcctcctgggttcaagcagttctcctgcctcagcctcctgagtagctggaactacaggtgcgtgctaccatgcccggctaattttttttttttttgagacagagtttttgctcttgttgcccaggctggggtgcaattgtgtgatctcggctcactgccatctctgcctcccaggttcaggcaattcttctacctcagcctcccaactagctaggactacaggtgtgtgccaccacacccagctaattttttgtattttgtagagagggggtttcaccatgttggtcaggctgatcttggactcttaacctcagatgatccgcccacctcggcctcccaaggtgttgggattacaggcgtgagccaccacgctgagcccagatttttttttttttttttagacagagtcttgctctgtcgcccaggctggagtgcagtggcgctatcttggctcactgcaacctccgcctcccgggttcaagcgattctcgtgcctcagcctcctgagtagctgggactacaggcgcccaccaccacacccaactaatgtttcgtattttttagtagagcggggttttgctgtgttggccaggctggtctcaaactcctgggctcaagtgatcaatccacctgccttggcctcccaaagttctgggattacaggtgtgagccactgagcctggccccaaatttctctttttttgttgttgagacggaatttcactcttgtcaccgaggctggagtgcaatgttgtgatcactgcaacctctgcctcgtgggttcaagcgattctccagcctcagcctcccaagtaactgggattacaggcgcccgccaccatgcccggctaatttttatacttttagtagaaatggggtttcgccatgttggccagggtgatctcaaactcctgacctcaagtgatccacctgcctcagcctcccaacgtgttgggattacaggcatgagccaccatttcctaagtgagcacagctgtttacctcccagatagagaatcagacctttaccagcagcccagaagccccattttgccctcttccagtcactgccttgctttccttttttcaaaagtaactactatcctgtcttctattctgacttccatggattattttttcctgtttttgaactttatatatgtaaagttcacaaatggaattgtactgtaagtggaattgtacagttcatattttaagaaaattgaccgaagtatgaaaaagaacatatagacaggttagacgagtgcacgtatcatccatgctcagcttgatgaattttccaaccaaacacatccacacagccaacatctgaatcaagacactgccagtaccgagaaggcccagctgtgttccttgcagtcactgccatcccctgccctccttcccactctgagcaaaccgcttttaacaacacagattggccgggtgtggtggctcactcctgtaatcccaccacttgagaggccaaggaagaaggattgcttgagcccaagagttggagaccagccaggacaacatagtgggaccctgtctgtacgaaataaaaataaaaataaaaataaaaattagctgggcctggtggtggcgcctgtagtcccagctgcttgggaggctgggctgggagaatcatttgagcctaggaggcccaggctgcagtgagctgtgattacgccactgcactccagcctgggccacagagcgagaccctctctcaaaaaacaaaacaaaaaacaaagaaagccaccaatttgtttttattgttatgtacttttttggaatcctacagtttgaactctttgtatcttacttgaattcagcatggttgtgagattcattcatggtacgagcagcagtttcattgctgtataattttcttttgcatgagtatgtggcaatttatttttctagtcttttcttagtagacattttggtttttgtagcttgtggctgtttcgattagagatgctgttagcattcttttgctgtacagttgcactcatttttgttgggaattattgggggagaagataggtacgtgtttagttttagtaggttcttcccgttttcctgtatggttgtattaattcacaccccacgtggcattgcgtaagttccaattgttctgtatctttgacagcacttggtatcgccagtctttcatatttttcaaagctcgtttcttttttttgagacacagtcttgctctgtcgcccaggctggagtgcggtggtgcgatctccgcccactgcaacctctgcctcccaggtttaagtgattctcctgcctcagcctcccgagtagctgggattgttggtgtgtgccaccatgcccagctaattttttttttttttttttgtatttttagtagagacaggctgttactcaggagttccttcgattttttttttttgtatttttgtatttttgccattttggccaggctggtcttgaacccctggactcaagtgatctgcttcggcttgccaaagtgctgggattacaggcatgagccaacgtgcctggccaaagctcatttctttttaaactactcatttatctttcaatgtagacatgaaatctgcactataattttcattttcaggtcaaaatgtaatcatcttaatccctcatattcaaacaattattccatcagcatcagttttatgaattgagagatgttttcccaagtaaaaatgttctggatttctgtaggaatccgtgtggaaatgaaaccatttgccctgtgccacgcagcacaggactgtcccttctcatgttgatgagatgcagagcagccccgttctggaagattccttgcagccttggctggcagccggcgtccgtgcctcccaagggttcttccctctgtcgtttgaagggttcttcgtgatgccacagcgtgcccgaggctccctcagtgacgagcgcgatttgcaggggtggccctggcagaaagggttgggaaggtacagacctccacagagactgtgtgtgctcatttccgtggaaaaaggacaaggaggcagcaaagacagacccagcagcccaggaaagattcaaatgcgattttacagaacatctgccctaagtcaaaaccaaagaaggattcctttttatcaaaacttcactaacacagaacatgaaattgtttggctcctcctgctcatggagttacaggacctagaaggcgtgatggatggaggatgtcaaatgcgattttccaggaatcgcaatctgtgagtcagggagaagcagcggagggcaagagccagttgaaggaatttgtttttcttctttccttctagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccggtatgcggcctaagtcccctcctttcctctgcggcccctcctgtgtcacggggctgcctccactcaggcctccagagccagccagccgtgcgtgtcctcccagcagccgcggctgttgctcaggagcccgtcctcgccgccgccctctcatgcagaagcctgagctcatccgccgtggagagcgaggccacgcaccagcggaagctccggcagaagcagctgcagcagcagttccgggagcggatggagaagcagcaggttcgagtctccacgccgtcagctgagaagagtgagggtgagcgaggggtgggagcagggccctgggaggcgtctgcaggaggaagtgtagccgcagggtcttctgattctctgcggtaaccctgggccggctccaaaccaggcctcgctgggacttctctcaagctacacgcaggagagatgagcccaggaaattcagatatttaaatctgctatacattttcccgtttctaaagacaatgatttcttttttcccccgtggaactaagtgggccttgataaaatcttctagaattagaaatttcagggtaaagaacttttttttgcttcgaatgctttggccatctctacattagaaagccttggccgggcacggtggctcatgtccgtaatcccagcactttgggaggccaaggtgggcggatcacgtgaggtcaggagtttgagaccagcctggccatcatggcgaaaccccgtctctattaaaaatacataaaaattagccaggtgtggtggtgcatgcctgtggtcccccctactcgggaggctgaggcagaattgcttgaatccagaaggcagaggttgcagtgaaccaagatcgtgccactgcactccagcctgggcaacagagtgagaccctgtctcaaaacaaaaacaaaacaaaaaaaaaacaagccttgtgtttctgagatatcttcgaatacaaggcaaaattgggattgagaataacgggaacttttggcagattatttatcaactttagtttatttcagagtccagattgagtgggaatagtgatacagatgccttctttctttcttctctgtctccccacctgttctctcctgcccatccagcggtaggtagtccttactcagagagtggaaacagagaaagggcttgtctcagacccatcgagcttttgcccagtttttccctacaaattgtgaagcagattcacagaggacttgcttcatggttggttcattcatatgcccctcagcaccgacaggctgaaattaacataaaaaccaaaacagaaccacttcctgtcctgtggatatccttactgttgagttattgcaggtgtttagcttcttaaccattgcagaagctcccgggtagattgtggaggaagctgccctccaggcctttcctgccccttggcagacaacccgagccattgttattttaatccatttcacacatcagattttggctgaagattttgtttgttggtttgttttcagacagggtcttgctctgtcacccagcctggagtgcagtggcgggatcagggttcactgcagctttgaccttcctgagctcaagtgatcctccttcctcagcctcctgagtggctgggactacaagtgcatgctaccacacccgctgatattttattttttgtagaggtggcgtctcgaattcctggtttcaagcgatcctcccaccttggcctcccaaagtgctggggttacaggtgtgagccactgtgcctggtcagattttagtttaagattttgtttgagcaagggttatggctgtaacaagcgagccagacactggattagatggcctgtgagaaaccttttacttttgctgtgaaaggagaaagaaacttgtttttcccactggtgagaagaattcaaaccacagacagatctgtaggtaggactgggactcgggaagctgaagttctttttactggcagaagcagcgcagccctaagcggtgttgtgcttcggagagtgttccctctaacaagaggggagtggacccacgctctgaaatcccatgcagtgatgtgatgatgacttgtcctttctctcctctgtgaaccgtagcagcgcctccggcccctcctgtgacgcacagcactcctgtaactgtctcagaaccactcctggagaaagacttccttgcaggagtgactcaagaattaatcagtaaataccttgaaatgcttgtaagctactgtgctgtatgtttctagtagccacagaataccttttaggcgacataaaaatcctcattttcgtgtggttttgttgagggggttctggctgatagcatatgtccagttcctctttggtcctaaccaaagggaagtgtacttttagggggaggggagagaaattccaaaaactttcagaaggtactgaagacatggaatttctgagggccagtttttccagtgctttctgtgagaatacttcattatttgctgatgacgcacttttccttgacctctgtagagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggtagcagagaggtgtttaggcacaaaaattaaggggagatcctagctttaattctgggaatttttgaggaaggatgacatttcatttaaagtttgatagaatcgggaacttctattagggaatggtactgcaagtagaacagaattgatttaagagccagaacgtttcctttgggctcctgacttcaggtgcagcccttttcagctcctgataatagcaggaagcggaaacgactgcatggagagctgtccctcccagcagcaggtctgtcatgagcacgaggccacttggtctaggagaatcatctgccttcctcctaacagtaattctcattcttgggcttagtctaaattaggatcattaatataatccagaaatcattagctgtcagtttattttaaaattatggcagctacatttaagccattttgtcttccataggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgttttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatatattgcttatctgaaatgcttgaaaccagaattgttttgcattttttgaatatttgtatacacataatgagaccttggggatgggacccaagtctgaacgtggaattcacctgtgtttcgtgtatatgcctcatacacataattttgtgcatgaaacagagtttttgtataagaagatacactgcagctgaagagggctgggtttttttttctcttagggtcgctgcataaactgttgtatgcctggtgctttgcgacttgtcacacgaggtcacgtgtggaattttccacttctggcatcacgtcagtgctcagaaattttctgatctcagagcatttcaattagggatgctcaaacgcaactgtttctacttccccatttcaggtgtgagatgtaacccaccttgaccataaattggcttttcatagtgctcagatgtttcataattcttcccccaaaataatgaagtttgcagtttaacaactttttttttgagagggggggtctggctctgtagcgcaggctggagtgcagcggtgccatcttgactcattgcagcctccgcctgccaggattcaagcaattctcctgcctcaggctcccgagtagctgggattacagacacccaccacgacgcccgactaatttttgtatttttagtagaggagacggggtttctccatgttggccaggctggtctcaaactgacctcaagtgatctgcccacctcggcctcccaaagtaaaaagtactagaattataggcatgagccattgcgcccagccaatttaataatttttttagacgtattattttgggctgggctgtggctaatcttgaagcagtgacttcctattttttggctcagacccatttgggaagctgtgaacctgagataaggaagtctgaaagtactagccggcagccgaccgtttctattcctttcgaagttaaggagacagcaaaggagctcccaggaattagggatccagttataaattgcacttaactcaaaatagtgccaatgagaatgtgaaggaatcttctggaaatgaaaccccacagctcaacaaaagcaagtttggtttatttgaatggtttcattaaataagtctacaaaggtaacaaactgaagcacaaagcgcaatcttacaagaagcgcaacacccagagttagtgcaaaatgtacaattaacggctgctgagaaacccccaaagtttgaatttttatttttatttttaacagtgtacattgttaaataatgtaaggaaaacatttataattcagaaagtttttaatgtggaaaaagatactcaaagtgtactattaacacaaaaataatttaaacagttcagtagcactagttcattcctctaggcttgttatttcatacacaggaggatgaaatcaacagtaaataacaccagttctgactttttttgtgtatgagtgaaaagatgtcaaaattattattaaacccaaataacaaatgataatgtgctgcatgaggctccactgctcctctggtataaagtatgtttcactcttgggtggcccctttctcagctactcagccccttgttggttctatccttactctctccacaagaaatacaagcagagaataaataaatcattttaaagcaggggtggaagcccttgcccttttcctttctaccttttaaaaaccttcagctctcatttgcatatttagggccgtagaccaacttacttacttattaagggaagcagggcccttaaggaatgaacagggtacaggagcctccagcctctttctgtggtagtggtggtggtggtggtgattcccagaatatgccattgacgtgggtaaaaggttggaaatattttcagtttcccaactaagagtcaagaagcaccccaaaattaagagtcctagcttctttctttgtcttcagagataacaaagatcctaaacatagccagttaggacagtatttccggaaagctctgaaaataattaataactacccattacaaggaggcatagcactgaataacactgattggttgcagttattacttacggggagtattatttatttgaaaatgtgaacatattagttgtacttctagaaataaaggtggcacaatagattatgatcctgcaaccatttggacatcataaaggaaatgagtaggaataagtattctttcctagaatgattaattcagatgtggaaagatagatagattaactttccacaaaatgtagtaccccaagctgagaaatgcatggtacatgtgcaacaagaggaaagcaatccaaacagtttttctgagagcaattttctccatctgtgacttttcactatcaggttccccaacttgaaaactagccccccacccccttctctttatgttcagtttcttctaggtcacgtctgttcaagcctagctcaa

SEQ ID NO: 14162 - DNA, 37308 bp, Human
accatgaaccaaacaaatttctgtttttgttttgttttgttttttaataaattacccaggctatggtatttctttacagcagcagaaaacagactaagacagagctcttactgaatgatctaatgccagaaaattggaagaaatatgtcttgttttcatttaattttaaggtagattcacgtttaaggaagagtcaataatttgtaataataaattattttttcctataaagtgcctatattttatttttaggaaacctttgtgtgcaaatacaaaatatgggagaaatagtaatgtaacagatttgcaaaccaataatttggggttagcttttacacaagtttttctattacctttgagaaagatagataatgggaaaagagagcacgcagaaagtaggccaaaagaagtaggatcagaacatcaacttcccagaactgtggagagtattctggattcatttgaattgagcagtgcctggaatctcttcatccaaccaatatatgccattttttcagtaacaccaatttaattttgctcttctatatcttcctagttcagtggagaatatcatgttatagaaaaaggtaatgataacttcattagctgaaaaaaatgtgtttctattttctagggttggagaatttgtctttgaattatttaagctgtatgactatctatttatctgtctatctatctatctaaatatatacttagatgatgcttaaacatgcacagaattacacttggctgtacacatatacatctaagtaatttttctatttctatattcccattcttttctcccaaaacgccagatataaaaatattccattaaaatgactgtattttctgattgagaaatcaaattccaatgcagtcacaaaatatgtttattagtgggtataccactagcaataaaatactacaagatatcttttagttttttttctcctgggtcattcattttccaaatcttcctagcttctaattctaatgaagcagttacatttatttctgtctctacatacaaggagaaattgttcccattgtcaaataagctgaagaaaacctttctttcctcccttctcagcagcatgggtgttgggctctaccttaacatttgaaaatatttatccttctgtcctaacttccatcactgccattgagtgcaattggtatcactgagctcactaatttgggacaggaataatgatgctaaagctcttgttagaggaatcattagggtttaaaaaaatctacacttgatggcctgattgtactattaagctaggatatcctatgtgtaatgtacaagtaattagggtgaatagagtgattttagagagacttgctctcaaagattgtagttgtccttgaaaaaatataaaggtaaaaagcagtggcatcttgtacaacaaaaggaaagccacaagaaagattatatgctagctatttctttattctctttcttttatgaagtctttacattctgataagtttcctgtgacatctagagaaccaaccacagtgaatagtcaataacaggaagtagataccatgcctttatgaagttgctgctttaaactggaatgccagttctctagcagaactacagtgttctacaggaccgatgacacttaaatgcttagatgggagataacttctgatgagtgtgattacacacgcttaggtcctctgcatttgccaatggcagttgaggaggcatcacttccttgcatggcgtttgtgcacaatttatgtttgtacccgagggcaagacaggttaataaggccaagaaggaggggaggctgtgggagtgggtaataactggggaggacttcacagcatcaacctgggggaaagggaggagggctgaggatgaagggtgttccctcctccttctgcctatgtgttaagtggcaagagaaattttgaaagctgctgtgaggaggagctactgactgggttttggggtgttttgtaccccaccctcctcacttgtaggaaagcctctttgcatttagacgtaattgaactggaaggaaggagactggccagggaatagggggaaagaaattctcccgttgctcctcctactgtttatcacttgcctccggactgtcttccaaaccaagctcagctgcatcaaggtggcagcagaataccctgtgcaagtgccagcgtcttcttagccgctctgtgcatcccaggctgccctgttatctggccaccgtccctggccattgggactgcttctgatggctctggcctctgctgccccagggagcatcttctgtaagcagctccttttctctctcctggtgagtaacaaccaaaggattagggaattcaagcatgttactacctgcttcctctctgcagtttgggcttgaaagagactaggagtgaggatgggaggcagagaagagagattggggaaaacaaaagcagatctgaggaagattcagggaagagttgagaggcttgggattcaggatggaaagtgttcagcttacttctcaagcacccactgccagagtgttaaaatttttcaagggaatccctcttccatcctgctgtggtgtttttctaagagtagagaagtgaattcattctttaggcatttggcccagaagtttctgaggtttacttctgctaccagtgattacataaactcatgttatttaacatgctgagttctactaagctgcaaaaaaagagaaaggattctgggtgaacatgcaaattatccaggacattttgaattttacccacgaagcagtttaagcaaagaatagtttaagaaaaataacaaaaatgtgactgtcattgaaaatatcctcaacttggcttccacttgggtttttaatagctttgtaactgtgtaaggtgctattttttctttggaggtgagggaagagaggggggttatttcacacatccgtccatcatttctgaggtgtgagtttcctattttttcattttagcaaaatacttgagtttcaaaatatatttttagaaatggcaggtatgaggacaaacattttctccatgtaaataatatacaatgcagggttgatggtcaccttctcatcctgtaactgcttagggagacgataactcagataccatcttaagttagtacaagtttggtaaaatgtggtaaaaatgtttcaaaggattctacccacatttcttttgcttctgatccctgtactgtctaatatctcttggacaattcatctcctgtttatttatttctgactctgaaactgactaaaagggtgtcactaagccacttagtcagtgatttaacctgaagacgggaatagtatttaatgaatggaaaccttcagtggctctgcctgcagagggaggaccatcaacatggaatcctaggacaagaaggaaagaagatgggggtgggagtggaagtgtggatataactataagaatgtctcatatatttatatatatatatgtacatttatatatatatacacacacgcacatatacagtcatgctctgcaaaacaatgcctcagtcaatgatggactacatatatgagtggtcccatagattataatggagctcgtctgtataggtgaaccattttttatcttttatattgtattttaatgtactttttctatatctaaaaatgtttagttacacaaatacttacaattgcctacagtattcagtagaggaacatgctgtacaggtttgtagcttacaataagctatactatatactatacacctaggctgtaccatggtgcataccatggggcatacatatataaatcatggtgtataccatgtaggtataacccaggtgtgtagtagactatatcctctaagtgtatgtaagtatactctatgatgtctgcacaaggatgaaatcacctaacgttgcatttcttagaatgtaagcaatatatgactgtgtgtatatatatacacacatacacatacatatataggtataggtatatgtacaggtatatgcatatgtatgtgtacatatgtatatgtatgtgtttatgcatagcctaattacaatatgctgtttccacattgtatacttagacaactattaacagtatggtctatgcttagaaagttctttaagtataatttattatgttccttggcattagggatgaacatatttaaaaagttaaataaatacgaatgtctcacgttttaaaaagtggtttttaaattaggactaaataaaaatgtggccttttaattccagatttctgcctaacatagatttttgtaaaattacaaactatttaattagactgctacagtatatctggtagacttgagatgagctggaaaagaagtgcacatccttaatatggatgttaatccattctctttcctcctcgcaagtaatgggtcccgtaactctagaattcagagaaaagctgaaagctgatcataaaattgacctacatgtttctggaaaacctagctctactctatcttatatttaaataataaaaaagcagttattttgataaagaggaacaaacagaaaatgccaagaaaaagaagtaaaatatattttgaacctatagacatttttgaaatgatagcttttcttttgtttttttcagatagtgtctatgtctttgaactacctaggttttaaaaacaatagctgggccttgaatttaattaaaaatcttcacccatctgaaggatactctccatattttgacatatatttctttttagattagtcatgtgatttgagatcatttagattttggcgttttggccaagtcagtcacaaaattgatttgagaacaatgattttttgggggcattatttttctgtgaggttaaaaaagcccttaactattttctagacttcatcaactataacttcaaatagtaaaatgatgattagagaattagggcatatatgtaattatgcatttcaaaggtaagtattttcttcatgctaaaaatcagaatggcatttatgaatggtcttagagacgtataacttctatataaagtcaatggtttgtgaaatattttcttgcattgacacaatatgatttaggttctaagaactactattcacttaatttttttcattgacaaataaatgacagtgctattcctaaagctattctctttgctggttccttttaaagtgagtattaaaaatgtaaagaattaaatgattaatttgtttccaaaattgacaatatttttatcaataagaaaaagctacaatgtgaaaatttgtgatcaaatttaattcctgatattttttctttttttttttttgaggttttaacattactttgcgatgcttgtcagaaagtttatcttcgagttccttctcatcttcaggctgaaacacttgtaggcaaaggtgagaaacactattaacagtttcatagctgtaacttgtcacatttagctgcaggctgctcttgtaaagtttgggataaaaaccacatagtaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaagaggcggagcttgcagtgagccgagattgcgccactgcagtccgcagtccggcctgggcgacagagcaagactctgtctcaaaaaaaaaaaaaaaaaccacatagtagctacttgaagttaaaatcggatgtacaataaaagacaggctacttgttttttggtagtggttagaaataattaaaataccaaagttagttgtatacttctcttgccaaaaaaattagcaaacatcagaaggctcaattatcttggattacgtcaaacaaagcaaggcaccaaaaccaggagcatattctaatttgtataaactaatctgctgccaaaatttcaaagccaagattcttcaattgattagacatgaaatggatgtctcaaaatctaaatgcccccaataaaatttgtacttgaggttgattacaatgaacaagtatccaccaagaataaatgtgacatatttcacagaacagcttgtgaaaatcaaatacagttttggtgggtcttagtaccatagccatctctgaagtataagttggttgttctgagcccaaacgtaaaatttttttcatcaaggtttttcactggctttgcattcacatgtaaaaaattacaaacaatacagaaatggtatcctttccaagccagatgttgttttgcccagtgctttaaggtttgaaattaataaacagtccacactctaaagacacatagtaaatacactaaatgtgttaaatatgaatctgtaaaggaggtaatttgataataaccacagcgcatcgggtttactaaaccttgaaagatattacagaaagattatttgcaatattactgggaaatattacttaagaatagactggttttcttcttatttatttatttagagacaaagtcttgctctgttgcccaggctgaagtgcagtggtgctatctctgctcactgcaaccttcacctcccaggttcaagcaattctcctgactaagcctcctgagtcgctggaattacaggtgcacgccaccatgcttggctaatttttgtatttttagtagagatggagtttcaccatattggccaggctgatctagaactcccgaccttgtgatcctcccacctcggcctcccaaactgctgggattacaggtgtgagccacttagttttcttatttttggcaagatagttttaagtatcaaactactgcaaaaagttcaaaacctactgacatcatacggttataccacttatgacataaaaaatcaagtttgtatacacatatataaatttatacacacacaataattaagagttcaaagaaaagagaataaaatcagtgacactaggaaaatattttatttctcaaattaatgtatgacgaaggtagtggaaaatgtgactccattaatataattatttaattttcatggcccccacgttttagaatagcaggtgctgagcacattccaaatgtaacctccctttttctgcttctcatgcattaactcacggctgtcattcctgtaaaacttgttccactcctgtttcatctgacaaactgctgtgatatttcttccctgcagtgaatctggaggagtgtctcaagtcggccagcctaatccggtccagtgaccctgccttcagaattctagaagatggctcaatttacacaacacatgacctcattttgtcttctgaaaggaaaagtttttccattttcctttcagatggtcagagacgggaacaacaagagataaaagttgtactgtcagcaagagaaaacaaggtataaggcaagggcttaagcagcctagcacagtcatatgcttacgggagtccttcgtgtttcatgtgttttaacgtgtttcatgttaaaatctatgctattgaatgacaaatttgtcttttccacttacaattagtgtaaataaagactagacttttaaggagtggcagagccatttacaaacttttataaagatgaatgactctgtagaccaggagcaaagtaagaatatcagagttttctaatagtgatttcaagtttgggaataagaacaaaccaacctgaggagcaaggacaagacaggggcgggtctaaaactcagcgaaatgtgattcaggctggagatgtgggctccaccctgtgcggctctcttcccactgattgcgggtttgagtctctctttaaagaggagaagagactgtttaaagcttactcccatcttactagaatattctatagggcaggccctctcttcagagagtggaggtgtggccaatccacagaattgatttgaatgtttaactctaggctcattttcttgcactgagcggtagagatcagttcagaaagcagggaggaaaaagttgctggaattcacatctcattttcagcaaattcaccacaatgaatttcgtcttataaaaccatttcttaataaatgattctatttaggagaggatttcccaactaaattctttttgattgtatgaactcctcttaatatgcttaagactttaaaaatgttattttatatccacattgtaaaatccccacattatataaaatcaagtatacttgagcaaatgctgacctgtgtctacatagatgtataaatgattgtattgtggagtgagggttttaacagattttggttgtaccagtcctagtggaataaagttgatccttaaatatttattaatgaattatctattttagggggagtttatactttctcaaagtggcatctttccaaatgccctatacatttcctggtggttaactgagtaaatagagaaataggtagaacgggggaacataatgtagtctgaggtgtgtgtgtgtgttttatcaatagaaatgctttgctgactagccatgatattgtaatgtgtaacccttacatctgcttgttgatgtatgtgtaaaataatcacagttccaaaaaatgataagcaatgctacatttctttgtttcttgtcaaatgtagtctcctaagaagagacataccaaagacacagccctcaagcgcagcaagagacgatgggctcctattccagcttcattgatggagaactcgttgggtccatttccacaacacgttcagcaggtgcatttcacttatttgattttatatgtgtccaaatttttttttgttcttaaacttttcatttgaattgcacagcatattgaatcagaggtttaaactaatggtacaaataatgatcatctattcaccagaactagggtcccatagaagtgacccagtatatcttattactttcttacagatatcatatttagaaatttagaaacaagttttatatttggagtttctggtgctcttaggtctatgtctaaattcacccaaatactatgctagacttgttaacactaatgtacagaaggcacacctacatgttttgcatagttcaactcttgcttaaactaacactcatcttttataaaaatgacctgtatttctgcttaccaagtaagattgcctcactgccacatagctggattgcaaacatagaacagttttgaaattttggagtatagtggcatcagctcagctcactgcaacctctgcctcctgggttcaagcgattctcctgcctcaacctcccgagttgctgggattacggacacccaccaccacgcccagctaatttttgtatttttagtagagacaaggtttcgccatgttgaccagtttggtcttgaactcctgatctcaggtgattcacctgcctaggcctcccaaagtgctgggattacaggtgtgagccactgcgcccggccaaaattttctaattcttgaggaattaattgtggaagaaaagttgctttacttctagttttattatcacataattttcaattccaaagaattcaaaatcacggaaactgttactgttatttatatgaagataagaataaatagataaaacttgaaaagtgtattactctacatgttttatagatatacaaatggcaaaaaagttgagatcaaataagtgacagaatttgtggctttgcacaatgcaaaatgcaaataaaaattcggaaaacatggcagataatgggcacctaagcagaagaaagaaagaataggagagtaggaaagaggggtagtggtaaaaaaataaaccatcacaagaggttaggttgaaaatattcatcatgacgtatttgttctattcctaaattattactgcagatccaatctgatgctgcacagaattacaccatcttttattccataagtgggccaggcgtggacaaagaacccttcaatttgttttacatagagaaagacactggggatatcttttgtacaaggagcattgaccgtgagaaatatgaacagtttgcggtaggattattgaaatatttattcataattatatctttattactggcttactaatattttcaactatgcttgtttacatattataagaatcaattatttgatttaatattcaagatattaatatgcaatataaactttaaatttctattcaccattgatggggaaaaacagtggatataataagggaagtggcgggggaggtaaagaaaatataacgatggaattttaaaggatatattttggtctgtaatcctggagaaataacaaagagttttactgaatttaaagttatccataataaaatgactcagttattctcaaccatggctgtacattataagtcatgtgagaacttgaaaaaaaatactgatgcttggacccatgcccaagtattctgatttaattgttctgggatgagatccagtcatccaacgtgattctaaatgtgtaagtgttggatccactgccttagccccttacatagcttttttttttttgcatccctttctctcactattcttcagcaatgagatcccttagtaccattttacttccttagtaacccagaacaagtttatcaattcatttgattctatcttatcctacccaaagacaagacaattctaactcttctgataattaaatccttttgtttctgttaattttatataactctttggtggactgatgtctcatctgatgaaatgagatattcatagtaggtttttggaatggtggtgaataaaactgattaagcatttattgtcttgaatgatataagagtataataaagttctttgctaaaggagaatataaaaatgaaacttatctcatacttgggcagttcagagagtaatatcttagcagacatctggagaatgagtagtagttagtggccacctcaaggcagttatgaaagaagttaacaattgtggggatgggaagtggtagacaagtattccaggaagatgcatcagaaatggaaatatttacttgttaaaaagaaatcaacaacaacaacaaaccctggctgaagtgtaatttgaagctaaggaagagtgtgaaatatgaagctagtaagtaaaaaatagagagggaaagaccttataatttatcctaaggagtagattctatcgtaaggatatcctccaaagcagtctataaggtagtgaaaaatttgaaactgtataaattttccactttagatgtttcataattaaatacaaaattcatggtgggattgtagtggcatattttctttataattttatgttcccttccaaattctctagaataaacatattttacttctagtaatataacacacttttactttaaaaaatagtgtatccaagttcttacaggagaagtaagctaagcaccattgcaatcactttgatctttctactcataaacaaataaataattgatagtaagttctctgctgcttttacagtttctttactagagaaaagatctaacactagaagtcactcttgaggagatataaaaagctcatactctgtatgttgcaatattcacttcattttcaattttgctgaggaattgtttgatagggttctgtttgccaacctgctttctatctttgcttcttactgtgatcattgccagagggaaaaggagagaacagtttataattaaaaataagttactttgctatttttaacatttaaaaaaatgtaaatgaataaaataggttgaaatttatcctcaaagttaaacttttaaataatttcgcctcagaattacccatgtttctgtaggtcccattaacacagttaagtttgaattggcattaagaaacaccacttgcaaattagtaaaattcattaagtgaggtatagcaacaagatgtaaacctgatgcaattataaaatcacttgaagcaggatagaatagaagacttccctgtcaatgcagaggttaaaataagataatatgtttttaacgtaatatactttaataatagtttaaaatattgaataatgtatgtttctgggaattggtagatcctaagtatctgttcctttccttgtagcctcaaacaaatcacaacctcctagagttcgctttcttctttgtttatgggctgctagtagctgtgttcccaacctcagtagtgttctgatcattaaatgccgtaataccagtgataccactatgtaaactgtaaaagttgttgaagatattctaatggtagatttaacaatacacgtgttctagaattttgtccttaaacctgggaattttcatggaatttcctaattctttgattttatataagccatattcatgttaagtattaataatagattatttttatttgaaataatttgatttcgtagctttgggagtagtagccataggtctaattcaatacatattcaaagaatagttatataagaagggaactttcttcaacaattccaagtgatgctgtgaaagcagctgcaaacttcctttctctctgagtgttggggataatctgtacctttggaaaagttagcttcaatctgctcctttcttacctattcctattcaaccagaaccttactatcttttattatcttgtttttttttgttgtttttttgatatagggtgtcactctgtctcccaggctggagtgcagtaatccgatctcggctcactgcaacctctgccttctgagttcaagcaattctcctgcctcaacctcccgagtagctgggattacaggcgcccaccaccacgcccagctaatctttgtatttttcgtagagacagggttccaccatgttcgccaggctggtctcaaactcttggcctcaggtgattcacccacctcggcctcccaaagtactgggattacaggtgtgagccactgtgcccggcctcttgtaatgtttattttctcttctgggcacacaagtcgattaattctcttcatatatgtgctgttaattcacattctgtacccactcagctttggtgttactgctctctcctttctctgccccatctactgaatgcctgccactgtaaggccaaactcaagtccctatttctgtcagtagctgtttgcatttttccaaagatgacagcaatttcagcaatatatagtgtgaaagggctaaaagagatgagattctttaagctatagaataattcagaggaaactatatcacaataacacgcacatgacactaaataacccacttataacctagctaaaaatacaactaataatattctaaattattttttattgtaacaacacttaagtatattattattgcttttaatacagaatgatggatatagtaataaaaccattacctctattgagttttttgaaattgttgctttgttgactaaataacatatttataatgagttactctatcatatgaacataagtcaattctcctagagagttaggctctgttttaatgatgattccaattttgatttattttggagatacttggttcattattagcacaataaaacaaaaccaggatactacctgaagtaaaatcaccaactctgagtcagcggaatgtgaaataatatttacttgtagtcaaataacaaaaatattatttcaaattacaaatgagcatatggtgggaagcagatgatcttcatttccattgaagagaaaaactaagacaaattagtctaaattatagcagtgtggacttagtaggttggataaggagacttgttaataccattttaatgaggtagaaaaattcattacaagagatgcaatagaatctttatgacaatttttacagaaggataactgaaggcgtagtttgtcttcctaaaaggaaagatgagtagaattgaatgcaaagagctatttattgaagacttacccaaggtaaggcagtgtgttactgtgtcaggtacttctaggatacacgtatcagtaagtctcagtcttcaagcctgacagcaactgtaatctaatagagatataaaaccattttatagttttatccagctaaaatatcaaaatgacagcattttaaggaataaaaatccacatcatctatacgaagagaaagggaaggatttttaggaagggtgactgatgttgatacctggatgtgctggtagtgatgatgataatgatgatgtgacagtggtagtggtgctgatgatagtggtggtggtgacggtggcgatgatgatgacggtggtggtggtgttggtggtggtagtggtagcggtgatgataatgataatggtgatgatggtagtgtggtgatgatggtgctgatgatgatgctggtgatgatgatggtggtggtggtagtggttgtgatggtaatcgtggtcgcaatgatgatgtggtggtggtaataatggtggtgatggtggtgatgatagtgtggtgatgatgatggtaagtggtgatgatgatggtggtggtggtatggtgaagtggtaatgatagactactgtattccactcctgaatttagaatttattgataaataagatatagagatcagactgatggaagccataatgtaagttttgttactgaaaaataccacctggaagttacttggagaaaaatgagtaggaaggcagagagaacatgaatggttattttaatacattccattccagagtttggagtgtacattctttcctttccaggttagcacgaacagtgaacatgaaatgttgccttttaacacaataatgaggattttgtggttaatttagcagttagtgggtaaatcactgacgagtctgattagtgagtatcgtggttaaaattgtaaagcacaataaaatctgacttctgaggccacatcgattagaacagggaatgtcagaacaactgcagcaaagttagtgagtcaacatgtagaatgcatttggagtcacctgaaaatgatggcagtgggaatagaaaagagaacatgcatgacacacacaaaaatgccaaaatctctagaacttggcaactgactactaaggcttatgagagagagggaggagtttgatgcctggaattttaatcctagttcacttagaagtggttacagtagggaaaattagaagagctagttgtggtaaaaagctgagttaatgcagaattcactttgggtaggtttagttgttcccatgagggatgaaaatccattcaacaactatttgctgaacacttactatgcacaaaccacataaggaaggtgtaggaataatttggagtttaaaggcaaaggacattaaatacatactggctgttggggacaaggcattcattttgaaatggaatttctggtatgtatatgcttttattaacatttttattgcaaagaaatacatgcttaccatagaaaaatgagaaaatataggtaaaaaacatataattgagttcctgaaatagttgtgatgtccatttatttgtatgtatatatacatctgtacataaatagaattgtatttttataaactttaaaaacacgtgttaatgacatagttggggaaaatctacatgcattctaacaagtaaaacagcatacagttaattcagagaacaactggagtgcatggtgcttagagtgggagaataatgagcaataacgctgagaggggattgaaatcacatggcaggcagagactgcatctgtgggttatctctctattgcatcatttcttagttacgggtctttgggaatgatttttttttttaatgttacattttcccccactgctaggcttacttttgtgcataatttgtggtttgagaatacattgatggtattttcccttctttcagttatatggctatgcaacaactgcagatggctatgcaccagaatatccactccctttgatcatcaaaattgaagatgataatgataacgccccatattttgaacacagagtgactatctttactgtgcctgaaaattgccgatccggtaagttcacattttattgtagcatgacaagaagactatttgacatttcgtaagtattataattaaagatgtttacgttttatcattgcattttatgcattttctggtatttctgattacatacactttttttcccattaggaattgatgttatatgacattgctattaagggtggtaattgactctgagcacactttcttaaatttaagcatattcatatgataaaatattatacatttttcccttttatatcatgattttataattctggcagcatttatttgactaaattctctccagggtggggttgttgctgaagttggtgtttggtttaccaatgcatgcttagaaagtctggagtgaaggaaatattgctcaattttgccattaggaaaagttgttgttcagtataaaagggactatacccagaaatccatagagaatattacaggggatttacacgtgggccagggatcattttttcttccaacaaagtaagaggttattttttcattcattcattcattcattcagtggttttttaaaaagtgtcatttaaggatatatagaagcctaaatgtaggaaaaattcaacttttccttcaaagcaagaaaaatactccaaaaaaagtgatgtaatcaaacatacaggaatgtctattttatggtgccaaggaatttttttttaacagacatttgaaattcaaaggatttgacttttgtaggctatgtatgtgtagtaccagtttatattaaaatcttataatatcagtgttgttttcctgaattctctttattaaatgactgttgggtattagctttcattttagcctagctttgtaaccagcgtttaggatgatggcaattttaggaaaacactagatttttgcttccattgaattccttattaatattttaaacacaattatgtagaacatttttaaatgcttgactttcaaggatatactacataaaacgttctagttttatgaggttatatacttctcaaaggaaaacctttctgtgctcatcttgctacccacatatagaaggcagctaattgatacataaagttactaactggttagattagtacacaacagatctgaatgtgcaacagacaaatgccattcatattaaatataaagatattttatatttttaccatgtacatatgtgtcacaggtgcgtttatgaaacagtacgtaatttgaatctttataaagtttcaatacattttcaaggaaccagaaatatatcatggcatggaaatatcgatctgataaataaaacatatacattgccttttttggcatatcttccaaacaaaatgaaaaaaaaaattaaactgatttgatgctatgtgcagccaagtctgtgacccaagactactaaggggtataacaagactgactactttgttttaaaatgttgcaagaacagttgttatttcctgtggcctcctccattctgtttccatgtacatatgtgtgaataatattgctgtttcacaatactaatgcaatgtgtctaatactctcatgtctggactatgaagcttgtctaaatgatacatagactactccctatgattttgtcttgcatatattaatagttatttgtatacattaataatttatcacatttattaaagtacaaagcataaaatatttgttattacatgaaaagatgtggtattcctctgattaactttatcaagttgggttataaaagaggcaaggtatgcagagaaggtcccattcaaaaatggtccatgaacacttatatgccattggtgagaatgtaaattagttcagcccctgtggaaagcagtttggagattactcaaagaactaaaaacagagctactatttgagccagcaatgccattactaggtatatacccaagggaaaacaaatcattctaccaaaagacacttgcacttgtatgtttgttgccacaccattcacaatagcaaagacatgaaatgaatccacgtgcccttcaatggtggattggataaagaaaatgtagtacacaaatgccatagaatactatgcagccataaaaaagaataaaatcatgtcttttgcagcaacatagatgcaactggaggtcattatcctaagcaaattaacacacaaacagaaagctaaataccacatgttatcacttataagtgagagctgaacattgggtacacatagacacaaaaatgggaacaacaaacaatggggattccaaaaggtgggagggaaggaggagggaaggggctgaaaactacgtattcggtaccacattcactacgggggtggtgggatcattagaagcccaaacctcggtatcgcacaatatacccctgtaacaaacccgcatgtgtacccccaaatctaaaattaaattaagttaaatttaaaaatagcccgtgaacttagagagaaagaatttcagaactactgtttctaagggtagtgtgggaactgttctcatctatgtagaatatgaatcatgttattcacaggggccacctaactgaagttcccgagtaagggaggcttggagacatttagaacagtttcacattcgtcaacttaacagtagaactaatctacttgtggtttgggggagaatttgctacagcaatgccttgattttattttgtttataattcaattatatgagtagaaatttttgacacttttggatttatctaaacaggaacttcagtgggaaaagtgaccgccacagaccttgacgaacctgacactctccatactcgtctgaaatataaaatcttacaacaaatcccagatcatccaaagcatttctccatacacccagataccggtgtcatcaccacaactacaccttttctggatagagaagtaatgatgattaattaactatctagtcattgaactacatttaaactgagaatgaactcccgagagaagttgcaatatggccagtctggcctcctttctcagcatgcttctgtaggctgcggttagggcttctctggagatgtcctcggtccttagagatgttgggaaagtaccatatattagacagggcctcacttgaaatcactaacctgatttgatttgttgatgataaaattgctttacatttattttatttttgttttaaaaaatacttttatctggctccaatatgcttaactttttaaattcataaagtttgttgtagcaactttgggttcacagcacaatttagtagaaagtacagacgggggccaggcgcggtggctcacgcctgtaatcccagcactttgggagcctgaggcgggcggatcatgaggttaggagatggagaccatcctggctaacaccatgaaacgccgtctctaccaaaaaaatccaaagaaattagccgggcttggtggcgggcgcctgtagtcccagctactcaggaggctgaggcaggagaatggcgtgaacccgggaggcggagcttgcagtgagccgagatcgcgccactgcaccccagcctgggtgacagagcgagactccgtctcaaaaaaaaaaaaaaaaagaaagaaaaagaaaatacagacggttcccatatactccctatccctcccaacacacatagccttccctgctatcaacatcctgccccacggtgttatatttgatacaactgatacatttatgttgacacatcattattacacatcattattacctaaagtccatagttctcacattgtggttcactcttggtgctatatattctatgagtttgaacgaatgtgtaaagacacacattcatcattatagtatcatccagagtggtttcactgccctaaaaatcctcctattgaggattattttgcttctgtagtgcttctcctattgatgccttcttctctcttaattcctggcaaccactgatatttttactgtctctatattttgcccttttttagaatgtcatatagttgaaatcatatagtatgtaggcttttaagattggcttctttcatttagtaatatgcttttaaatttctttcatgtctttttaagtcttgatagctcttttctttttagcactgaataatatttcattgtctggatgtaccagtttatttacctactgaaggacatcttggttgttttcaagttttggcaattataaataaagcagctttaaattttaaaatgttacattagacacatcacctttccattgtaccaatcagccaatatcttgttctgtactttatttttttttaacaaaattatacgtaaaaggaatatttgggccaggcacagtggctcacacctgtaatcccagcactttgggaggccgaggcaggcagattgcctaagctcaggagttcgtgaccagcctgggcaacacagtaaaaccctgtctctactaaaaatacaaagattagctgggtgtggtggtgggcgcctgcactcccagctactctggaagctgaggtaggagaattgcttgaacctgggaggcagaggttgctgtgagccaagatcatgccactgcactccagcctgggtgacagtgagaccccatctcaaataaataaataaatatataaaagaaaaagtaaaaaagaatatttgtacaataatcgtgcctaaacaagtggttgtgagaattgcaagttataggaaataaaagtgttcattaatgtagttttttcctttttttcagaaatgtgatacttaccagttaataatggaagtgcgagacatgggtggtcagcctttcggtttatttaatacaggaacaattactatttcacttgaggatgaaaatgacaatccaccatctttcacagaaacttctgtgagtatacctctctattcattcatctagatttatctactttttcaaaaaacatgtctagaatttggtagctctgtgagatcacaaagtttgacagtttgatttaaataactactacttacaaataacatagggagaaaaatatgatttctgtacaaataattgaagtactagttatttctggatgctagggaaataaccatgctcttggctaccgaagagcttcttagccctagacgtagctcatgtgttaaacttttattttattttattttatttttttggtgttaagctctgctaccagattccttggcattaaatctttatgtagggtgaaggaggagaggctctctctctggtgtcctttacatttcaacttcttaagatgagtaaggaactagcctacggagacagtagtacaggctggctcacaactccaaacaagctcttcctgtaccatgagtaaacttttccttaggcggtaaacaataagagatatatataaatatatatatgtgtgatgtgtgtgtgtgtgtacacatatatatatttatatttttatgacaatagtttcaggaaatggttctcctttcctgaacttttgataaataacctttcattttttcattaacttattccagagcacaagtcaaagaaggaaaaacctgcaagtacagtgatagacatgttcatgtaatttcttacatgaatccctacaatatatgaggatatattttacctcatatttcatatgaggaaatagaaagtctgttaagtcaagatctcatactaataaaccatatacaaggaataaccaggattcaaatctaggtctattacgctccagtgtctatcatcctcctatatgaattcaccttctatctctaacagattcaatttactacttcttttagtctttaatatcttatgcttttgtaataatatttttgtggagggctattgtttaatgtctcaaaaaaaaaggaaaacttttctgctaaaggtttgcaagtgaatcaaaagtacatttggaaacactggtgtgaaaacaattctccagaaataagaagccaacatacgtttataattacctacaagtactgagtgtttaatatattaacataagacatttattaagtgtttactgtgtaaaaatgggagaggatagactgtaaatattgtagaggtgcagagaagagataaatctgaggtctagaatgattaggaaaattatctcagagaagttcagaagataagacttggggtagcctttgaagaatggaaaagatatgaaaaggcaattcaggaggaaagaactaagctacgcattaaatttgtaaaatgtttccccatatagtgagggcagcttttcacatcactttatttatttttttctttaaatacgtgttttagaatataaagctacattgtcaaagttgtaaattgataataataaggggcaattctttcagtatgttacagaagtagaagaaaacagaattgacgtggagattttacgaatgaaggtacaggatcaggatttgccaaacactcctcactcaaaggctgtatacaaaatcctacaaggaaatgaaaatggaaacttcataattagcacagatccaaatacaaatgaaggagtgctgtgtgttgtcaaggtaaacaaataaaataatcaggctatgctttaaaatatcctaactcacgcactgattttaagagataattcttatatgtatatgactagactactgcagtgcaaggccaaatgatttatattggtttatataaactttgttgtttcttattctcttaccctaattttctctcttagaagaaagtcatgtcaggtacaaaactcattgttctctatatgaagaaaaccaagacagagaaatattgaatactgaaccagatatttgctttagaaggggtcttagacacttacttgtccacatttcttttttataagaacacaaaagaagaaaatggaagaatcactatttgaaatcaagcctcaacttttcaactcctttcatgttcatagtacattttatttttacctctctatgatgtattctgtaaaagagactattgaactaaatattcagcaacttttcccattaatccccctatattccaggtagccattgctttggattttttaaatttaattgcaattactggtttctaggatgattactttaactggacctaattcttttttagtccatctatccatagctctcattgacttcttgcatagcttcattcattaatttcttagagacagtttaagtcctcagaaggttcaggcagacattgtgttctcctgataagatttttagaaaatattctttaattattgtactgtctactttttctttctttatttctttttcttttcttgttcttaggttttttcccccttgatatttttttcaccatttaaatgttgttttaggattctttctaactattcattttaggactgtattagtttgttttcacatggctgataaagacatatccgaaactgggaacaaaaagaggtttaattggacttacagtttcacatggctagggaggcctcagaatcatggagggaggcaaaaggcacttctcacatggtggcagcaagagaagaatgaggcagaagcaaaagcagaaacccctgataaagctatcagctcctgcgagacttattcactatcacgagaatagcacaggaaagactggcccccaagattcaattaccttgccctgggtccctcccacaacaggtgggaattctgggagatacaaatcaagttgagatgtgggtgggacatagccaaccatatcaaggaccaagcgctttcatcaggaactaaacagcctgaaatataatgtgctttgaaaaggtgctgttaaatatcattctatcttttgagtcaggcatagagtaactgctgtattatagccaaatttctatctaattattgtatatacttagtttggaggcaatttagttgtcactgttatcccatataataagcagtaaagtaatttgaattttttcatacacttatcttgcatttctattaatatttaaacttataatgaaaaaggccgaaggcaagatcttccaaaagaaaaatgagaagaaaaatgggttgaatctgagaatcaacaattttgcatttggcaatgtttgtcactttaggaagctaattgttggtctttaactgtattagacctaactttaggttacattttaaatgtaaaaatgatattcctttgtaggaaaatttgaaattagaagtcttatatataatgttatatattgacttattaaagtatgcttatttaacagccattgaactatgaagtcaatcgccaagttattttgcaagttggtgtcattaacgaggcacaattctctaaagcagcgagctcacaaactcctacaatgtgcactacaactgtcaccgttaaaattatagacagtgatgagggccctgaatgccaccctccagtgaaagttattcagagtcaagatggcttcccagctggccaagaactccttggatacaaagcactggacccggaaatatccagtggtgaaggcttaaggtgatgtacttttcaaaaagctccttaattttaattgtgatgtaaattgtttttaaagttatgaatgttttatgtatttttcaaaatgacagattttaagatcatgtcccttctttgatttgaccgttcatatttgatttctaaaaattaggtatcagaagttaggggatgaagataactggtttgaaattaatcaacacactggcgacttgagaactctaaaagtactagatagagaatccaaatttgtaaaaaacaaccaatacaatatttcagttgttgcagtggatgcaggtgagtgccattttctacagataaaatataaatatacgacatgtttttaaggaaaccttgtggtgaaatctgtttatttctagacaaaacataattcaagcaatgtttgcatttttattgttcatgttattggatatcacccagtttaggcttcagtgcatctataatgcaaagctatgaggtagtgaatggccaaagcttaaggcttaattatatcacaataaatttaaatgtaattacatcacaattaaaattaaggtctaaggtttcaaagatgatctatatattattaatttctgctgaggaaatggtggcatactcaaggatcaccgttttttttcagaagtacaggtttagatacattatgatttgagcttgctgaaagggttcaacacacctaaaacagttgggttcaaagtaagtttgttctgagcttctcttaatggagaacaaatcatttatcctattttataaagcaatggtcaaacaatgacttaagtcttttatggtgatttgcaatcttttaccaaggtcaattttagaatcaattctgtaaagaatgtcctccaaatatagtaaagtagtgatctggaaattcttttgaacatacaaatttctatcagtaaaccacttgttagtatgtttaaatatatatttataaatatgtttttaaatatttgctatcatatgtatttttatatacatgtactattatactaatgtatacatcataaaaatatacaaaacatattaaaagaggatgataaaaatataagtagaagctacactcttccattttatcatattgatgacaaatttaccataaattttggcaaattgccataaataataaagataaatgaacttgggcttttataacatagcctattcgtttgactacctgcctaatccaagaaggtttccactctttttacatgcatatgctggatgttcaaaacaaactagctgatacaatgctatgggttttttttttcctgtgtctattgcatttctttagaaggaatggttgactgtattaataaatacatatgaaattccatggtaattaatataagttggtagtagtgaaaatgttcatgcttatttatttgtccctttgttttttttttaataacaaaatgcaaacaatgtgttctcagatattatacccctacttttttctatgatggcaaagaagactttatgtttactcatttattccccaactggtggtttgtctattaagttctaagtattagacaagctgacatggaaattaagaatgttaagataaggccaaattcttacacgatatcaactatagaattattatagtttcacaagagattctatgatgtgagaactttcctcaaaaagaatgtatgaatattatcagaagtggcgatcagttaagacctgctcagattaaggatgaaagagaagagattacagaaatgcagaggcctaattttttaaaaataaaatgctatctggagaggagaaaattatggagaacaaagtatttaaaaagtaactttgttttttggtgctaaaagacaaagtctgtaagcacagtgaatgtagtgtagaaaataaaaagcaaactttaacaaatctacattccagggccgtagataacctgggtgtgtttaataaaaaagtaaagataaggatgttacacattttagtgaaaaaccatatagtgatatgatggattttgtttctttgaactttaatccacacacacacacacacacacacacacacacacacacacacacattttgctctgatgctcatgattattcctggatgatgatctaggtattctacctgtcttagaatccaactttctttcttgtgtcaatcctctgtcagtctggctgatgtccctgctgtcagtcgagaaagcattgttttacataccttccacctagagtagcattgctcctcctgtctgaaattcaggccccttaacttcttcaaataaatggcaatgacaaggtttgtgattgtttccattagtctggattcagttcttctctaaataccttttgaactggggataacaattatcatatatggtgtggcttctgtagaaaaggctgctttcattgtttctcatgtatattctgttctcctaacaagcttaattatgagttcaattttgtataaagaccctttttctttgtaaatcgtccctttccaagtatctggcagaaaatgtggtatacatatgcacagtgcaggtgctgatatttgtcattcctttgttgtttgagagtcctatgaatctccacgttatacatttcactgcaaaaagctttacaattctagggacataattagcacttgggaaaactgattttaatgtagaaaattgagattaaacatttattaagtgcttctttatttttcccttctgtaagaaggattttcttaagagaacaaatatttaagggttgtcatgtacaagtggcaaacattttgcatgtatagtccaaaaagaacatgaacaaattacaggaaatcattaggaggcatattgtagcttaataattaaaaatttaaatcttttaacaattaattttaaaatttatagagtaggctgatttataatacagtgattctagttactgaaacatttgagtagcaataaaaaacgactgctttccagaattgctgttgaagtattatgaagatttttagttaacccaagatgtactttctagctctgtgattggtgtttcttactcatttatacttgatgtttgcttatgtgcttaatttaaagtaaattttagaagtaaataaacacaccaatgacttcatcatgctcagctattatcagtaattacttatttttggctgtttacctcttcccaggggtaaaataaaaacttaccatcaacctcttgtaatttttgatatcttctaagacaagcttgtccaacctgtggcctgcaggcagcatgcagcccagcgtggctttgaatgtggcccaacaaaaattcataaactttcttgaaacattataagatttgtttgcaacatatattttttagctcatcagctatcattggtgttagtgtattttatgtgtggcccaagacaattcttctgttttcagtgtggcccagggaagccaaaagattggacacccctgttctaagaccttctcagctttgtctttgattgccttccatttaaatcatttcaagcatctttcatctgtttttatcaacatgcttaaagcagagactgtaatagaaaatagtaagttatgggataaatgttggttgaatatgtgattaaataaatcttgatttgcgttactataattaccactttttttggatttttaaagtgtgttttcttacgatttttctataaagagaaaggctttctgcttaaattttaaaaggtgaaattatagtatatatatcaactcatgtgtagtgtatgcaactaaattttttactttataaggcctctttttcatattattcatttcttagtttgctgattttaaagttattacttatattcaactttatttgctattttctggcagtctcaaagtatttatatgctattgcaaatttcttcaacaaatagctatatctctcttttatttctggatatttttaaatttgttcaggtagttttaaaataggcataaatagtagttactttatacaaacaattagtttaaaagtcactgaataaattaattttgtagttattcaacagaaaaaattcttttgaaatacactacatgatatgacttagggttatttcaaattaaaaagaaaaataaattatatttgcatgggagttatagtagtctttatgataaattcaacatacatgtttcaaaatgtggaccagtatttaaagcaaaaacatgaaaaattacatcaattacctttctgtttatttcaattttgatatcttatcatttattgtagtttattatccttttacaaatggtcggatttgacatgtttctgaacttcattatctcttaaacacaaataatgggcactattttaactaaaaatactatgtgtgaagtcttaggccaataatagtggcaatcaacagatgagtacgagacagttcctgttgtcaagaacatatgaattgcattagggtagagatgaaaacttatttttctggcttattcaattaaatgttttcaagtataaaaataggaactgcattatgttcaatgtgtcagtattaagttatagttagctgggaaatactgggcaaatcactaggctctcaaggtgaatacaacttactatgctacttttgcagttcagtgtgtgagccaaagtattagcaaagagttctgagaaagcactggaatatggctaccattgtctgtggaagtcacgagtttcatgaggacgtgacatttaagtagattcttgaagataatagtgtgctatctggcaaagaagaggagaaaagtattcctaggagtggcaaccgaatgctacaaagcagacaggaaggggaacacttagtgcatttctagagaagttttcaaggtttgggaaaaaagtatatgatgcaatggagaagctgagaaagtgactgacaaccaaatgtaaagtgtttgtattctaaggatgaatatatgcgcttcataaagaaggatgtaagacatctgttttattttcaacaggtcattctgtagtgaccttcctcataatctcataccttttagttttgaaaagcatctgaagaaattatctgatccagccctagtcttcaaagaaaagtgacatgtccctattttgtagtcttggtgtctgaaatctgggaagcatgtatgcgaactcaagctcagacagctagtagaaagcagatgtcaactgtgtattttataaattgttgaaaataaatgcattttcatgtgaagaaataacctatttttaattaatcttagttggccgatcttgcactggaacattagtagttcatttggatgattacaacgatcacgcacctcaaattgacaaagaagtgaccatttgtcagaataatgaggattttgctgttctgaaacctgtagatccagatggacctgaaaatggaccaccttttcaattctttctggataattctgccagtaaaaactggaacatagaagaaaaggatggtatgtaatcatgctaaattttatagtcaatacggacttcagattggtgatggttctttcaccttagtttatcataataaatacacatttattttaggaaattattttattaaccctaaaaacaacaatacctaatctttaaaaaaaattagtgccattgtggtgagcttagactcttgttctgaatatcttttaagaaaacatataagtccctttttaattaacatttgagcaacatgttaagtacagattagtttaatatcagcataaagcaacatcaattacttttctggctcttctgggaaatcacaaattcaaaaaaaaaaagaaaaattcgagtttttattctaaattgattcccttccactgagaatattgagtaggaataatactgccatctaaacagccaatccatatatattctgtcttttttttccctaggtaaaactgccattcttcgtcaacggcaaaatcttgattataactattattctgtgcctattcaaataaaagacaggcatggtttagttgcaacacatatgttaacagtgagagtatgtgactgttcaactccatctgagtgtagaatgaaggataaaagtacaagagacgttagaccaaatgtaatacttggaagatgggctattcttgctatggtgttgggttctgtattgttattatgtaagtatattaagtatcattatctagaatgtgttagctaaaattttatctagtatttttaaaacatggaagttttttatattaatagcctttgggaagtgtgttcttttaaaaatattgtatctattttatgtcttggggctctgagtgataaatgtatcagtaacagcagattaaatttaaagtcagtttcagaggtggtagccttagttcttcaataattatctgtgagacattgggtaaattatttcctcctttttgaactcatttttccatgtgtaaaatgaagaggctgggtaaaactattaagattccctccatgtaaaataatatagtctttcaaccagccatgtttatgtagggaatacatacatacaaaaagaatttgtgaaaacagagctattccaaaatttactcagatatttctgttccatattattaatgaagtgatttagcatcatcgtaagacttccgtgagtgaaaaatggtcatatgagccactgaggaaaagcaatacaggcaaaggatgctaagattttgcattgtgcaaactgttatttggaggtacaaaagtaatagaaatattgcccacgcttaattaagactgcctttttctctttctttctttctgtttctctcttcttttccttttctttttctttctctctccctctgaccccaaagaacccatttgcatttacaaacttttcctataatctttactgtatcctaattcattgatctgagtttcagattaaattggatattcctcttagcactttattagttgatgtacatttttgaaaccagacaccaattttatgtaattgcctttcttgtttgtatttatgcctaatgttcttagtcttgttattttaagccctttaagtgtgttctgtatgattttaactactaatgatgctatcttaaatatcagttagatgaagttaccatttcaatgtagaagaaataaaagacacatataagttaattctggacctgggaagagagctattattaatctctctaagctacaaatagtataaatacatttttaaaatattctgtttttaaatcttgtgacctgaagagctcaatttgtggaatgaatttttgagacatatgcaagaagactttaaaaaatcatgtaatcaaatgatttaatgtctgtgttttactttgatcttttttgctttttaggtattctgtttacatgtttctgtgtcactgctaagagaacagtcaagaaatgttttccagaagacatagcccagcaaaatttaattgtatcaaatactgaaggacctggagaagaagtaacggtaaatcagatttcacatccctttgaattgtacggtgaacaaatgatgacagattattactcaacaatgtcaatgataatatcactaatgtttattgagcacttactatgctaagcagagtttcaagtgccctcagtgttttaaatcatttaaacctcccaattctacagggctagggctgtcacaacaaactgagtgacttaaacaacagacaagtattgtttcacagatctggagactagaaatcagagatcaaggtgttggcaggtccgtgctccctctgaaggaactggggagggatctgttccaggactctctcctagcttctgccaattccctggcttatggcagtggaaatcaaatcttcatatggcgattctccatgtgtgcatgtctgtgtccaaatttcccctttttataaggatactgattatattcgcttagggacccactctaatcccatataacctcatcttagctaattacatctacaatgaccctatttccaaataagttcacattctgagttactgagggttagggcatatgaatttttaggggactcaattcaacccatcacacctatgatactattattctgattttatgtatgaggaacagagaggcacagcaggcaagtgatttgcctatggtgaaaaaaaatgaaaatgaattgttagtttccatttttcaaattcactttatcactctcactttacttttaggaagcaaatattagactccccatgcagacatccaacatttgtgacacaagcatgtctgttggtactgttggtggccagggaatcaaaacacagcaaagttttgagatggtcaaaggaggctacactttggattccaacaaaggaggtggacatcagaccttggagtccgtcaagggagtggggcagggagatactggcagatatgcgtacacggactggcagagtttcacccaacctcggcttggcgaagtaagttccactgtctttgaggtcatattacatggaaattaaatgctagttataaatcagaatttcccaaaagttttactcctcatatacctggaattcaacatcttttacctgttggattatcatagatgtggatgtctggtttaaacccaaagataaaaatgatctttgaaaattcacctttgaaaatacagtttacaaaactttatctaggagtgccatatgtagatgtgtttacaaaggataaaaggttcatagcctcttccctagaaattaacaggaaaaccagctggagtgaaatatttattatacaggaatgaatggatcataaattataaacatttctcagtgtgcttgagttctttgtgtggttatgaagtcctggctatcaaaatcaaccagataaattgttgagcttttattttgagttttagttccttgttttgttttatgttcagattaatcagtataggtttgatattagccagtttaatatattacactatcacagttatatagtagtgtataaacataggaatcatagcctatattggttttcctcaaatacgtgaagaagctacaaaggtaaatttcaaatatacatgttttgtgttcaaatgggaaattataaatgtgttgcgtgatatatgcgtagtcttaattttttaaatgtgctcactagaagcatttatttatttgctatattttaagagtgactataatacagaccaatcctgtgcattttttatatataggaatccattagaggacacactctgattaaaaattaaacagtaaaaggtaaatcaaagacatcatttttctgctaatatgtttaggtgttttttaaaaaataataaaatgtgctcttttttgatacagaaggtgtatttgtgtggacaagatgaggagcataaacattgtgaagactacgtttgttcgtataactatgaaggcaaaggttctctggccggctcagtaggttgctgcagcgatcggcaggaagaagagggactggagtttctagatcacctggaacccaaatttaggacattagcaaagacatgcatcaagaaataaatgtgccttttaatagtgtaatatccacagatgcataagtaggaatttattacttgcagaatgttagcagcatctgctaatgtttttgtttatggaggtaaactttgtcatgtataggtaagggtactataaatatgagattcccctacattctccttgtctggtataacttccatgttctctagaaatcaaggttttgtttgttaattctcttttatatgcatgtatatattgcccttttcacgactgtactgtacaccttcttgcaccttttatttgcaaactgatgttactttttgtgctgtggaagagcatttgggaaagctgggtattatagaggccaatgaaagatgaatttgcattgtagatgtacgaattaaatatgttcttcaaaatcttggggagaattatgttcttagaacatagttggtgccagataattgcattctctccacctgagtggtttaaaaaggacttttaagtattcttcagtgcaatcttcagttttgtgattaagttcatttctcttttacacttttgtactcctcagagcagtgctcccagcattgttttctttcaggatccttcagagctcagtccctggacctctgcccatgtggatttgttgttaggtcactccaacttctagggttcttggaaagataaggaccagaacaagctcatagcaaattgaggggcagagattttatgaagattacatgagaagatttccatgaaagaattgcagccctgaggtccatgggttgacttatgctcacaaatatgtttcgtttgctcaacatggtttactactaacattttaaaaatataaatactttagcaaaaacattcactcttgagtttgacataggcctgccttatctgtggttgccacctgccatctccaagcatttggacaactagccctgatgcattaggctgcaactctgatatacagagactagcaccttgaatatgccagaaattgaattaccatctgtattagaacttaagactcagcctaaatttacagttactttaagaaaatgggcagtcagaattagggactagaatgtatatgagaaacccccactctactaaaaatataagaaattagccggacatggtggcgaatgactgtaatcccagctactcaggaggctgaggcaggagaatcgcttgaatccaggaggcggaggttgcagtgagccgagattgccactgcactccagcctgggcaacaagagcgaaactccgtctcaaaaaaaaaaaaaaaaaattgaaatcaattacagcaacacttaccaaacatttgtagaatgatgaataaatgaacgcacacattcagaaataattttgaatgtataacattttaataggatagtatattttattaatctaaaaagaaactatatatttaaatagcattttcgtagtcatttgtggcaaactctataagtctataaacaataacagtatggaaatttctcatccagaaaaaacaaagacttaaaaaaatctattaactagatattttctaactagttaactatttttaaaaatgagtggctttttaaaaaaattttgtgactagtcttctaattctcagttccaaattaaaggcgcttcttgatatgaaattggatattggatcagaagaaaaaagtgattttaataaatcagattttataaggtatccataacatataatttttataaccattataaaatatttttgtggtcatgcaatttttgttctctgatgtacaggttgctctgataatatcagttctaaaattttaaaatataatataaatttggacatttatcataaaaagttacattcttgaatgtaggtacaaaatgttcttggagtaattaaaaatcattaactgaaccttaactttaattgtacttttatgttcagatatacattttctttcccataattaagcaagtgaaaagaaatatgaagacaaacgaacatatgtaagttaaatttcagctaatgatttttagttactccaagaacaatttctacctacattcaaaatgtaataattaatatccagaggtagatagctcagtcagcaagagaagatactccaaaagcatttgaaaaattattagaaagtgtgagaaataaatttgtattaaacagttttggccatttaaaatattttcaaaatatcattagagtttatctcagagaaactttgactgtcttttggtttacttaggcaattcaaaatcattctctgcttactcccaaaattaaatgttaattgtatgtttgataaaatatgtgacactctatcagattgcttacaaatttcatttgttaataaaagattgcatttcatggatttatttcataaaacttaattgtcagttaataagttaatagttatgactggtttttctagaattaaatcagtattgaggaagatatacagttaaattttcttatcttatttcagatctcaaatatttcatgtgaaaaaatttcatgagaacaccagggtagatgaaaatcaatgtaattttataagtgagcttcattagacatgtcctaattttactgaacttctgcttactcctgtgtttattaaaagtatttcatacaacttgacatctatgcatatatttactttcagaaaagtcatatgctgtgttatttagaaaatgctcaaaatagatgttttagagtcaaagatttttattatcacagaaaagccctctttttattgcatggtagttatgaaagttctgtactagttgaaaaacctaaatgaaattaaggtaatgaaacaaacaatgtatattgctgcatttttctactctcttttatctgcttttctaataaatctgaaggagtgttgcatttgactagacactgcatttgtctttctgcttttgtagaaaagaagaaaataaagaagtatagcagaagaaaacgttactaagaatggatagattcttgcatattttatagggcccaataaaattaagttagcgtaatttttcaaaactcttcaaaaaaatgtttacataaaaaataaaaatcacattatattacctcaaatccttactaccaaaaccaaaataactttttaaaaatagttattttaaatagactaatttaagtgtattagaaggattataaaaacaaatgtgtgaagtgcatttataatatatatcttatgaagttaagtcttttattattttaagatattcacttcttaaagtaagttttttgattgaccgaaataaaatatcctttcata

SEQ ID NO: 14163 - DNA, 37308 bp, Human; identical to SEQ ID NO: 14162
